United States Patent 9,328,346 (POLYCOMB-ASSOCIATED NON-CODING RNAS) - sequence listing, part 131

SEQ ID NO: 191613 - RNA, 122290 nt, Homo sapiens
gcggucgaagcucacgcgguaagccgcugcacgugugcuacggcgggcggagggccgaaaguccaguauguggguccagggucacucuucuagagcuuccgcaacggaaagugugaggucaguaguaguuuuugugguacgugcagugguggccgcuucaaggacuauuuucgucgcugcuugcguuuuaagucuccaauccugggacgaggcccauuucaggguuuucugucaccuucuagccgcccgccaccccagaggggugccagaugccccaguuuuugagugcaugcaggcaggcgaaaguggcucgaaaagaccuccggccugaaugaucuccaugaagacgcggucacgcagccuccacacucucuuccccuucucgaaaauucugugccauuuaaguuucaaaaucccuuauaaaauaagugucagagagcuacguguacccguuucuuccaaauuuucaucacgaaguggagauuuggacguacuauuuugugaucucuguuugcagaaaguggguacggcaucagugccuucauaaucagggcaagucauuuuaaaauaagauuuaaaaacuacucuagaaguagcuucuuggaguguguggagagauuuccaaaguaauuuuaacuuuuacugaauuuaagccuuaaugcuuuccgugggaauauauagucucccuaaaaguuauuacagcuuuucagucaguugaauuuaaaaacugcuuuuugaccaguagaaaagaacccuugcuuuggagacauuuucaugccacuuacgaaaaauuuuuuuaaaaaauuaaguugugacaaaguaauccauuuuuaaaauuuuauuuuucugugaugaggaguuaauguuuuccuuuucauaaugagagagcauuugaaacuuuaguauagugguguuccuagacaacuuuuaaagcucuuaaaaaauugcgguggcuuaggccuguaaucccggcacuuugagaggccgaggugggcaaaucacaaggucaggaguucaagaccagccuggccaacauggugaaaccccgucucuacuaaaaauacaaaaauuagcuggacguggugucacgcgccgguaaucucagcuacuugggagggugaggcaggagaauugcuugaacccgggggguggagguugcagugagcuaagaucuccagccugagcgacagagcaagacuucguuuggggggaaaaaaaaaaaaacccauaaaaaaucuguguuuuaauuuuccuucaacacuuaugaauggaaagugcaguauuuuaguauauuacagauaaaauuacauaguguacauuuauuuuggaauauuuuugcauuugauaaaguauaauauuauguaauuaaaauuauuuuugaaguaauaggcaaaauuuuagguauuuuugcagucuuuaaucccacggaaucuucaaaaauaguaaccaccgugccuuuuacauaaaauagacuaccaguuuaaagcauuuguucuauuacuuguaauguuucucuuuguuuacauuguggaaguccuuuuuaugggaggauauuuucuaaaaaaagaauauguacauuguuucaaaguauugauuuauguaagugaucaaaauguauaugaguucaguauaaguuuguaaaaguuuggcuagagauaauuuuaaggauagagauuauauaugauaaaauugcaucuacuacaaaauacucaaaagaauuaguuagugaaggaaauauugagcucauuuuuaauauagaguuugaauuuugauaacugcauuuaggacaaaacauuuguaagaauugaacaugauguaguuuagucuucauucauuauuaaugguggauuauuguaaucuaauuuaagguauuguucuaguuuuucaggaauuguucaaauggaugaagauacacauuacgauaaagguacugacacuaaaaauuauuuugggguguaagagcuagaugauacugauuaauuucuaauuuuccuuguauugugauuugauuuuaguggaagaugugguuggaagucacauagaagaugcaguaacauuuugggcccagguaaauagcaaacugguugauauccccccucaccucccccaauccaguuccuccccaacaaaaacaaaaauaaaacccaggaauaaauacauuugucauucucauugccuaauauuuauugaauuauuuaucaccaggcauuauuaggagacaaauguugacagcugugauguuacuugacucauuaugagucaaguguuaugcccauaauacaccaaguuugaaaaaagaaaauuggcaagauugugauuucagaauuccacucaauucuaggcugcuuuugcuggauucugagagccuguuguauuugugaaguuauagccccaucuaggggucuuuuauaagauuguuucuugaaggaggauaaguuaaaaaucucggucguuuuuucuaauggcuuaaauuugagaugugguauuuuucucauuauagaauuggaagcaugaaugaaacauuucugauuuucuguugggagggugucaguuagguaagguuacucaguuuuaaauacaaagcaagcacugaagggcuguguuccacaauuuaagaagguaaauuccucugaugcacagaacgaccugcuaauuuuugguuuuguaaacuauacaugauacggaagggaaagaaauuacguuucucuauacucccuacagcaugggaacuccuuuugguggggggugaggugaacucguaaugugggaaauaaggagaauauaugagaagaaaguucuagaagaauaugauuaacccagaguucuuaaauauauagucaugcaucacuuaaugacugggauacauacagagaaaugcaucauuaggcaacugcgucgcuguaugaacaucauagaauguacuuagagaaaccuggaugauauagccuaccacauaccuaggccaugugguguaccuguaccucauguuacuguacugaaugcugcagacaauuguaacacaauauuaagucuuuauguaucuaaacaugaagguacaguaaaaacauauuauaaaagauuaaaaagugguacaccuguauagggcacucaccaugaauggagcuugcaggauuagaaauugcuuugggugagucauugagugaguagugaggaaugugaaguccugggacauuacuguacacuacuguauacuuuauaaauaccauacacuuaggcuacacuaaauuuauaaaaauauuuuucuucaauaaaccuuagcuuacuguaacuuuuaauaaacuuuugacucauuuguaguaacacagcuuaaaacaaacauuguagagcugugcaaaaauauucuuuacguccuuauucuaaagcuuucuucucuuuuuaaacuuuuaauuuuuuuuuacuuuaaaaacuuuuugguuaaaaacgaagacaagaucuucaauaucacugucuuucacuuccgcuucuuguccuacuagaaggucuucagggucaguaaugugcauggagcugucaucuucuguaauaaaaaugcccuuuuggaauaccuucagaaggacuugaggcggcuguacaguuaacuuuuuuaaauaaguaggaguacacuaaaauaagaaaaauuauaguaaaaaaaaauauauauauacacacacaccagugacauaguuauuuucauuaccaaguauuauguacuguacauaauuguaugugcugugcuuuugugagacuggggcacgguagguuuacaccagcaucaccacaaauaugugaguaaugcauuguucuaugauguuacaauggcuaggacuacacuaggcaauaggaauuuuucagcuucauuauaaucuuacgggacuacuguagugugugugguucauucuuugaccacaaugucacuauguggggcauggcugcauguaaaaaaaaauuguagaagggugauguuauagaaaacuuggggcaaauucgugugucugcuuaugcacauauauuuggcaaauuuguuucugcuuaugcauauucucuaaagguugcucacacguucugguuccaugcccauugucucuguauuagugacaacugcaucacucucaacagugucccaggguggaugauaaauuauauuuaagcuuauuauacagaaacaucauuuaucaguguaaaaagauuuucuagacuagugcugucuaguagaaauauaugagccauguaaguaauuuuaaaacauuuuuggcagccacauugaagaaacuaaaaauagcaggugacauuuuaauaaguacauuuuauuuaacucaauauauccaaaauauuguuucaaaauauaauuagcauaaaaaugugaacaggauaguuuauauuuccuuuuuaauauugucuuugaaauccaguguguauauuagacuuacagcauaucuccuuagacuagccauauuucaaguggguauuggcuauuguauucacuagugcagcucuagacuuugauuucaguuuacuuuauuugugaauauguugauugaauuuggagcaaauucaagagucagcaguuuuuuuuuuguaaaggaucagaugaugaguauuuuaccauuuuuaggccauacaguuuguuuugcagcuauucaauucugccaacauagugcaaagcagccauagacauaaugugaaugaguguguguagcugugaugcaguaaacuuuauuuacuaaaacaggcggcuguaauuugccaaccucugaguuaaaccaugaaguugaggcucuuguagaagaacguuuaaaacaggaaacaugcgcaugaaaagauuaaacauuaaaacuacuaaugguauauaaaugaauguagugguuauuucaauaagcaaauuggcaaauuugguugggguuauggugggauauaggcauagagaagacuagagauuuggaaauacgcguaggcagauuaggaugaaaaucugcucacguguauucuccauuuuuuuuugcccugugggcuucugccuuauaaaccacuuauaagcaaacacuucagauuggaugaguggcagcugaaggaaucugacguauuugacuccaccuguuucuuugaaagaacaagcuucuggucaggcaugguggcucaugccuguaaucccaacacuuugggagaccuaugugagaggaucgccugagcccaggaguuugagaccagccuuggcaacaguaagaccuugucgcuacaaaaaaaaaaaaaaaaauuagccaggcaugguggugcaugcuuguguucccagcuaugugggaggcugagggugggaagauugccugggcccaggagauugagacugcagugagcugagauugcaccaaacaaacaaacaaacaaagagcuccuauuuguuuuagucuguauagugaaaaaauauaguuauauggaauauuuugauuccagggguuuguucacaaaggcugcuucucuuguuucucagggucaguuuaaauucaguuccuguucuaugcugagacuuugauauucaucaugauguucuuugaacugcucuuucagaguuuuuuuucagucaucacggauaaucauguucuuucuagcauuauugaauauuuuguugguauauuucuuuagaacauauauauauauuuaacauuuuauuuugaagaaacuuugacuuacaggaauguugcaaaauuaguacagaggcuagaauguggcucuguauacucuucacccagcuuccuuuaaugcuaauguguuauauaaccacaguacagugaucaaagccagggaauuaacauuaguacaaugcuauuaacuaaacuacagcccuuauuuaaauuuuagcaguuuuuugucuuuuuguguuccaggauccaauacagaaucccaaauuguauuuaguuguguauccuugguuuccuuuaaccucugaauguuccucaguuuuuccuuguauuucaagacuuuugacacuucugaugaauauuaguuauuuuguagaguaucuuuuaauuuggguuuguuugaugauuucuuaugaauagauuagcaagaguuccacagaagugauauuguaguccucucaguauaucauauugggguuucaugaugugauauaccuucuuauugaugauaaccuugauucacuuggguaagguggcaacuuccagguuuuuucgcuguaaaguuacucuuuucuuuuguaauuaauuaauguuuuaggagacuuauuguggcugucuaauccaguuucuguucaacuuuucacccacgaauuuuauuguuuauugcucuagugcuugccuaaugaugauuuucuauuccccucauuccuuccacauuuauuaauuggaauucuucuguaaggaagagcugucucuucucugccauuuauuuauucaauuauuuauauuaauauaaacucaaggauauuuauuccguggguuauaauccuaugcuaucauaauuuauuuuguuguuuaaauuauucagccuuggccauugggacaaaguucaccaaagaauacagauugguacuuguccuuaaacgucuccuauucuuuuuuugagcacuuuuuuuuuuuuuuuuuucaagacagggucuccgucaccaaggcuagagugcaguagugugcucauggcucauugcagucucgaacuucugggcucaagcaauccucccaccucaucuuccuguguaguuggaacuauaggugcacacuaccaugcccggcuaaucuuuuguauuauuuuuguagagacaggauuucaccacauugccaagcuagucucaaacuccugggcucaaaaaugauccucccaccucggcccuccaaagugaugggauuacaggugugagccaucgcaaccugcuuuuuuuuuuuuuuuuuuuuuuuuuuuuagcauuucuuuacuuucuggcaccaucaaaugucccaggaucaucuuuuauuucccaguuugagcucugcaaucaaaucaaucuuuaaggaauccuuuccauaugauuuaauuauauuugguaucuuguuugaauucuaccuaauuugaacacauugggaaguaaacuuuuucuauggccuagucucauuucuuauaaauaacucauuuaaauuaugaaaaaauacaggcauaagaaguugauuuaauuucuaauggccuaaaaucuuuuaaguuuaucaugcuuagaacccucaagcguguaacacuguaaaauaauauuuuacuguaucuuauacuauaucuaaucuuucuagaguaucaauagaaauaaggauaucaugaagauugguugcucacugucugaaguuugcccccaggccaguucaguuuuggggaaucuugacccaaacaaggugagccauauucuugaauauaauuauuucauuccuccugucagcuuuccugugucuuagauauuuaguuuuuggaguuccugguauauuugaaaagaagaggcugauuuuuggaauuuguauaaacuacuguuaugguauauuuauuaauucaaaaauacuuauggacugaauauuacucagucuugaaauuugacguaagcuacaacauggaugaaucuucaggacauuagcuaaauaagccagucacaagaggacaaauacuguuaugguucuacuuguaugaaguacuuagaguagucaaaaucauagagacagaaaaagugagugaugguuaucagggacugggggaagauugaggaugaggaguuauugauuaauggguguagaguuucaguuuuacaacaugaaaagagcuauggagauggaugaugaaugguggcgaagguugcagaacaguaugaauguacuuaaugccacugaacuguauacuuaacaauggucaagauagucaauuuuauguuauguauaguuuacuacaguuaaaaauaggaaaaguagaauuaaaagcuacacuauucuagccaaaaaaacaaaagugaagaaaacguauguacugucugccauguaccuggcacuguauuaagcauuaaguaaguaugcaguggugaacaaacuagauuccuugcauuugacuuugauucacaaaaaauuuguaagaugcaucuuuaugcagagcaauuuggcuuuuuucuuuuuuacugaguuauaacuuguauacaguaagguauauaucucuuaagauccuaaguauauagcuuggugaguuuuuacguguguauguauccauguaaccaccauccagaucaacauaugguucuaucauuucagaaaauuccuucgggccccuucucagucaauucuuagucaguaguuucuccaucagagguauaacccucauuuugauacuaucaccauagauucguaugucuguucuuaaaucauggaguauguaguuuauuguauguaucuggcuucuuuuguucaacauaauuucugagauucauuuauauuguuguguguauuaguguauugguagucuguucuuuuuuaagcuauuuaacauucauuguauaaauauaacacaauuuaucgaucuguucuccuuugaugggcauuuggauuuuuugcaguuuuuaacuacucugaaugaaacugccgugaaauccuuauauaagucuucugcuggauguauugacucauuucuuuugcacauauaucuagaguagaauugcuaaauuguaggguagacauguuucugccaaaguagauacugccaaacagcuuugcaaaaguguugaaccaauuuacauucuuaucagcaauuuaugagaguuauaguuccucgauauccucaccagcccccugcuuugcuaguguacugagguuguguuuuaauauuuuuauuagcccuuuggaaggggucuugugaaguaccuauucacaucuuuuccccauuuuuaaauuagguuauuugucuugauugauuuguaggcauucuguauguuuuuuucacuuuaauuuucauuuuuguuucuaccucuuaaagucaaugauaaagucacaacuguaaaaugaaugcauuuaaaaaauaaaagauauauuucaaugacaaaaaguaugcaaugaucaugaaaaucuacuguacacuuugccaaggccaaagaaugaaagacaauaugaaaaagccaaucuucaaauauauccucaacaaaaacucccuccuaaauaguaaaauuaucauuuaagaauauuugucuuuacacaucuaaacagaagcucuaaccaaaaaaaaagugggggaaagggcagaugauaacucuccacaaguuuuccagauauaaacauguggucaccaggaauucaagauuaaacuucuaaagcaacauuuaacucaaaauaaagugaacauuucugacaggugacaacaguaguaugaaacugauuuuuccuuuccuaaauagaaaugagauggggcauuucaguaaucaucuaagaauaacuguagaaauacucccaauucuaccaccccacccacugguauaaaacagauaccuuccaugaaaguaucuuucacauuacugaaauauccucacuuacuugggacaauuucaugcuuagaugaguauaaacacuuguuuuuagguguguggaauuauuggagcugagauuuuugaaacaauaucugaaucuuagcagagauauaauaauacuuucacuauacauugauugggcuuccuuaaccaaaucugagcaacuacuguaauaacaaugcuggugguaguccaugauacucucaaauuuuuucccuuuaagaaauauauaauccauguaauacuaguaaauauguuacauuguacaccuucuuaacaaagaaugucuguuuucaggccuuacuaggaaaacaaacaaacaauggcaguuacugccuguuuuuaucacugauaagcuacaauaaagcucaaaugauggaugguuuacgugugugauauuaaguacaaaaugaaagccauuauaauuuuaccaaaagaaacacgaaaaauaugggaagaagugaaaugaacauggcaugggucccaaagauuacgauauguuucagaacaggauuuugaaaacaaacaauuucugugaauauuucuuauacuagaaagauccaaagcaaaucuaggcaagcuuagcccuaccuugucaaagauaaauacucagauaaguuggaaguuccguuugcuaaagugcaucugggaucauaucuacccugcuacuuagagacagccaggaagguggccaucacucaugcucuuucacucuuucugugucuuaucaagagucacacguaacaauuuuuuuuucaaaccaaaugcuuuauauagugaacuacaggaaaaacaauucuaaauacacuuuuaaaaugcuagagaguuaagauaaccucauuaaagaaaaaauacugaaaauguaaaggguccauacaaacuaagagcuguauuaaguguauacuuucuauuuuaauaauucacuuggcugugcucuuaaaaugagagaagcagauauuuuacccaugucuucuggcaagagauucaaaagcagaaguagcaggacuguaaaauuucauaaaauuugugggauuuuuuaaagcuaaauuauucaauaucuuguacaguuuuguacccauauauuaccccggaauauauguacagcaucccagcaacagugacugcaacaaaaguaagguaaauaggucuacaaagcauuugauuuccuuauuagagaaaguuuuuauagaggaaaugcaaacaacugcaauucagaucacauuauauaagcuugaugauuauuuaaaccuuauauaaaauuaaaucuaacccuuaccacuacaaaucuguaaggaaucagaaaaggauuuauaguacacaagucuugauuacuguuucauuccacuuugauaucacucugagcuaaaacagcauucuuccaagauuuaaagaaaaauagauuuuauaaaagggauucuuuuacauuauuauuguuacugacagaaacaaguuuugcuuuuuuccacuauaauucgcucugaugaaagaaauaauucucucucuuaacuccuaacaaacgcuacauuuucaagacuaagggaauuacugguggcauucuuucuccuugaucuaaacuauuugucucuaaaauaugucaaguaagcuuuuaaagauucaggaaggggcagcguugugauuuuuuucucaguaaauuuugagguggcuccucuggcuucauugcuucacugugaucuuuuucuuccucuucuuuguuaucuuccauuuuuucauccuccucucuguccagaggcugaggaauaagcugauuacccacaaauauguauguguuaguucucuguuuaacucucuuuuuuuuuuuccuuuuggguggagcccuuugcggaauccccuuggccugcaucucaucauuuaugaaauuucuaagugugcgucgaauguaaauacaagccaagcccuguggauuccugacagcacagggagggagucccacagaaucugguuuaccauuaucauucuuacuuggcugcacaaguggagcaaaugacacaauaaggauauuuuuccuuucccaaguguuuuguccaguucugcguuaacugauccucuacaggcaugauccucuacauucauuugaucuucaaucagugauacccuuucuuccacuugaucaaaucagcuacugaagcuugugcaugcgucacguaguucucgugccaugguucucagcuccaucaggucauuaaggacuucucuacacuguuuauucuaguuagccauucgucuaauuuuuuucaagguuuuuagcuucuuugcaguggguuugaacauccuccuuuagcuuggagaaguuuguuauuaccaaucgucugaagccuucuucucucaacucaucaaagucauucuccauccagcuuuguuccguugcuggcgaggagcugcguucuuuuggagaagaggcgcucugauuuuuagaauuuucggcuuuucugcuuuggucucuccccaucuuugugguuuuaucuacuuuuugucuuugaugauggugacguacagaugggguuuugguguggauguccuuucuguuuguuaguuuuccuucuaacagucaggaccuucacguccucagcugcaggucuguuggaguuugcuggagguccacuccagacccuguuugccuggguaucaccagcggaggcugcagaacagcaaauauugcggaauggcagauguugcugccugaucguucuucuggaagcuucgucucagaggggcacccggcuguaugaggugucagucugccccuacuggggggugccucccaguuaggcuacucgggggucagggacccacuugaggauacagucugucuguucucagaucucaaagucuaugcugggagaaccacuacucucuucaaagcugucagacagggacguuuaagucugcagaaguuucugcugccuuuuguucagcuaugcccugccuccagagguggagucuacagaggcaggcaggccuccuugagcuguggugggccccacccaguucaagcuucccgguggcuuuguuuaccuacucaagccucagcaguggcggacgccccucccccagccucgccgccgccuugcaguucaucugagacugcugugcuagcagugagcgaggcuccgugggcaugggacccucggagccaggcgugggauauaaucuccucgugugcuguuggcuaaggcuauuggaaaagugcaguauuagggugagagugucccgaauuucccgguaccaucugucauggcuucccuuugcuaggaaagggaauucucugaccccuugcacuuccugggugaggcgauaccugcccugcuccgugggcugcacccacugucugacaagccccagugagaugaacccgguaccucaguuggaaaugcagaaaucacccgucuucugcgucgcucacacugggagcuucagacuggagcuguuccuauucggccaucuuggaaccucucucuccucuuuucuuuauaaaucuugauuuuacuuuuauuugcugaaacagucuaaugccaauucuccuuucuauauuaauggagaaugagcaugcagauaagugucucuauaugauuccuugacagauuucuuucagagacuaugucuauaaaaauuagcccaucugagacccaucauuggagccaacucauuccucaauuuuuaaaauuuuuuuuauggggggauuacaggugugagccacugugccugaccuaugacuguguuuaauauuguuauaaauuaagacauacuccuuuucuucuauugaauauaaaauuaauuaccuuaucaaaaauuuaaacaagugucaguaauuaagugauuaaucagcuacuucugauuguucauaaauggauuauacuuugucaguuuuccuuagugaucuaaaugguucucucccucugccaccauguagaagggucauaggcuaugaauaguggaguugugggaggagaagauugggcccaggcacaaugagagugaauauauaguuuucacuaugucaugagaacagauaagucuaucugggauagauuuacauguuuuggugguuguauuacacuaacagagccacgaacuucagauucuucacuuuguugaguacuguuauaccuaggcgaguuagagaaacgccacacucugagacgaauuaagaguccuuuauuuaagcuggcggccaaagagacggcuaaugcucaaaauucucucggcccggaggaaggggcuugauuaacuuucauaccuugguuuaggaaggggaggggaacucaaaugcaguaauucuacagaaguaaaaacaugcaagaaucaaaagaagcaaaugguuacagagagauaaacaauuuaaaagacaaaugguuacaaaaagcaagguaccaggugcagggcucuaaauccuucauuauaauuagauauaaaugcuaugccggacaggaacucaaggcuuuauguuguuaucucuuugaaaaaaauccugggaacuucauacauuguuugugccaguaccuuaucaguuaauugggcuccuuugaaaugcugaggaucugcuuacacaggucaacuccuugcggaaggagguuggguaaggagcccuuagugucuuguaaauuaaggggucaauuggaguuuguccggcuuucccagcuagagagagucuuacuugagaagcaaggcuaggugauuaaagagacaaacaggacaaaauuuaaaguagcgaguuagaguaaaaacaagguuaggcauuacaguaccagcucuauucuuggacacaaguguucccagcccugccucaccugguuugcaauaaaccauugcauaucugucgcuuaccuuauaccaaauuauuaaucauauugugauguuauuacaaagccuuaauuaaagaugaugcagucuuuugcagggauugaaauugguuaggacuguugauugucagcuauuuuugcuacuuaccccugucuucuuaccaggguugagagagaguaccguacuauuacugcucucucuugcccuuuaguuguuuaauguuagcugaagaaaccggaguuaauuaugaauugaauacacuuauccuuuguagcuuuugaauuguuauuuauuuauuuguuugucugaauuuauguguucuuuauuguuuuggugaauagguuugguguuuagguuucauaaaauaaaucuguggauuuguccuaguucagagugauacauugaaauuaauuuuauaauccauaacuuaaagcaguauucuucagccauuuuucucauuauucccuccuaaggagcauuuuuagaccuguuuucucccuaauggccuaaugggccuucuccccuucagauauuuuaauacuacagauauacaguauauaauaacuauguuaucaguaggguugaacuuuggagggcuacagaccauuguaguguuuaagauuuccaacucuccauaaggaccacuuuuauuccccuuagggauauugccccaguugagaauguaugauuuaaagcuguuaaggccaggcaugggggcucaugcccguaaucccagcacuuugggaggccgaggcaggaggauugguugaggccaggaguucaaaaccagucuugggcaacauagugagacccuguuucuacaaaaaaaaaaaaaaaaaaaaaaaaagcuagguaugguaugugugccuguaaccccagauauuugggaggcugaagcgggaggauugugugagcccagaaguuugaggcuacagugagcuaugaucaugccacugcacuccagccuggacaacagaguaaaaccuuaucucaaaaaaaguaguuaucagccugcagugauuuuuguauccuucccaauccaaucauggcuuacuucauuuuuguuacuguaaagaaauaccugagacuggguaauuuauaaagaaaagagguuuauuuggcucaugguucuguaggcuguacaaaaagcauaacuccaacauaguauaguugagaguuagacuuaaguggcauguacuucgcauguuuauguuuuaaaaaaauuauaccaauuaugucuucagacauuaaaauaguaugauuuuaaguguuugaugccugugucuucuaaaaaaagucuuuuugcuuuuuauacaacucuaacaagggacucagggugcuuccacaaauauuagaaggugaagaggagccagugucuguagauuacauggugagagaggaagcaaagggaggaagaggugccaggcucuuuucaacaaccaguucucuuaggaacuaugagugaaaacucauucacuuccacgagaauggcaccaagccguuuuuagggaucugccucuacuauccaaucaccuccuaccaggccccccuccaacauugggaaucagauuuuaacaugagauuugguggaugauauccaaaugauauccaucuaaaucauagacaccuucaggagacauuugacaguguuuggagacguuuuugcuugucacaacuggaaguggugcuacuggcaucuagugucuagaggccagaagggauguugguaaauaucuuacaaugcacaggacagaggacagccccacucugccacucaacacagacucaucuggucccaagugccaguagugcuaaggcuacuuugaaguucgagaaaaugaaagccagccugggcaacauggugagaccuugccucuacaaaaaaaaaaaaaaaaaaaaaaaaaaaauacaaaacuuagcccaggcgugguggugcgugcccauguucccagcuaccguggggacugaggugggaggaucacuugagcuuggagagguugagucagcagagagccaugacugcugcacugcacuccaggccuggcgacagaaugagacccugucucaaaaaaaaaaaaagaaaagaaaaugauugaaaguacauaaauuuucucuuuauucuuuuauuaaacaucauucaauugagauauaaaauaaaguacaguauuaaagauauuaucuaauuuaguuuuaucuacuuaauaggacuaauguccuuauacguaaaguaaaaaguaugaaaucuuucuugcuugguaggaaauaugaauuccacuauaguugagaguuagacuuacguggcauguacuugccauguuuauguuaaaaaaaauuguaccaauuaucgccucagauauuauaauagugugauuuuaaguguuugaugcuugugccuuaaaaaauuuuuuuuuuugcuuuuuauaccccucccuccucauuuuggagaugcagaauagcauaaugaacucugaagucagaaguuugaaucuugguucugcaguuuacuaguuuaugucuuuggauacauaguggcauaaacaaaguaccugccugauaggauugugagaauuaaaugaguuauauauaaaguacuuauugacauauaggaagagcuuaaaugcuaaccuuuauucugaucuguucaccaugcuuuaaaugccaaguaauuuugcuuucuuuucucuuuguagauuuaugguggauuauuuucugaagaucaguguugguacagaugcaaaguacugaaaaucaucagcguugaaaaggcaggaaauuaaguguucaguuuuuuuuugcuuuaagaaauauuuauugugguucaaaaauuugaugcuuauuuagcccuucauugcuuauucguaguacugauaccugguucagugauuaaaacacagaagaaauuaauugcuaaaaaacauguuguuuuauaaucaccucagauuauucaagaauagauuauauaauauguagguuauuuuuggugacuaguuauuuuuaccucaguucuuuuuuuuuuuuuuuuuuuuuuuugagauggagucuuucugugucgcccaggcuggagugcagugguacgaucuuggcucacugcaaacucugccuccuagguucaagcuauucuccugccucagccucccaaguagcugggauuacaggcgcccaccaacacacuggcuaauuuuuguauuuuuaguagagacgggguuucaccauguuugucaggcuggucgaacuucugaccucaggugauccguccgccucagccuccgaaagugcugggauuacaggagugagccacugugcccagccugccucagaucuuaauaauuauauuugguucuugaguaacuuuuaaauguucauuuuauuaagcuuuauaaguaggagaagaacauuuugauugauucuucugaaguuagguauaucuuuuauuuaguugaugugaauauuguuaauaauaaugauuggcuugccacuuucuuaugccuggguuaaauguggugaguuuucuuuguguuaagcuuuuuuuuuuuuuuuuuuuuuuuuuuuugacauugugaauuuguggaggauuuuuaagaggauuuagggagacagaauucugaauagcuguuuggugacaguugcauauugcaggcugggugaaagcaccucuguaagauuuccuuugguguuuuuucuacaccuccuuucuguacuuaaauuauaauauguauguuuuuacugaaccagggaaagugguucaggauaaaagagaaaaaguuaaaaauauguauguuucagaaauauuuucuuuggugugauaagaugcuaagaugugacaauuugauuaauauucugaauagcuugguuuaaaaaaauuucauuuuuugcugucauagaaaaugguuuauuuuaguggaauggaacuuucuaauugaccuuucucccauaauuugacaacuggagaugauauuuuacauauguuuuucaguuggcuuuaauuuuuuaaauuaaagggcagcaugauguuugaccuuguaauaacuauuuuucuuuuuuacuuuuuaaacagauguagagcuggagguaaggguggugaaucugauuaguuuacauggucuaccuggagugaguuuaauugugucaaaggaaguuugauaacuuugccuuucuuuucagauuuuauucuuuccaacuugaaauugaauugaauguugauugauuuuaacauuaggagaaacaggagagggcuguaagcuucauaggcugauguuuauuuaaaauaucaauugucuaaaaacaaaaagcacccuaaugagaaaugguacuguuggaauuuaacuaguaacaaguaaagaaaucacuguaauuucauggacuguggauuuuuuuuuuauuuugaagauauuagaaaucuguuucugaauguauuuugucauuuugagguaagaaugcuauuuugauauacaggucauuaacagagagcagcaaauuggugguuucuuuggaaacauuuaaucuggggucaguauucguauuugucucuuauuuuuuccagugucuggugagguacauugacuauggaaauacugaaauucuaaaucgaucugauauaguugaaauuccuuuggagcugcaguuuucuaguguugccaaaaaguauaaacuuuggggacuacacauuccuucugaucaagaaguuacccaguuugaucaggcaagucacguauuuuaaauauuuuugcuaaugaaaguaaaacuaugugcuugaaacaaaauguagguauaguuaaaucuuacuuuaauauaaaagucuguauaaauuagugaaaaauaggaauuauaauuagaaagcaauuauauauuuaugcucaucuuugcuagguaaacauugaacagauaagaaugacauacacauauauaauauauguaaauaguuuccuucugauguaaauguuuaaaaggauagucucuuuuuguuuuuuuuuuuuuuuuugagacagagucugacucuguugcccaggcuggagugcaguagcgugaucucggcucacugcaaccucugccucccagguucaagcaauucuucugccucagccucccgaauagcuggauuacaggccugugccaccauguccagcuaauuuuuguauuuuugguagaguugggguuuuaccauguuggccaggcuggucucgaacuccugaccccaggugauccacccaccuuggccuuccaaagugcugggauuacaagcaugagccacugcgcccagccaaggauagucucuuauaugauggagaaaauaaugaauacaguuauuucuauaauuguuuugggaaaguauuuauuaaauaaaagugaucuuuaccuaguccuggccauaaauaccacaaauuugaaauuaaugggguuauaauuaaucagauuguauuauuuuggcagaggcucauacuguuugauguaauaauuggcaguggauguuuugcuuauguggauucuaguuuauauuacuuuccauugaauuuuggguugguaaccuaauucuggaagacguucgauaauuucagggguagucuuacaggaauucuaccucuuuuaaaaucuguuauacaaagaugauucuuuugguaaaugguaaugcuggugagagauauuacauuggaaaguaaucagauuuguaauucuuauuuauaauagcagcucaaguagcucauguggaaaacaguuuaaucauuguaagcauuauaaagaaauuaauuaaaauugccucuauuuuucuuugagaaucuuguagguguguuggguauaguuuugucugcuauguaguuacuuauaaaaaacauuucuguacaugaaacucaggcuuucauaaacaugaaauauagauauuauaaaauuacaccccaaguuucugguuuaaaaucuaaaguuuguuacuuucuucuuuaauauaaaugcuuugaccaagguuggggaggcuuguuuuggauuucuugcaugcauaaaacucuaaaaucuuguuuacggaccuuagaauauuaucugcucucacuuuguuuuacauauagggaaauuguagucuagaauaauuaaaugacuucaagucgugaagcuaacuagggaagagcuaggccuagaacucaagucuguuguucuuuucauaguaaaaugcacagauuuguguugauugaaacacacaugaaucaagggggaaaaagacauuaaaaaaaguuaauuuuagaacugaauuaauaaacugcagcugagaauguuuuuguauguuucaaagauucuuuauauaugguacuguauauaaacauuuauauauauauauauauauauauuuuuuuuuuuuuuuuuugguuggggguugaagucuugcucuguugcccaggcuggagugcaauggcaugaucucggcucacugcaaccuccgccucuuggguucaagcgauucuccugccucagucuccugauagcuggaauuacaggcacccgccaccacgcauggcuaauuuuuguauuuuuaguagaggugggguuucaccauguuggccaggcuggucuugaacuccugacuucaagagaucccccugucucugccuuccaaagugcugggauuacaggcaugagccacccggcuaaacauuuguauuuggaugcuuaguucaguaaaaagaucauugauuagaguuaagcuaauuggcacacaauguuuucuggaaaaaaaugagcuauucuugaauagcucugcuuagaaaguccguguuuaguuauuaauucucagcccaaagcucaacucuaaucuucuauaugaagucuuugcuaauacccacuuacccgguccucugugguguuuuagucacuccguauauaaagccuauaaaguuguaauuuuuuccuccccuacaagcuuagugaguuugguagagauaaguauucacuuuucugugccuaauuucccugccagguagguguuagaugagcauuaguuuaucuaacauuugaauaaauagaugaacagcagggauucaguaacaacacaaauaccuccuuccuuccccuuuuccagaagguguccugggcacugaaauuccuucacauuuuuuuaacuaacacuuucacgcuaugcugcagcacagucagaauugaugcucagaaugguaguuugcugaagaucgagagaauauuacauuacuaguccuacaugccugacuuuaaaaauuauauguaggguaagggaaugagagcuagagcuuggaauuuguguuuaacaauuuaaaggccuuuuagcuuguuuucuaauauauacaggcagaauucagaggaauaaaguagaaagcaagugauccuuucuuguuucugaaugaagcuuaccaguuuggaaaacagaaugaaauauauuucuaaaaagugacauucaucuuuuuuaaugauugaaagccuuauguucuaaaccagugaccagauuuauuuuaaaaaguuaaguuuuguccagugcgguggcucaugccuguaagcccagcacuuucggaggcugaaguggguggauggcuugaguccaggaguuugagaccagcuugggcaacaugggaaaacccugucuguauaaaaaauacaaaaaaauuagcugggcaugguggcgcaugccuguaguccccgcuacucaggaggcugaggugggaggauugcuugagcuugaggggucaaggcugugagacccugucugaaaaaaaaaagauaaaaguuaaguuuuauaccuuuuaaaugccuaaauauauuuuuuaagugcagguauauaucuccagcucauaaggguuaguggaaaauauauuucuuaugauaaaaauuaaauguuuauauguauuauauauaaagagaaaacauacauauuuuugguauaguauuaaaacacccauguaucauauacucugucauucuuuuuguuaguuggaacugaggaagacucagauuuuauuucaaguucaggguucuguguuuaugauuauauaugauucagggagaaucuguuugaaccacuucauacuaauugugauuggugacuguaacuaaaaugaauuugaauucagagagaaaucuaaaauuagauuucugcauaaaaauucuaugcaaggaguaauggaccuuuagaacauucagcuuuagguaauugaaacuuuuguagacaauagguuauuuccauuugaauucacguauugcccaaagacaggguuucuugaaauauuaauaauuccacauauaccagcaauaauuuucaaagacuuccuaggggcagaaguuguucuugaauuuuagauagacuuuugauaauaagaguugaaagcaaggguuuuuaugugaaagagguuaacuggaaaacuacaucuaauugauuaaaauccuaacauauauuucaguuaguuauauuuugagguuguuagcuuugccugcuugaucccauuugauuggugauaacuucuggacuguauuuguuauuuauacugauauaauugauauaauauauugauauaauauauugaauucuuggugaauucaaaccucuugauauaauguguguauuucugaauuuuaugccuuggaaaauuuauaaaaccuguguuuuuguuaaccuaaaguauuauaggaauuuuaugccuugaaaaauuuauaaaaccuguguguuuguuaaccuaaaguauuuucguguuuuguggauuuaaaaaauuauuuuuucagcuaggcacagggugugugccuguaaucacagcuacuuaggaggcugaagugggaggauugcuugggcccaggaguucaagaccagcuugagcaaacauagcaagaccccaucuaaaaaauucuuuuuuuuuuuuuuuuuggguagugauaguuggugauucuugagcauauguaguuugagucuccuucucugccccuucagaugcauccuuguaggcccagguauccucaaccuguuguuaaaauaaaugugucagcugggugcggugucucacgccuguaaucccagcucuuugggagacugaggugggcggaucacgaggucaggagaucgagaccauccuggcuaacauggugaaaccccaucucuacuacaaaauacaaaaaauuagcuggucaugguggugggugccuguagucccagcuacuugggaggcugaggcaggagaauggugugaaccugggagauggagcuugcagugagccgagauagcgccacugcacucccaccugggcgacaaagccagacuccauucaaaaaauaaaaaaauaaaaaaaaaaugugucccaaugaaauaauuuuuuuuguaauccuauguauuucauacauuuaaaaacauucugagaaaaaguccaaagauuucaccugacugauaaaggagccccauggccacaaaaagguuaagaauuccuacaucggucucaauuuuacccucuauacuacuguguaguugaagagaaaauaguucuuaaaaauguuauuuaguuucuuggaccuugacuuccccacacccccuauuucuuuuaaaaaugugaccgguuuguauuuugugguuuuuaguguguuuuuacacucuuguuugucugauuauuacggguaugauguccuguucgguuugcuuuguuugcauaaacuauauuguuuuuuguauuuauagagugggaauguagcuaaaaauacagcuccaccuucuaagagagauacguuucaucagaugaugucccuauuucaaggaaguugugaaccaguaaauuugagcuguaccuacccauuuuguguuuuaaguuuaugcuuuauauauuccgaaaaagaauacuuacuuuuaauuuccuuuauaguacgcacagggugaaauucaggaaaauaaccuagagaaauuugggaagagcaguuagauugugucaaaguaauuuuaguaauuacaguuuuauggaggaguagauaaguucuuauuaaaauuaagucucaauauguuccaaucccaaauauguuuuagguguaucuuugcuuaguucuauugauagauauucaguagcucaaaguuagcaagcaccuaauuucucauaugccaguuguacaguuguagcccucuuaagcaaaagucuauuuaagagaguuuugaauguagaaggccaggcgagguggcucaccccuguaaucccagcacuuugggaggccgaggugggcggaucacuugagguuaggaguuugagaccagcucaacugacacggugaaaccccaucucuacuaaaaauagaaaaauuaggcaggugugguggugugugccaguagucccgguuacuggggaggcugaggcaggagaaucgcuugaaccggggaggcagagguugcaaugagccgagauugugccacugcacuccagccugugcgacagagugagauucugucucaaaaaagaagaaaaacaaaguuuugaauauguauuugugacaccucacauuuuauaauuucaguuuguugauuuuuaaagaauuuguucguauuuugugcuuucgguuuguggcuuuuuuugcuucugcucgucuuacuuuaaaaccagaguuccugacucugccucuaaaacuuucaaaguuuuguaaaaucgaguaccuuuucuagauaucagagauucauuuuuaugcgcuauugcuuuucaggagaccauuauauuuaguuggggccaaaguaaucaauguaaucugcuggguuaaaaaaaacuauucuaggauauuuacuuaguauacauuuuuagauuuauaaagguggcugccuguacaaguauuuagcucuacuugauuuuagcaaguguguaauuggaauacauucauauacguggagaugcauauuugcauauuauagccaacagcaaaguaauauagagauuuuagaaugaagaaauaugaugcuuggaaaaaauggguaggaacaaaauaagggaagagaaacauguugguguagcugguuuauguuuucuucuuucuuagggcacaaccuuuuuggggagcuugauuuuugaaaaggaaauaaaaaugagaauuaaagcaaccucugaagauggaacaguuauugcucaggcugaguauggcaguguggauauaggggaagaggugcuuaagaaaggauuugcagagaaaugcagacuugcuuccagaacugacaucugugaggaaaaaaaauuggauccuggucaacuuguucucaggaaccucaaaagccccauuccuuugugggggcauagaucaaaccagucaaccuucagcaggcccaaggggcacuuaagugagaaaaugacucuugacuugaaggaugaaaaugaugcaggcaaucuuauaacauuuccaaaguaagaauuuagucuucacuaauuucuaauugaugguagaggucccugucauaguagaauagaaguuaaggcuuaugcuuuuggaauccuuuacugugucagugauuuuaagggcugaugcugauauuucuguuuuucucaaauguauuccucucugcuuuagcagggauauuuucauuaaaagcuauuuugaaagaaaaauaacuccugaauuauuuuaaaguuuacauaccaacuuuucaugccaacuauuuggaauacacuuaucaaaaauaaaaaucugcuccuaaaucugaauuauucaggcaaagucagaauuucagauaagauuugaaguucuuccuauggcuuuaggaauauuuuaaagaguuucaggaaauugccuuuacuuuuuuaauaaaagugaggcucuuucuucuucuugugaaaacuugugauggaguuugauuauuccgaauacuuuacuuuuuagauaauuuuaaauuaucaacuugaagcagaaauccagauuugauauuuauauguaucaaaacagucuucuauaucaugguccaagccaugaugcuguaucuuggaugacauagcuguuugaugggaucucaucagugcuuuaggagcuaaacugucaaaugggggugggaggcgguggacggggggaucacaggggaucacaggacggggggaucacgggggggggaucacaggagggacuggaaaaaaacuaauacagaaaugcuuuuuacuuuguucucuguaguugauagugcuaugaagaaguuggaauauuuuuuuuugagaauuagaggcauuauugaauuacgacuucaguuauaaaaucuuguuugcauuaaauuauuuuuuaauauuaugaacuagguaaauauuuuaguuuucaaaauuaacuuucagauauauuguggcauaaaaggaccaagauaacuuagauuuguuuucugugucagccuuauacaguuuguuugucaaaauaaaugaauuuguuuuuauagggaaaguuuggcuguuggugacuuuaauuuagggucuaacgucagccuggaaaaaauuaagcaggaccagaaacugauugaagaaaaugaaaaacuuaaaacagagaaggacgcucuucuugaaaguuauaaggcguuagaauugaaaguagagcagauugcccaggagcugcagguauguucaguggcuuaaggugaagaguguccaacugggaaaucuguguacucaucugcugcuauuuauuuuucugucacuuuccuuuccuuccccaccucauucucuccuuugcuaaucccuguauuuguuuauaggugaauuuuuuuucauauacuccagacuaaucaucuuuggauuucauuggauguuugcaaauuuaauaauuucucauuuacauuucccuuuauguucuaaaaacuuuucaacuaaggcaauuuucaaacauucuaaaaggagagagacuugaauaauuaauucucaugugcccaucacccaguuuauacaauuauaacacauggccaaucuuuuuaaaaauuuacacuuccuggauuauuuuagaagaagucccauucauauuauuucauagucuucaguauguaugacuaauagaaaaggacuuuaaaaaaccguaauaauaauacuauucauacuuaaaaguaaacaauaauuccuuaauauuauuuauauccaggcaguauucaaauuugccauauugugucaugaaugccacaugauuguaggcauguugauuguaguuuucuccaaucaggaucccaguuaggcacauacauugcauuuugguugauauuucucuuaaauugcuuuaauguguuuccuuguguugcuuaacuggauucuugaucuccacgugugucuucuuuuaugguaaucacgucuccagauuugcucagauuuuaguucagaaauuuucccccccagggauacagugugguugauaaguguguguguguguguguguguguguguguguguauguguguuuaacaccaaaucuguuguuccugcacuaguuccuccaauucucugacaccaacugggugucuaauaauucagcuccauucugacacuacauuaccuguacuuagcauauacccuacaaguuaaggacucaguuccauaaagcugccucuacuuuagaugccagccacaaaugggguccccaggcuacuugcauaucuacccccccacuauaaauucgggguuucccaugacccucccucagguuagauaauucacuagaacuacucacagaacucacggaagugcuauacuuacaguuuuauuauuaaggauauaacucagaaacagccaaauaaauggaagauauauauaaggcaagguacuggggcaggagguacagagcuuccaugcccuuucugagugugccacccucccaggucauggauguguuuaucaacccagaagcuccccaaaucucauucagaguauuuugguuuuguuuguuuguuuguuuugagacagucuugcaacaucuugcucuguugcuuaggcuggagugcagugguguaauuucugcucacugcaacuucugccucccggacucaagcaauccacucacuucagucuccugccuagcucggacuauagguaugugccccauuccuggcuaauuuuuguguuuucuuuucuuuuuuuuuuuaaacucaaacuugccuuauuuauauccccaauggcaugaucucggcucacugcaaccucugcuucccagguucaagcgauucuccugccucagccuccugauagcuggcauuacaggcacccgccgccaugucuggcuaauuuuuguauuuuuaguagagacgggguuucaccauguuggccaggcugguuucgaacuccucaggugauccacccaccucugccucccaaagugcugggauuacaggcaugagccacugugcccagcccacauuuucuuuauccagucuaucauugaugggcauuuggguugguuccaagucuuugccauuguaaauagugcugcaauaaacauaugugugcauaugucuuuauaguagaaugauuuauaauccuuuggguauauacccaguaaugguauugcugggucaaaugguauuucuuguucuagauccuugaggaauugccacacugucuuccgcaaugguugaacuaauucauacucccaccaacaguguagaaguguuccuauuucuccacaucgucuccagcaucuguuguuuccugacuuuuuaaugaucgccauuauaacuggagugagaugguaucucauugugguuuugauuugcauuucucuaaugaccagugaugaugggcuuuuugucauaguuuuuuggccgcauaaaugucuucuuuugagaagugccuguucauauucuuugcccacuuuuugaugguguuguuuuuuucuuauaaauuuauuuuaaguuccuuguagauucuggauauuagcccuuugucagauggacagauugcaaaaauuuucucccauucuguagguugccuguacacucugaugguaguuucuuuugcugugcagaggcucuuuaguuuaauuagaucccauuugucuauuuuggcucuuguucccauugcuuuugguguuuuaguuaugaaguccuugcccaugccuauguccugaaugguauugccuagguguucuucuaggguuuuuacuguuugggguuuuacauuuaagucuuuaauccaucuugaguuaauuuuuguauaagguguaaggaagggguccaguuucaguuuucuucauauggcuagccaguuuucccaacaccguuuauaaaauagggaauccuuuccccauugcuuguuuuugucagguuugucgaagaucagaugguuguagaugugugguguuauuucugaggccuuuguucuguuccauugaucuuuauaucuguuuugguaccaguagcaugcuguuuugguuacuguagccuuguaguauaguuugaagucagauagcgugaugucuccagguuuguucauuuugcuuagguuugucuuggcuauacgggcucuuuuugguuccauaugaaauuuaaaguaguuuuuucuaguucugugaagaaagucagugguaguuugaugggaauagaauugaaucuaucaauuacuuugggcaguguggccauuuucaugguauugauucuuccuguccacgagcauggaauuguauuuucuguacagucaggguuugcuguguugcuuaggcuggucucaaacuucugggcucaagcaauccuuccucuuuuggcuccagaguugcugggacuacaggcgagccaccaugccuugcuaaauuaaugaacuuuaaacacauuugacauguuuuaauccacugaagccauuuuuuuucuuuuugaugcacacauuauccccuuugaagucuuuuuaaauuagcuucuguguccuuuugacaucauaacagcugauauucauaauggauaaaucaccauuauuaaguuuuucauuaaucugugaccuaaugauuuuugcagccaucgaugguuguugucugcaagcauguuuucaucaggugcuguauuucuuuuuuuuguuuuuauuauuauacuuuaaguuuuaggguacaugugcacaacgugcagguuuguuacauacguauacaugugccauguuggugugcugcacccauuaacucgucauuuagcauuagguauaucuccuaaugcuauccuucaccacuccccccaccccacaacagucccugaugugugauguuccccuuccuguguccauguguucucauuguucaauucccaccuaugagugagaacaugcgguguuugguuuuuuguccuugcgauaguuugcugagaaugaugguuuccagcuucauccaugucccuacaaaggacauuaacucaucauuuuuuuuggccaggugcuguauuucuuagcuggaaaauuucaacuauuuagucaugcugaagccuaguuuguucaguaaaggcaagauaaauacuuuauucauucccuuuauauguacauguuuucagaaaaauaaguuuauucccuaggauuguccaguguugaccagcaaggguuauuuguucuccuuaaguauuauuaugaacuaaugaauuuuaaacauauuugaguguuuuaauucacugcagccauuauucuuuuugaugcccaucuuauacucuuuggaagucucuuuaaguuguugcucuguccuuuugaugugauuccaguagucugauagcuuccuuguuuucuggugucacaagauguuccauacucaucugcauuuccuacccuaauccuggaaaaguuauuucuccaagcuauaguucuuuuuaguggcaagagguauuuagauaccagacuuugggugcuagggauauauauagcuauugcuuuagucuuugcuucuagguuauagaaugucuaauugauaggguuaggaaauauuauuuucuaaugcuauauugagauaucauuuacauauaguaaaaaugcacaaauacuguguagaacuugauaaauuuugacguauguauacucucauguaaccugaaucacccucaucaagauuggcugaugaaacuaucauuaaucagauauuucaccuaguaucaagcucuaccaauaauuucagggacacagguaacaaagagacuccuuuguuccagagcaggugccccagucucugaccagagacuagaaugucugcuguggcuacugcugccaggcaucaaacaaugucucuaaacucucauaagggugccaucuguaguauuguaacuagagaggguggggccccucucaggugagcaguguggauaugaagcaguggggaguguguucuacucaaguguaagucucacagcagccuauagcagagcuuuggguguugucccaggugugcauaggagagccuggcuuuucugccccuucuuggcugggcagcagcugcagucaugucagccuaaagucaggccaaaguugggccacagcucagaauuaaacucuccaagugacacuuuuggccugugcccugggauacuggggcaccacccuggugaacagcaugggcaaaaagcugugggaaguguagucugauugugucucaguuucacagcagcccauugcagggcuguggguauucuauagauaugugugggguagccugguuucccuguugguccuuugcugggcagugacuggggcugugucagcccaaacucaggccaagggcaggacucagcccagcauugaacucagaaaauggugccuugggcauggggcuagagagaaugagucaccacccagccaagcagcaugagcaagaagguguauggaguaugaucuacuuaugucucagucucaacagcagcuuguagcagggugacaaguauccuccugggggugcaugggcaugcuuguucucccucuccuuuuuuggagcaguacaguggcugcagccaugucuauaggucccugguaucuaaacucuuaaaguggcucccugcugaggcugcuccagacuugggugccugugggauucuguguggauuccuuuucuggaacaaugucuuugugugaucuuuaggcagcuccauaugugaggugugaggcccuaguggaucgaggguuucuccuauagccaauguuguaaaugcuuguuucagagcucuggggauuuuucucuuacuguuucccugcguacaguagccuuucccagcucucagcugguuucuggcuaggcaugcuuccucaaacccucuccuuucuuacuucuggggcuuucucucucuucucuggugaauccaaauauucauucuuagucuguucaaaaugugucuacuuaacuauuucugauucuucccuguggaaaaggcacacacuaucuaguuggccaucuugauuauuuucucucucacucauuguuuaucauugugguuugguguguuucuguagugggaacauuugauuccuuucuuguuuuacuuguguguuugcuuuacucuguggguuuuauacuuuuuuuuuuuuuuuuuugagacagagucuugcucugucgcccaggcuggagugcaauggcacggucuuggcucucugcaaccuccaccucccaaguucaagcaguucuccuacuucagcccccugaguagcugggauuauaaggaccugccaccaugcccaguuaauuuuuguacuuuuuaguagaaacgggguuucaccauguuggccaggcuggucuugaauuccugaccucaggugaucugcccacuucggccucccaaagugcugggauuacaggcgugagccacugcguccagcuggguuuuuaacuuucauguguuuuuaugaucacagauuguguauugcccucccuuaagcaucucuuguagggauggucuagugcugaugaauucccucagcuuuugcuugccugggaaagacuacuacuucuucauucaugaaagacaacuuugcuggauauaguauucuugacuagcaguuuccuuucagcgcuuugaauauauuguuucauucucuccuguaaggauuuuacugagaaauuuacaguuaaucugauggggguuuccuuauaauugaugacacgccuuuuuccuucuguuuuuagaaauaucuuugucuuugacuuuugacagguugacuguaauaugcuguggagaagaccuuuaugaauuuuaucuguuuaggcaucucugaacuucuuuuauuugaaugucuaaaucucuugcuagacuugggaaguuuucagcuauuuuauuaaauauaagaaguuuuugaucccuuuuuuucucuuuuucugugacauugaaaauucaaauacuuguuugcaguguggugucucauaugucuuguaggcuuuuuucauucuuuuuuguucuuuuuuuaaauuuuugauugacuggguuaguucaaaagucuugucuuaaguucugaaauucuuucuucuguuugaucuaguauuuuuuguuguuguuuguuuuguuuugaggcaggguuuuguuuuguugcccaggauagagugcaguggcacaaucacagcucacugcagccuccaacuucugugcucaaucagugcuccugccucagcuuccugaguagcugggacuacaggugcaugccaccaugcugagcuaauauuuuaaauuuuuauuagagaugaggucuuguuauguugaccaggcucuucucaaccccugagcucaagugauccuccugccucagccucccaaagugcugggauuauaggcgugagccaucaugccaggccuagaucuaguauauuguugaagcuuuggaauguauuuuguauuucauucggugaauccuuuaguucuaggauuucuuuuuuuuuuuuuaaugauaccuauuugguaaauuucucauuuauaaccugaauuguuuuucugauuucuuuauauuauuuuucagaauuaucuuuuaucucacugaacuuauuuaaaaucaguauuuuggauuuuucaucuggaauuucagaauuucuuuuugauuaugaucuguugguggagaauuacuaacuuccuuuggaguuauauuuucuugucuucucauguuucuuuuguuacauugauauuugugcauuggguguaacaguugcuucuuccaauuuuuuggaaauaauuuuguaggggaggaucuuuuccugaagauguacccaugguguugguuggguagggcccuuuggcuuuaauucuggguucaugcaguagcauagucuuuguaugauuccuuuggaugugaauagucaguggcguuugugauuuccucaauggcuuagggugugguuguuagugggggcugcggagaaguuuugcuggguaaaggaaugccauguuugccaguccucagaccccaaugguggcaaugccaggccaaguaugcuuguccuugguuuccaggacagcacaugcuggcacuacuguuagaaagcccagguuggccagugcuuggguuuccaggagucuugcuugggugcuaguagcagcaguggugggccagacaggugaguguguucuugggcucuuaggcagugggcacgaugugggugauaguagcaauggcuugacaacccugugcuuuccaaguggucuacacugguguuagugcuggcugugaugugcugagugggucagucaggcccacagguagcaugugcaaguggaugccagcuguguugguaguggcagguuggguaggccugaccuugggcccuugggaggaguguugagguaccaaugguggacugggcugggugauacccagggccuuggguggugugcucagacacuggugagagggguuauggagcuggguagaguggaccuguccucagguccagguggugagugcagacucugauugcgguaggcaggugcaggaugaugcccagguuuccaguggaaugcuugaguggggguggcagugguugcuuugcagcccugucacuggggagggugagguugcuuucacuggcagcagauguguggagguggcuggugaacauguacuuugcucuuacauuugcuccaguggaggcaguuugcaagggcagcagcugcaggugggaaaguuuguccuuugggugugugaaaaugugcagcagcuuugcugcuuagggcagcggggucacuguaaauggcucacacuuugacacugguggcagcagcagcuagcauugccucagguucuggguuggguagcccucccuugggucaugugaagaugcauggcuacccuucugcuggugggguugggguuccugccaguggcuugcaguuuggccucagguguggcagcagcuagugacaauggugguugugggaugggguagccuuuccucuggguccgugaaaaugcaugguugcccuucuugggcguagaguggcugccaguggcuuguguuuugauucuguggcagcagcagccaguaguggugguggcugcaagcaggauagcauuuccucagggccaucaagauguauggcuguuccucugccguagggaacaggguugcugccaguggcuccuaccucuucgcggguacuugcagccagcugcagugguggcugugggcaggagaugucagcuuugcuccaggguuguggaguuguaggggauguugggcccuagaccaugaugcagucuacuuggggcugggcacacaaaauggcagcaugcuguaguugcuuaggauugggggguggguguaugggacccaacaugagcucccuguauggagcaauauacuuguguagucucugggcagcucucugugucucagagcacaugaggaucaaaggucccuuucguggcuagaauugcaggaguuugcagugagaauaugggccacuggggucucucauuuaccccuucuaugcauugaggagccuguccaggcucccagccaagaaggcugcuucucuucuuucuccuuccuuccuuuauguguuuccugucacuucucuguugaagucccauuucucucuuagaugaucuauuugaagugugauuaucuacuugcuauuuuggcucuuuucucagagggaggcaaauaacaguggccucuagugagucaucuugaagccccugucugaaauaauguaaucuaacaaacacguuuuuguguguuauauuuauuguauacuguaucuuuacaauuaaguaaucuagagaagggaaaauauuauuaagaaaaucauaaggaagaagaaauguauuuacguuuuauuaagucuuaauccucauugucuucauguugaguaggcugaggaggaagagcauggguuggucuugucucacaggugacagagauggaagagguggagggauaaauaaguuaaauaauuuuaacuuaauauuauuuaauuuuaaaauaaguuaaaauuauuuaacuuacuaacuuauuuaaaaauaaguuaaaauuauuuuaaaauaaauuaaacuuuuuacuuuuuuuucucaauaaguuauacaagguguaccaggcaggcacaccuuguguaacuuuuugagaaaaaucuguuuguaaguggaucugugcaguucaaaccuguguuguucaggcaucaacuauguuucuuuucauacauuguuggauucaguuuucuaauuuuuuggaggguuuuuacauauauguucgugacauauauugguuuguggcuuucuuuuuguguaauguuguuuucugauuucaguauuagggugaugcuggccucauggaaugaguuuggaaguauuuccucugcuucuauucaaugacugagaauugguauaguuuuuuccuuaaauguuugguagaauuuaccagugaacuuauauaggccugacauuuucuguuuuggaagguuauuaaugguugauucaauuuuaaaaauagaaauaagucuguucagauuauuuuuuuauuuuuauuuuuuuggagacggagucucacucuguugcccaggcuggagugcaguggcgcgaugucugcucacugcaagccccaccuccuggguucacgccauucuccugccucagccucccaagcagcugggacuacaggcgcccgccaccaugcccggcuaauuuuuguauuuuuaguagagacgggguuucacuauguuagccaggauggucucaaucuccugaccucgugauccacccgccucggccucccaaagugcugggauuacaggugugagccaccaugcccggccuguucagauuauuuuugugugagcuuuggcagauuacgucuuucaaagaauuaguucauuuaaucuagguuaucaaauuugugggacuugaguuguucauaauauuuuuaaguuuuaauuuccauuggaucuguacugaugcccucucuuucauuucugauacuggcaauuuguguccucugucuuuuuuuccuuuauuagccugguuauaguguuaccaauuuuauucaucuuuucaaaguaucaacuuuugguuuugcugguuuuucucuccugauuuccuguuuucaaauugauugauuuauacuuuccuauuuuugcauauuaagauuuaauuugcuaaaggagauuuaauuuccuaagaagcaaacuuagauuauuaauauuaguuucuuuucacuucuaauauauacgcauuucaaugcuguaaauuuuugucaaugcacugccugugcugcguucuacaaauuuugguaaguuguauuuuuaucuugaaaguauuuuuaaauuugucaugagauuucuucuuugacucauguguuauuaguaauguugguuaauccuuacauguuuugagauuuuuuucaauuaucuuucuguuauugauuuuuagcuuauucuacuguggccugagagcagacauuguacgguuucuauucuuuuaacucuguuaagguguguuuuauggcccagaaugugguggcguauuuuggugaaucuuccaugugaucuugacaggaauguauauucugcuguuauuggaugaagcauaguucacccuugaacaugaguuugaacuacauggguccacuuauauguggauauuuuaaauaaaaguuacaucaguuaugccugccucuccagccuccccuuccacuucuucccucucugccaucggugagauaggaauaccaaccucuccucuuccucccuguccucagccugcucaaugugaagaugagggaggaugaagaccuuaaugaugauccacuuccauuuaaugaauaguaaauauaucuucucuuuaugcuuuuccuaauaacauuuucuuuuuuuuggcuuacuuuacugugagaauacaguauauaauacauauaacauacagaauacuugcuaacugauggcuugucuuaucaauaaagcuucuggucaacaguaggcuauuaguaauuagcuuucuguggaaucuaaaguuauacauaaauuuucaagacuguuggggguuggcaccccuaacacuugcuuuguucaagagucagcuguagucuguagauguuaauuaucaacuguacacuauagauguuaauuauauccaauuuauugguguugaguucaaauguaucuuuacugauuuuuccaugcuagaucuguccaccucugauagagggauguugaagucauuuuugauuuccguuacaguguuuugauaucuaacauuucuuuuugguucauucuuaggauuuccaucucuuugcuuacauugcccgucuguuguuacuacaugcuaucuacuuucuccauuaugaugcguagcauauuaaucauaauuguuuuaaauucauugucugauaauuccaacaucccgucuacaucugguucugaauguuuucuuucuucaaacuguaguuuuugcccuagaguaugccuuguaauuuuuucuuuucuuuucuuuucuuguuuuuuuuuuuuuuuugagacagggucuugcccuguugucuagucuggaaugcaguggcgugaucuuggcucacugcaaccuccaccucccggacucaagugauccucccaccucagccuccugaguaacugggacuacaggugugcaccaccaugccuggcuaauuuuugcuuuuuuuuuuuuuuuggggguagagaccauuuugucuuguugcccaggcuggucuugaacuccugggcucaagcaguugacccacuucagccucccaaagugcuggaauuauaggcauuagccacugugccuagcuguaauuuuuucuugauaacuguauaugauauaucagguaaaaaagcaauugguuuaaauaugucuuuaauaauguaauuguaagauguacgcgggagugauguguuguauaguccugugauuaggucucagucuuuuugugagucuaugucucuggcccaugaauucacaagcauuucucaauuuuuuccucccccuuuaggugggauaggauggcuagaguaggauggaauuggguauuuaccuccucccauguggaaggauagagcuggcuggaguuggauauuuccaucccccaggucaguuaggcuuugaugaaaccucagcagguuaggcucugcuuaacugguuucuuuucaggguagaucuuauuaagaaguacagagugcucugggauauuucagaaugguuuguuuccccccccgccacugcuggaaacaugaggggauuuuacugcgaugauauguaugauacuguauuuacugugagaaccugaucuagcuccuggagguaaaauucacaaaagcaugggggcccccaugacuggaugccccuggagcuuucaacucucagucgugcccacaccuaguuuccagcaguuugucagcaguccagguuuuccuaucuaggcacugcuuccuguagaaauuucuguuccaguauguugugauucucuguaucccugucugucuguuuaauuuuaggaguagcaguuuucccagugacccuaccuaucucaccuuuucuuacagaucugagaaaaguuguugauuuccacuuuguucagcuuuuuaauauguguuaggauggcauagugacuuccaggcuccuuacaugugaaaccaaaaccugaaguccccauauuauuguuuuaaaucuuuuguucuuuuguaauauacuuuuagagauaaagauuucuuucuaagcauugcuuuauuuacaaaccacaaauuuugauauguuuuguuuauuauuuagugaagcauauuuacaacauuuccucgugaauccuaguuugaaccaugagcuacuuagaagcauguugcuuaauuuccacaaauuugaagauuuccccaauauacauuuuauuuuuuucuugguacauaguauuuguauauguuuacugguguaugugugauauuuugucauaugccuagaauguguaaugaucaaguguagguauuuaggauaucgaucaccucaaggauuuaucauuucuguguguugggaacauuucaagaccucucuucuagcuauuuugaaauauacaauacaucauuaacuguagucaucugcuaucaaacauuagaacuuaucccuucuaucuaacugcguguuuguacuuauuaaccaaacuuucuuuauucuucuaucccuaccacauccuuccuagccucugguaucuaucauuccacucucuaccuccaugagaucaacuuuuuuuagcuccuacauauuaacaagaauguaaaauauuuucuuucugugccuggcuuauuucacuuaauagaaugacauccaguuccauccauguugcugcaaaugacaggauuucauucuuuuuuuauggcugaauaguaucccauuguauauacugcauuuucuugauccacugauggacacuuagguugauuccaugucuuugauguugugauagugcugcaguaaacuuaggagugcauguuaauuccuuucuuuuggauaaauacucagugguuccugcaauauauuuuguuacugauuucuaauuuaauuuuauugguaucagagagcauacucugaaugguuucaguccuuuuaaguugauugacauuuguuucauuacccagcauauggucugccuggaaauguuucaugcauuuuuaaaaguuauguguauccuauagcuguugggugaaguguuuuauaaauauuaggcugaauugguugauaguggacuucaagucuuuuagacccugacagauucuuucucuacuuauucaaucaacuacugagagagaaguacugaaaucuaaauauuauuguaguuuugucuguuuuauucccuuuuguucuauuagauuuugugauuuuuuuaaaaaaaguucuauuauuaugcaaauauacauuuagaauuguuggaucuuuuugaugaauugacccauuuaucuuuaugaaaugucucucuuuauugcuuagaaaauacucccugugccaaagggaguuguugcuugacauuaauacaggcauauuugcauauaguauuuuuauucgaaguuccuagagcagucaaaucuguagggacccaaaguugaauggugguuucugggggcuugggggagggggaggggagauagggaguaguguuugagagauagaguuuuaauuaggaaagaugaaaaaguucuggagauggauggugcugaugauugcacaacaauaugaauguaccuaaugcaacagaacuauacauuuuaaaaugguuaaaaugauaaauuuuauguuauguauauuuuaccacaauuuaaaaaaagacauagcaccaaaaaaagaugaugaaugaauaaauuccaaaaagcugugccaggagugauaauguauaguuuguuuagaaucauugaagccuucauucuuuauuuaauugaagcaguuaaaaauaaauauuaauuugaaauaaaaaucagcagcuagauucuauuauauuuuauucaaauuuggaauuuuuuuuuuuuuuuuugagacagagucuggcuuuguugcccaggcuggagugcuguggcacaaucucgccucgcugcaaccucugccucccuaacucaagccauccucucaccuuagccuccuaaguagcuaagcuacaggcaugcaccaccacacccauguauuuuuucguagagacgggguuuugccacauuguccaggcuggucucaaacuucugagcucaaaccaucuguccuccuuggccucccaaaguguuggaauuacaggcaugagccacugugcccagccaaaaauuauuuaaauuauagcagaaauacaguuuccuauuugggucucacgagaauguguuuauucuuuguuucagcaagagaaggcagcugcuguggauuugacuaaccacuuagaauacacucugaagaccuauauagauaccagaaugaaaaaucuggcagcuaagauggaaauacugaaagaaaugagguagguaaaagcauauuuuucagaaggauauuuuaaacuaauuuuuaaucaauuggugcuuuguuuaaauugugugcuugccauuuuugcuuuaaaauuuaaccuuuguauuuuuaugacuucaaagagagaaagauaguuauuucugagaugaauuuuauacuguuuuugucagguuucuacugucacugcuuggagcuagaguguucuaagguuauaacugagacugaaauugaaaaaacagcaacauagcuuuuaagugauaguuugaugggaaacuaccauauccaguuauuuugcuugggguuauuuucaggaguacagcauguccuugaauaacguguuuucauucaacauuauuucauuauaacauugaagaagaaaaucaauuccuagcuggagccccacugucuguguggaguuugcacauucucuccauauuugggugguuuucuuggaauacugugguuuccucucacaucccacuuaggugaauuggugugucuguauugucccaguaugagugaguguguggaugagggugagugugcccugcaaugcaagggugucauguccaggauugguuccuaccuuaaugcucugagcugcugagauagauguggccaccugcaaccccuggauuggaauaagcggguuggaaaaugaaugagugaaugaguauauacagauuaucauaaaauaaaaauuugugaaguaugcaagaaucauacagaugccuuugcaauaagcgaugugacaugaaagcauucagcaagcccacuacguuuguuauuguuuguuuuugaaccuguggugguagggggcgcuucuuagaauuuucgcuugcaaacauuuauuccuugauuuaacccuacugucacccacucauucaccaaaguuuggguaaauaauuaucuuuguuguuuuuauugcuuuuucuuaaauguguguauaggacacguauauuuuaguguuuaauauuagaaauguuuugggucuuuauuuggaagugcuguuuuugugacuaaaaauaugccauaggaacuuaacucuuguuuagaucaauuagccuaugauacuauggguuucuuauaugucuuuucucuuagacauuguaaauuaucuguagaccaaaaauugaagguucauuugauaccauuucaaauucugcagacuuucgaaguugccuuuuuuauaguuuaaaaaauuuuuaauuuuuucauauuuuuuaugucaugaaauuaguauauccacaguuguuuuuuaauuaaaaguuuauauuaaauuaugcaugucugcauaaaaauauguggacugaaaaaaauaaguuauacaugauuuuauauaaaguuuuaaaagguaccccuucaaagccagugcuguaaacacuaacuuuuagaccauuacuauuaaaguguaacuuuuucucacaccagcuuucuaauuuauugaucuucuucuuuuugauguuuuuaaaaauaggcaugucgacaucaguguccguuucggaaaagaccuuucagaugcuauacaaguguuggaugaagggugcuuuacuacuccagcuucuuugaauggauuagagauaauaugggcagaauacagucuggcucaggagaauauuaaaacuugugaauauguggugaguugggaauuuuucucuauugugguuuuuaucuguugaacauaaggaaguguuuuuuuaauuucuucuaaaaaaaauaacaggauacaugugcagaaugugcagauuuguuacauagguauacaugcgccgugguaguuugcugcaccuguccucuaaauucccucccucacccccccauuuccuaacgagcccugguguguauuguuucccucccuguguccauguguucucaauguucaacucccacuuacgagugagaacauguaguguuugguuuucuauucuuguguuaguuugccgaagaugauggcuuccagcuucauccaugucguugcaaaggacauaaacucguuccuuuuuauggcugcauaguauuccaugguguauauguaccacauuuucuuuauccagucuaucguugaugggcauuuggguugguuccaagucuuugccauugugaacagugcugcaguaaacauacgugugcaugugucuuuauaguagaaugaucuauauuccuuuggguauauacccaguaaugauauugcugggucaaaugguauuucugguucuagauccuugaggaaucgccauaucgucuuccacaaugguugaacuaauuuacguucccaccaacacugugaaaguguuccuguuucuccacauccucuccagcaucuauuguuuccugacuuuaaugaucgucauucuaacugguaugagaugguaucuucuugugguuuugauuugcauuucucugaugauuagugauguugagcuuuuuuucauauguuuguuggccacauaaaugucuucuuuugagaagugccucuucauauccuuugcccacuuuuugaugggguugucuuuuuccuguaaauauguuuaaguucuuuguagauucuggauauuagaucuuugucagauggguagauugcaaaaauuuucuucuguucaggagaacagguugccuguucacugugaugauaguuucuuuugcugugcagaagcucuuuaguuuaauuagaucccauuugucaauuuugacuuuuguugcauuugcuuuuguuguuuuugucaagaagucuuugcccaugccuauguccugaacgcuauugccuggguuuucuucuaggguuuuuauaguuuuagguuuuacauuuaagucuuuaauccaucuagaguuaauuuuuguguaaaguguaaggaagggguucaguuucaguuuucugcauaugucuaguuuucccagcaccauuuacugaauaggagaugcuuucccaauugcuuguuuuugucagguuugucgaagaucagaugguuuuagaugugugauguuauuucugagguuucuguucugcuccauuggucuauaugucuguuuugguaccaguagcaugcuguuuugguuacuguagccuuguaguauaguuugaagucagguagcaucaugccuccagcauuguuccuuuugcuuaggauuaucuuggcuauauggggucuucuuugaauccauaugaaauuuaaaauaguuuuuucuaauucugugaagaaugucaaugguagcuugaugggaauagcauugguucuauaaaauuuuuuggccaguauagccauuuucaugauauugagucuuccuauccaugaggauggaauauuuuuccauuuguuuguguccucucuuauuuccuugagcagugguuuguaguucuucuugaagagguccuucacaucccuuauuagcuguauuccuagguauuuuauucuguuuguagcaauugugaaugggaguucauucaugauuuggcucuuugcuugccucuuguugguguguaggaaugcuugugauuuuugcacauuuauuuuguauccugagacuuugcugcaguugccuaucaguucaagacguuuuuggggugagacgauggggauuucuaaauauaaaaucaugucgucugcaaacagacaacuugucuuccucucuuccuauuugaauacccuuuauuucuuucucuugccugauugcccugucgagaacuuccaauacuguggugaauaggaguggugagagagggaaucguugucuuguaccaguuuucaaagggaaugcuuccagcauuugcccauucaauuugaggcuguggguuugucauaaauaacuguuacuauuuugagauauguuccgucaauacuuaguuuacugagaguuuuuaacaugaaggcauguugaauuuuaucgaagcccuuucugcaucuauugagauagucacgugguuuuugucauugguucuguuuaugugauggauuacguuuauugauuugcguauguugaaccagccuugcgucccagggaugaaguggacuugaucgugguggguaaguuuuuugaugugcugcgggauucgguuugucaguauuuuauugaggauuuucgcaucgauguucaucagggauauuggccugaaguuuucuuuuuuuguugugucuuuucccgguuuggguaucaggauaaugcuggcuucauaaaaugaguuagggaggaguccguccuuuucaguuguugggaauaguuucaaaaggaaugguaucagcuguucuuuguauuucugguagaauucggcugugaaucugucugguccugggcuuuuuuuggucgguaggcuguuaauuacuaccucaauuucagaguuuuuguuauuggucuauucagggauucagcuucuuccagaagggguggccagccccugcacaccugugggcguuucucgucagguggaacgagagacuugagaaaagaaagagacacagagacaaaguauagagaaagaaaagugggcccaagggaccggcgcucagcauguggaggacccgcgcccgccggcaaaggucucugaguucccucaguauuuauugaucauuaucucuaccaucucggagagggggauguggcaggacaauaggguaauaguggggagagagucagcaggaaaacaugugaacaaaugucucugugucauaaacaagguuagaaaaugugcugugcuuugaugugcacauacauaaacauaucuggugcauuaaagaguaguauugccgucagcaugucucaccuccagccuuaaggugguuuucuccugucucaguagauagaacauacaaucggguuuuacaccgagacauuccauugcccagggaugagcaggagacagaugccuuccucuuaucucaacugcaaagaggccuuccucuuuuacuaauccuccucagcacagacccuuuaugggugucgggcugggggacggucaggucuuucccuucccacgaagccguauuucagacugucacauggggagaaaccuuggacaagaccuggcuuuccuaggcagaggucccugcggccuucugcaguguuuuguguccguggguacuugagauuagggaguggugaugauuuuuaacaagcauacugccuucaagcauuuguuuaacaaagcacauccugcauagcccuaaauccaugaaaccuugagucgacacagcacaugucguagggagcacaggguuggggguaggguugcagauuaacagcaucucaaggcagaauaauuuuucuuaauacagaacaaaauggagucucuuacgucuacuucuuucugcauugacacaguaacagucugaucugccuuucuuuuccccacacuaccugguuuagucuugguaggguguaggcauccaagaguuuauucauuucuucuagauuuucuaguuuauuuguguagagguguuuauaguauucugugaugguaguugguauuuuuguggggucaguggugauaccccuuuaacauuuuuuguugagucuauuugauucuucucucucuucuucuuagucuagcuaguggucuguuuuguuacuuuuuuuaaaaaacagacccuagauucauugauuuuuuuuuggaguguuuuuuuugugugugugugucucugucuccuucaauucuucucugaucuuauuucuugucuucugcuagcuuuuggguucauuugcucuugccuuucuaguucuuuuaauugugauguuaagguguugauaugagaucuuucuagcuuucugauguggguauuuagugcuauaaauuccucucuuaacacuacuuuaucuguguccuggagauucugguacauugucucuuuguucucauugguuucaaagcacuucuugauuucugccuuaauuucauuauuuacccuggagccauucaggagcaaguuguucaguuuccaugacauugugugguuuugagugagcaauacuaaccuuaaauguaaaugggccaaaugccccaauuaaaagacacagacuggcaaauuagcuaaguggucaagacucaucugugugcuguauucaggagacccaucuuccgcacaaaaacacauacaggcucaaaagaaagggauggagggaaauuuaccaaacaaauagaaagcaaaagaaagcagagguugcaguccuagucucugauaaaacagacuuuaaaucaacaaagauaaaaaaagacaaaggcauuacguaaugguaaaggaaacaguucaacaagaagaggugacuauucugaauauauaugcacccaaggagcacccagauucauaaaacaaguucuuagagaccuacaaagagacuuagauucccacacaauaauaaugggagacuuuaacaccccacugucaguauuagaucaacgagacagaaaauuaacaaggauauucaggacuugaacuuagcucucuaucaaguggaccugauagacgucugcagaacucucuaccccaaaucaacugaauauacauucuucucagugccacauggcacuuauucuaaaauugaccacauaauuggaaguaaaacacucuucagcaaaugcaaaagaacugaaaucauaacaaacagucucucagaucacaguguaaucaaauuagaacucaggaaauguuaucuuucuagaaagacaaggaacuggagauauuguaaugauaguuuguguaaaaccuuuaacuuuuacaguaucuucauauuaauaauuuccuucauuuauugccuuauaagaaagguguaauagacaacuggugauuguggauaagggguagcaaaaucuuuucccuuuuugcaugaaaacuuuaccuuugguuaacucccucucuuuguucccuugguaaugugauaaaauauuucaacuguguuacuaggcaacauuauuuaugguaaguauaacuuaugauugucaaacugcaucuguacugggagaaacuacaaacuacaaauacuugauguggacucuuguaacuaaacaugccccuugagggacccuggaagcuauaccuauggaguuguuacaagagauacuggcuuuugagggacauuaggcuuguaaaccagaguggcuuucauacaugcuaauguggaacuuuucuggucugagugguguguuuuaugcauguaagacucugccuuacuauuaauuagugucugagucaccuauuguugggagguaguuguuugugugugugaguaggggugugaaaaugaaauauuuuacauaaauucuuuauuagcuuagguacaaguauauuuauuuccuguugcaguuuucuuuaauuuauuguauugggcugaacagaacuuccuguuuuucuuguaaaccauucccuacaaccaccauaacuuucccuagcaccugugagcucuauacuuguuguguuuggacuuguuccaucuuaaauauuugugguuucugccucuguggauuauacccuguaaaucuuacucccuagucauaccuagguugaucaguuggcagccugacugccucugaaugagaaguaugagcaggauaacuaggcuuuugaaaaugccaggaauguuuaguuuggagaagggauuugauuuugguuauuuuacguauuagauucuaacugaucacuucugauuaugggagaaagaagaugacagcagaaugauuaauuuuuuaauuucuaugaaacacaggcaguguguuuauaaacauuuucuuacauuaacuuuuaaaaugggcauauuugcucccauuuuauaagugaggaaacaggcuuacaaggguaaggaaauuguucaagauuaccuaguuguaauuuuuuaaaauuaaaaaauuacucuuuuuuuugagguauggucucacucugucacccaggcuggagugcaguggcacgaucacagcucacugcagccucaaccuccagggcacaagagauucuccacuucagcuucccaaguagcuaggacuacaggcgguguacuaccaaccaugccuggcuaauuuuuuuguacuuuuuauagugacgggguuuuaccauguuguccagacagguuuugaacuccuuggcucaaguaauccuccugccuuggccucccaaaguccugggauugcaaguguuagcuaccaugcccguacccuaguucuaaauguuaauauggaacuugaacccagacaugucugacagcaaagccuauuguuuuuccauugaaaccacacuauugauauuaaaauacuucuuaauguauuuucauguaagaugaaaagauguaaaaaaaccugccuuauuuguuuuugugguuugagcauagugaaaguauucaggauggagcuuuagcacuuacuauccuaugaguacagaugugacuuuuuuugaaagcagaauuuuuuuuuucuacuacugcuuguguuuccggacuuaaaguuuacuugauagauggaaguguagauuauuggcuaaauauauaaucauaauagccacucaaaugaaaucgucauuuuauuucccuuauuguacuuauuuugguuuagaauugauaacuuuuauucaaguauuuugcauaguucuuuaacuugauugccauguggccauaugcuuuuuuuuuuuuuuugagacggagucucgcucugucgcccaggccggagugcaguggugugaucucggcucacugcaaguucugccuuccggguucgugccauucugcugccucagccucccgaguugcugggacuacaggcgccugccacucugcccagcuaauuuuuuguauuuuuaguagagaugggguuucaccauggucucgaucuccugaccucaugauccgccugccucggccucccaaagugcugggauuacaggcgugggccaccgugcccagauguuuuuuuuuuuuaaugaugaaaacaguaggcuuuacuugaggucuuuucuuuuuuauuuauaguuuuaaaauaaucugguugagcuuaugcaagaaaaaauauccuaaaauucaggcuuuuauaguuuuauaguuuuauaauguauuuuauaguuuuauuuauaguuuuaaaauaaucugguugagcuuaugcaagaaaaaauauccuaaaauucaggcuuuuauaguuuuauaguuuuauaauacauuuuauaguuuuauuuauaguuuuaaaauaaucugguugagcuuaugcaagaaaaaauauccuaaaauucaggcuuuuaaguguaugugccagacacuguuauagguaauagagauuaaaacuuuuuuauuuuauuucauuuuauuauuauuuuacuuuuaggguacaugugcacaaugugcagguuaguuacauauguauacaugugccaugcugcugugcugcacccauuaacucgucauuuagcauuagguauaucuccuaaugcuaucccuccccccucccuccaccccgagauaaaaauuuuuaaaagacauauccuuucuuucuuucuuggguacaggauggauauauuaauauauaguuuuaauacaguaugguaagugcuauaauaaagaaaaugcauagaguucuuggauaucuuucacauauguauuuccaaacacagccuguuggacaaauuggaggguuuauccugguguuuaaguguaucuugaaggaugaguagcugaaggaguugagaaugggaugggaauagaaaagaggccauauguaauuaguaggaacuuauauaauuuucuguaagaaaaacaaaaauuucauuguugcagaaauaaugggaaaaauaaaaauuagaucagaguuguugaacuuaaauguuuuauuuuuaauuaagagaaaggaaguuuuuuugucauuuuguugaucuaaggagagaaauguccuaagugcuauaauguuuggagaauauaaaguuaauuuuggagaucacuuuuuuucauauaggucauaugcggaaaagaccugauguauuaaugaugguuauucuuuuuuucuuccuccagagugaagggaauauuuugauugcccaaagaaaugaaaugcagcagaagcuguacaugucaguagaagauuuuauucuggaaguugaugagucaucucuuaauaaacgcuuaaaaacauugcagguuggaauuaaaaauauauuaaauauacguuaaauuguaaguuuauuuaagaagugaaauuagcauuuaccuuaagacuuuagauuguucugugaugguugcaaaaguuuuuccuguuuccugaauucugauuucuuuuuaaugggauuaaaaguuuauauuaauauauuuuguggcuauguuuauaugcauaucuaucuugcaaacaagguaaaauggcuagggacuccaguauucacuggggaaauuaauggagacaggagcaguagcagguaugugggucccuaucguccauugcauucuagcagaaaauguaguaggaccacauguuacagggagaagggaucaacucugauccauaaauuauaggguuuuuaggcuccaugaccagggaaguuucucccugaugugaucagaggcuagaguacuguaguacauauagcuauaugauaugguggaaucuugucuucagcucugucuugccagcucaggaaugacuuuaauucggggugaaugaacaugacaguguuaaguaauuucaccuaauaauaguguuucucucuacuuauucagaucuuuuuuuguccuuuaauauuguuuaaaauuuuucucuauaaguccucaugcuuuuuucuucauuuaacuuuuauuuauuuaugcuuuugauugcuuuuaugaauauuaucuugucauuuccuaguuuugauugaauagaggaauacuguucauuuuuauguacugguguuucucugauaacucugcugaucucucuuuuaguucucauuugucuguugauacucugcuuucuguguuuucaaauguuuucauuugaaauguuuucauuuucuaauguuuucauuugaaauguuuucauuuucaaauguuuucauuucauuuucaaguguuuucauuugaaaacaauaacucuuuaaucuuuucucuucuaguccuuuuaccuuuuauguaucuuugaauuuuuacugcuuuggucaguuacccuaguacuaagcugaccaguagcuaauaucgaucuuguuguggacugcagggaguaagcuugcuagaaauuuggagaagaagauauucagggacaucugggcauuguuucuuucuguccugcuggaugaagauguaguuuugaugaugcaccacauggcuuaagaaccauuggagcccugguuugaaacauuuucuuaauuggaauugcauaaauaguauaaguucuuccagaauguugaaguaagccuugcauauaaaagggcaguaauauaguaagaauuuagcuuuccacaaugcagcuucuacuuugucccuuaaagguuuauuucuucucacuguuaguaaauguagguuaagguucuguaauuaagaucaucuuuaaaccucuuuucuuuuaaaaguucaaugcuagaagacuuuuugccuuaacuggcuugucuccacuucuaguauucccucaggucaccaaaauauucuuuaaacuucucuuuauuuugcugagaaauaguuuauauuuuucaaguauccaagaaagauauuucuauaaugaaggucaaauaaaugaaaguucuugauuucugauuuccucagcauuuuauuuagacuucuuuuguggcauacaauacauguuugauuuuuugugacuggucuucuuaaguucaaaaagaaauuguauucucgguuuucuugguguacaguuuuagauauaucuaaaacuugcuuagguuuugguugguucaguauaucagucuuugagauauuuuuguuacauauaucugaaauagauagguuugucccuauuugucccuauuguucuuuugguucuuguucaaaguauuucagcgccacauuguuggguguuaagguauucaugauuguaauguauuuaaaaauguguaucccccccaugacacauguuuaccuauguaacagaccuucacauguaccuccaaaccuaaacuaaaagucaaaaauaauaauaaaaauguuuucuuuuuaacuacuauguaaucuuauuuuuucacuuagauuuuaaaaaauaaaaauuuuuuuguuugccuuuuaaguucguaucccaccuuucuuuuugguuaacacugcaacaucuuuucuuuuuuucuauuuuuauuuuauuuauuuuuauuuuucuugagauggagucucgcucugucgccuaggcuggagugcaguggccgaucuccgcucacugcaaccucugccucccggguucaagcgauucuccugccucagccuaccuaguagcugggauuacaggcacacaccaccaugccugucuaauuuuuuguauuuuaguagagauggguuucacgauguugcccagggugggcucgaacuccugagcucaggcagucuacccaccuuggccuccaaagugcuagauuuacaggugugagccaccgcaccuggcuucucccuuuauuuuuaaccuuuuguauucacguuuugaaauaaccucuugauaacacacuaauggauuuaauuuuugaaagcacccaacguauaucuuuuuuguugguaacuuaauuuacauauuuauaauuacuguuuuauuaaaacuuauuucuguuuaucaucguuucuuuuucucucuuuuucuaacuuacaccucuuauacuuuuuuuuuuuuuuuugagauggagucucacucuguuacccagguuggagugcaguggcacagucuuggcucacugcaacuucugccuccuggguucaagugauucuccuuccucagccucaugaguggcuaggauuacaggcaggccuggcuaauuuuuguguuuuuaauagagaugggguuucaucauguuggccaggcuagucuugaacuccuggccucaagucauccacccgccucagccucccaaaguguugggauuacaggcgugagccacugugcccggccacucuucuaauacuuuagaacauucuuaucugccuuuggugucuuuccucucuuucucuaccuccuuccccaaaccaaccagugaaccuaccacaauugucuaggauuuuagucacggguuauuauagauauugugugugauagcucaguuaaauagacuuuagaguuauuuuuccauucuuauuucauaagucguuuaucucuuggcuuucucuguauauuggaauauuuucucuaagagugcuuucaaagaaaucuuuguguauuugauuuugcgaguuauuugauauuucaggauaucucauuucaaucucaaauacaaauaguuguuuagcugacuauaaaauagcaaguucaaaggccauguuuccuuuacaccuuugacaauaauaaucuauuguuucauuucuaucauuuuauuucuuuauuuauuugagacagagucuugcucuuucacccaggcuggagugcaguggugccaucucagcucacugcaaccucuggcuccuggguucaagcaauucucaugccucaaccucccgaguagcugggacuacaggcaugcaccacugugcccggcuaauuuuaguagagaugggguuucacgauguuggccgggcuggucucgaacuucugaccucgagugauccgccucucuuggccuccuaaagugcugggauuacaggugugagccaaagugcccagccuucuuauuuccauaauuguuaucagucuaaucuuuguucuucugugaucuuuuuucccucuggaaguuuuaaaauuuucucuugacuuuguucuuaaguugcaucagaacauguuuauguuuugacugaaucugagccaguucagucugagguuuuauauauuucuuuaauuguagguaauacuugauaauuauuuauugagauacuucucucccccauuaauuuuuucucuuauucugagacuucugauagauauuucagcuucuauuucuguuaucuacauauuuuaauggcuaaucuauuguuuaaaaucuuuuuaucuuauguaggagguggguuaaacuaaauaaauaaauacaaucuuuuuaucuuguuggugucuuuuuggagggauccuugacuuaaccauguagcuaaugaauuaauccucuagcugugucccuucugccauuuagccaauccauugcauuuuguaugucaaagauuauuucuuuuauauuuaauaucuucaguugguuauuuuuuauuuauaaguacuuggcuuuuguguuuccaauauucuuucuuuuguugagaauauuuauuaugcuuauuuuugaguucuuacuguuaucugggccauugacacugauuuugcuuccuuuuuauaaaguggcuuaguuuuuuauacuucuuucagagugcuugugcuguucacaccauuuuauccucuucuuaucucuccucaagaucucauauucccuuggaacuauaagcuaccuuaguucuuugcuguuguguaguuauaugaagggccuagggaagagugaaagucuggaccacaacuuuuaagacuuuggauagguuuagggaauagaaugggguuauuuuuauuuuuaagggucuagcuucugauguugccaucugggauuaucuacuuccucuuugcuucucuccuggguggucuguccuacucuucagcaaaccucuauucccucugccucagcuacugcuccuuuccaggcacuaccacccuuagauguaaaugcugccagauauucaggggagaagugaaggaaagagaauggucaggggcuggccagcucuucuguauugguuaucaguuuuugccucaucuguguucuugugcuguacuugcauaaaccuguugccucuugauggugcugcuguuuuucuuucugaugugagggagagagaagagccuaugaaaaaaguuuucuuuucccacagguaauucugugcugugacacaguccuucuuucacuuguagggacuuuguuaauucaaugcuaaacaccaaccauccucugccuaagauuucucagaguuuugugauuaaaaacuucugagaucucuuaagcuuuuuuucuuaucucuguaaaauuucuaggguuugauuucuggagagagcuagcaggcugugccuaucuugucuuuuccaauucuuuauuacauuaaaaaauuuuauuguuacuguuauuuuuuuuuugugcaccugccccgacaaacccagccaggccaauucauuaaaaaaaugccuuuaaguacagucaagggcugcaugguuuggucagugauggacugcauauauggugguggugccauaaaauuauaguacuuaacuguaccuuuucuguguuuacauaggcaaucauuguuacaauugcuuacauuauucagcacaguaacaugcuauaucuaggagcaguaggcuauagcauguaguuugguuguguaguaaauuuauaccaucuagguuugcaucaguacacuccaugauguuugcauaaugaugaaauugccucacgaugcauuucuuagaagauauccguguuguuaagugaugcaugauuguccauauauauguuuaaugucuuuacuuaauuagaauuauuuguauauuuuagcguguaguuuauuuuuauuuggcaaucggucuuagaaacuuucaugccaggacaaacaguagugauucuuaugauagacaaaggagacucagaagggugauuagggguggagagugguggauguugagaaauuacuuaauggguucaauguacauuuggaugauagauacacuaaagcccagacuuuaccacuacacaauauauccauguagcaaaauuacucuuguacuuaauaaauuuauacaaaaaguuagggaaaacaggguaaugucuacuuaauuaaaaaccauaaggauauaaagcuuucuauuuguaacuaauucacuuaauaaacuuuacuguuaugguccaaauaaaccaccuucuagguaguuuuguguuuucaucucuaucugaugauucuaaguuguauuuaugaaauucucaagaauggggauucagcauacugcuuuucuaccccuuagauccuaacacagugcucgaauccugaauuaguuaauaaacuuuaauaaacagaaguauaucucucugcaggauuugucagucucuuuagaagcaguguauggacaagccaaagaaggagcaaauucugaugaaauacuuaaaaaauuuuaugacuggaagugugauaaaagagaggaguucaccaguguuagaagugaaacagacgcuucucugcaccgucuuguagcaugguuccaaagaaccuuaaagguaauaaaagcuccugcccgguuguguuuguagcauaaaccagggaauauauauuuuaaaaaucacgcgcuuuguucaagagcugacaucaucuaccuacuauguaucagauuuaaaauugccaccuuaccagucaagguucuuuauuagcuuuuagucagauugcuccuuuuauuagucucaaaaaaaucauaucggucuuguuccuccuuuuucucagcuuuuccuaaggauuguccucuuuccucuuuuaaccauuuauuuauuuucuuacaguaugcuauguguauguaccuuuuccuuucagugcauaaauuuuaugaggguaggcacuuuuuuuuccugcauuccuaguucuuuuacauugcccaggguauagcuuaauacucugcuucagguauuaaggcacgaugaaugcugauugaauuaaaugagauauuucauguguuuauuuuugcaaaugagguuuuugaccuaucuguggaaggaucacugauuucagaagacgcaauggauaauauugaugaaauccuagagaagacugagucaagugucugcaaagagcuggagauagcucugguugugaguaucgauauucuuuauuauugccuccuuugaagcagugugguuuccuuucaugguuagaaaguauuaaccaauaauagaguuuuucuugcuaguuagaaaguauuaagacugaucuuagcuuucuucuaauaggcuuguugaaagaguaacaaugucuaguucuaauccagacaccaugcaaagucuuauucuuaggugacauuuuuguuuuaauaggacauuucacauaaaaaaucuguuuaauucuaagaaaacugcucuuaauuugaguggacaaucuugucuauauuuugauucuugaaugcgucauaccaaaugacuauaagaagagacuccuuagaguuugugaaaacuuaaaaucugagagagcucugaaaguugacacacaagauggaguggucauccucuuucuuucuccauuguguauauucuuuguuacagugucaagguaaaaauuaguguagcuacuccaaaggguguuuuguaauuuuaauuauugcucauugggacucuucccaguuauucaggcugcuuuccaauguuucagugguuaggcuucucauuuuacuuguuuuuucuuuuuuuuacuuuuuauaauuuuacucauauuggcauuaaaaauacauuaagaaguuuuauauuguuaaauaguccugauguagauaguuuugucagacuugauuuuaguaguaguuguuaacaggugauuucuaaaaguaaaguguugaaggucuauauauuguuuauaguucuuauauuuagcauauuaguaucccugauuuccauuaaugcucuuauucuacacagcuuugggaauaaugguguaauacggguaaaguuucccauaugaauggcuuugcuuuuuuuagagagacagugucuugcucugucgcccaggcuggagugcauugaugugauccuagcucacugcagccuugaacuccuuaaucucccugccucagccucccuuguagcuaggacuacagguguauaccacugugcucagcuaauuaaaaauuuuuuuuuagggacuggucucacuauguugccuggcugccauaugaacaucuuugauaucuaucuaucuucugacuaggaaaacauuuguguuuaagaacuguuuugaaaucacugcggaaaucuguuaaaggcauaauuuugaaguuuaucuauuguuauuggaggccuuagcuguuuuggauauuccuuuguguauaauucuaugugugugauuucauuuaggaucaaggugaugcagacaaggagauaauuucaaauacauauagucaaguacugcaaaagauucauucagaggaaaggcucauugccacaguacaagcuaaguacaaggacaguauugagguuugauugugcuuucucuuauugaucuuauaaauugaugauuugaauuuuucaguacuuaaauuuuucuauuguuguuuaauacucagugucaguaaauuguuauuacuagaauucacugucaacuggaaauggugauuuuugaugauauaaauauaucaaauuuuuuauuguuuuaaauauuuuauuauguccaugagaaccacaauuuuuaacaucauuuucuuuuugccuguaugagucuacuguagauaauuugcuauauacagaaagauaagaaauaaaacauugcuuauaauucccuuagccuaagagauaguuuuagaguauuuacucacuggaugugcaucuguauguuugugagcauauauauaugcauugcauuguuuuuuaaguuacuucaaacauacuuucuucauuuaaugguauauuaugaacauuuuucuauaugauuuuucuauacugucaucuugagugacuaaauccucaucccuauguagauguacaacaacauuaaccuuucauguguguuggacauuaagguuacuuccaauuuuuccuaccauaaauaacacuguacauauguuugugcauaauuuuuuguuuuuauuucucagauuucuaaauucuauaauuacugaguuaaaaggaauggacauuauuaauuaaaacuugauacauauuuucaaaccacuuuugggaaagaugauuucaguuuacauccucacuagaaauuccuuuuucauccauacuaacaauguguguuuuauuguaugucucaguuugaaauauuacuuuugucuuuguuacuuugagugcuggaacugauauucuucuaaauagaaacauggauuaaaaaggaaaucuauugaauugucuuguugaaaauuauagauuuucuugguauuucagucugaacucaguaaauacuaguugaaucuuaacagagaaauaauaaaugaucacuguucaauaaauacuuuucuuauguguuugaaaauacguaacuuuuguuuacuuaguuuaaaaagcagcuuauugaauauuuaaauaagagucccaguguggaucacuugcuauccauuaagaagacauugaaaagcuuaaaagcucuacucagauggaaauugguugaaaagaguaauuuggaagagguaaggaaacaguuguuucuuacugaucuuuaugugcaucucauuuuacuuggucucugcuucauaaaaauaaugcauaaauacacucuuuacaauaagagagccauuacauucacauuuuguuuuauauacuuuaucuuguuuucuguguauauaaauaaaauugagauuacaguaauaguguaaaaauuuuccuauaucauuaaauauucuuuaaaaacauuuuccuaggcugccuugguucuuaguaacaugaacauuuuagaauaauuuuaaaagcucuuuuaguuuggacuguuagaauguuuauuguaauaccaacuugcuacaugcaggugacaggguacccccucgaagguagcguuuugucauaaaguauuuuuaagaucaugguaucuuuuguuaacucccuuuuuauggauagauguaauauuucuugcaaguauuuuaaguugcuuuuauaugauaauagaacuggagaggauuaggaugcccuaaucuggacuaacuucuuccuuuaggcuugaaacuuugugaauaagauaguaaacuuuguguuccuuugaggauuugauuuauguacaaggaucuguauuaugccuuaauccaauuugaauuaucugucuucuacuucugagcacugaauuggggguggagcggaggacuauucuagaacuaauaucauaguugaagaacuuucuaguuuuauucuauucugggcuuuggggaaguugauuuuuuuagucugauuuuucaacuuuuggagaaaucugacuuuuguuauacuuuaaguucugggauacaugugcagaaugugcagguuuguuacauagguauacacgugccauggugguuugcugcacccaucaacccgucaccuacauuagguauuucuccuaaugcuauuccuccccuagacccccacccccugacaggcccagugugugauguuccccucccuguguccauauuuucucauuguucaccucaucuuaugagugagaacaugcgguguuugguuuucuguuccuguguuaguuugcugagacugaugguuuccaguuucauccuugucccugcaaagaacacgaacucguccuuuuuuauagcugcauaauauuccaugguguauaugugccacauuuucuuuauccacucaaucauuggugggcauuuggguugguucgaagucuuugcuauugugaacaguacugcaguaaaccuacaugugcaugugucuuuauaguagaaugauuuauaauccuuuggguauauacccaguaaugguauugcugggucaaaugguauuucugguucuagauccuucaggaauugccacacugucuuccacaaugguugaacuaauuuacacucccaccaacaguguaaaaguauuccuauuucuccacauccucuccagcaucugugguuuccugacuugugugugugugugugaguguguguguguguguguguguauuuguauguugccuauguuguuuuuuuuuucauuauuauacuuuaaguucuacaguacaugugcacaacgugcagguuuauuacauagguauacaugugccauguugguuugcugcacccauuaacuagucauuuacauuagguauuucuccuaaugcugucucucucccugccaccccccaccccacaacagaccccggggugugaugguccccuuccuguguucaaguguucccauuguucaguucccaccuaugagugagaacaugugguguuugguuuucuguccuugugauaguuugcugagaaugauggcuuccaguugcauccaugucccugcaaaggacaugaaaucauccuuuuuuauggcugcauaguauuccaugguguauaugugccacauauucuuaauccagucuauuauugaugggcaacuggguuuguuccaagucuuugcuauugugaauagugccacacuaaacauacgugugcaugugucuuuauaguagcaugauuuauaauccuuuggguauauacccaguaaugggauggcugggucaaaugguauuucuaguucuagauccuugaggaauugccacacugucuuccacaaugguugaacuaguuuacagucccaccaacaguguaaaaguguuccuauuucuccacauccuccccacugucuguuguuuccugacuuuuuaaugaucaccauucuaacugguaugagaucguaucucacugugguuuugauuugcauuucucugaugaccagugaugaugagcauuuuuucaugugucuguuggcugcauaaaugucuucuuuugagaagugucuguucauauccuuugcccacuuuuugaugggauuguuuuuuucuuguaaauuuguuuaagucgugguagauucuggauauuaaaccuuugucagauggguagauugcaaaaauuuucuccauuuuguagguugccuguucacucugauaguaguuucuuuugcugugcagaagcucuuuaguuuaauuagaucccauuugucaauuuugucuuuuguugccauugcuuuugguguuuuggacaugaaguccuugcccaugccuauguccugaaugguauugccuagguuuucuucuagaguuguuaugguuuuaggucuaauauuuaagucuuuaauccaccuugaauuaauuuuuguauaagguguaaggaagguauccaguuucagcuuucuacauauggcuagcccguuuucccaacaccauuuauuaaguagggaauccuuuccccauugcuuucccaguuuucccaauaacauuuauuaaauagggaauccuuuccccauugcuugcuucugucagguuugucaaagaucagaugguuguagaugugugacauuauuucugaggccucuuuguguuccauuggucuguauaucuguuuuggcaccaguaccaugcuguuuugguuacuguagccuuguaguauaguuaaagucagguagcaugaugccuccagcuuuguucuuuuugcuuaggauugucuuggcuaucugggcucuuuuuuaguuccauaugaaauuuaaaguaguuuuaaaaaaauucugugcagaaauucagugguggcuugaugggaauagcauugaauuuauaaauuacuuugggcaguauggccauuuucaugauguucauucuuccuauccaugagcaugaaaauuuuuuccauuuguuuguguccucucuuauuucguugagcagugguuuguaguucuccuugaagagguccuucacauaccuuguuagcuguauuccuagauaccuuauucccuuuguagcaauugugaaugggaguucacucaugauuuggcucucuguuugccuauuauugguguauaggaaugcuugugauuuuugcacauugauuuuguauccugagacuuugcugaaguugcuuaucagcuuaaggagauuuugggcugagacgaugggguuuucuaaauauacaaucaugucaucugcaaacagagacaauuugacuuccugucuucuuaugugaauaccuuuuauuucuuucucuugcuugauugcccuguccagaacuuccaauacuguguuaaauaggaguggugagagugggcaugcuuguccuggugacaguugucaaagggaugcuuccagauuuucccauucaguaugauauuggcuguggguuugucauaaauggcucuuaauauuuugagaugcauuccaucaguaccuaguuaguugagaauuuuuagcaagaagugugucaaauuuuaucaaaggcuuuuucugcaucuguugagauagucgugugguuuuugucauugguucuguuuaugugaugcauucuguuuacuuauuugcauauuuugaaccagcguugcaucccagggaugaagcugacuugauuuugguggauaagcuuuuugaugugcugcugaauucaguuugccaguauuuuauugaggauuuuugcaucaauguucgucagggauauuggccugaaauuuucuuuuuuuuuguugugucucugccagguuuuuguacgaggaugaugcuggccucauaaaaugaguuagggaggauucccucuuuuucuguuguuuggaauuguuucagaaagaaugguacuagcucuucuuuguaccucugguggaauucaccuguguaucugucugguccuggacuuuuuuugguugguaggcuauuaauaacugccucaauuucagaacuuauuguuggucuauucagggauucgacuucuuccugauuuagucuugggaggguguauguguccaggaauuuuuccauuucuucuagauuuucuagucgauuugcauagagguguuuauuguauucugugauaguagcuuggauuucugugggaucaguggugauauccccuuuaucauuuuuuauugugucuauuugauucuucuuuauuagucuggcuaguggucuaucuauuuuguugaucuuuucaaaaaaccaacuccuggauucauugauuuuuuuuugaaggguuuuucaugucucuaucuccuccaguucugcccugaucuuaguuauuucuugucuucuacuagcuuuugaauuaguuuguucuugcuucuguagcucuucuaauugugauguuagggugucgauuuuagaucuuuuccgcuuucaccugugggcauuuagugcuauaaauuucccucuaaacacugcuuuagcugugucccagagauucugguacauugugucuuuguucucauugguuucaaagaacuuauuuauuucugccuuaauuuuguuaauuacccaguagucauucaggagcagguuguucaauuuccauguaguugugugguuuucagagaguuucucaaucuuaaguucuacuuugauugcacugugaucugagagacuuguuuguuaugauuucuguucuuuuccauuugccaggaaguguuuuacuuccaacuguguggucaguuuuagaauaagugugauguggugcugaaaagaauguauauucuguugauuugggguggagaguucuguagguguuuauuagguccacuugguccagaguugaguucaaguccugaauauccuuguuaauuuuccaucucauugaucugucuagucuaauacugacaguaggguguuaaagucucccacuauuauugugugggagucuaauucucuuuguaggucucuaagaucuugcuuuaugaaucugggugcuccuguauugggugcauauauauuuaagacaguuaacucuucuuguugcacugaucccuuuaccauuauguaaugcccuucuuuauuuuuauuuuuuuuuaucuucguugguuuaaagucuguuuuaucagauaccaggauugcaaucccugcuuuuuuuugcuuuccaucugcuugguaaaucuuccuccaucccuuuauuuugagccuauggugugucuuugcacgucagaugggucuccugaauauagcacaccaaugggucuugacucuuuauccaauuugccaguccuugucuuuuaauuggggcauuucaccuguuuacauuucaggucaauauuguuauuugugaauuugauccugucauuaugauacuaacugguuauuuugcccauuaguugauguaguuucuucauagugucgacggucuuuacaauuugguauguuuuugcauuggcuggaaccaguuguuccuuuccauauuuagugcuuccuuuaggagcucuuauaaggcaggucugauugugacaaagucucucagcauuugcuugucuauaaaggauuuuaguucuccuuugcuugugaagcuuaguuuggcuggauaugaaauucuggucugaaaauucuuuucuuuaagaauguugaauauuggcccccacucucuucuggcauuguacaguuucugcagagaaauugcuguuaguuugaugggcuucccuuugugaguaacccaaccuuucucucuggcuucccuuaacauuuuuuccuucauuucaaccuuggugaaucugacaauuaugugucuugggguugcuguuuuugaggaguagguuuuugguguucucuguauuuccugaauuugaauguugaccuguccugcuagguuggggaaguucuccuggauaauaugcuuaaguguguuuuccaacuugguucccuuuucccugucacuuucagguacaccagucaaacguagguuuggucuuuucacauagucgaauauuucuucaaggcuuuguucuuuuucauuuuuuuucuuuaaucuugucuucaugcuuuauuucauuaaguugaucuucaaugucugauauccuuucuucugcuugauugauuuggcuauugauacuuguguaugcuucaugaaguucucauacuuuguuuuucagcuccaugaagucauuuauguucuucucuaaacagguuauucuaguuagcaauucgucuaaccuuuuuucaagguucuuagcuuccuuccauuggguuagaacaugcuccuuuagcucggaggaguuuguuauuacccaccuucugaagccuacuucugucaauucaucaaacucauucuccauccaguuuuguuccguugcuggcgaggacuugugauccuuuggaggagaaaagauguucugguuuuugaaauuuucacccuuuuugugcugguuuuuucucaucuucuuggauuuaucuaccuuuggucuuugauguuggugaccuuuggauguguuuuuuuuuguguggacguccuuuuuguuuaugcugaugcuauuccuuucuguuuguuaguuuuccuucuaacagucaguccccucugcugcagguuugcuggaguuugcuggaaguccauugcagacccuguuugccuggguaucaccaguggagacugcagaacagcaaagauugcuacaugucccuuccucuggaagcuucaucccagaggggcaccugccagaugcuagccagagcuauccuguaugaggugucugucguccccugcugggaggugucuuccagucaggaggaugggggucagggacccacuugaggaggcagucugucccuuagcagagcucgagcacugugcugggagauccgcugcucucuucagagcuggcaggcagaaacauuaaagucugcugaagcuaugcccacagccgccccuucccccaggugcucugucccaggaggaugggaguuuuaucuauaagccccugacuggggcuucuaucuuucauucagagaugcccugcccagaaaggaaucuagagaggcggucuggcuacagaggcuuugcugggcugcggugagcuccguggagucugaacuuccugguggcuuuguuuacacugugaggggaaaacugccuacucaagccucaguaaugacagaggccccucccccaaccaagcuggagugacccagguugacuucagacugccaugcuggcagugagaauuucaagcuaguggaucuuagcuugcugggccccaugggggugggaucugcugagcaggaccacuuggcucccuggcuucaacccucuuuucaggggagucaacgguucugucuugcuggcauuccaggugcaagggggguaugaauaaauauuccagcagcuagcucggugucugcccaaacgucugcccaguuuugugcuugaaacccagggcacuggugauguaugcaucugagggaaucuccugcucuguggguugugaagacuguuggaaaagcauaguaucugggccagaaugaaccguuccugauggcacagucccucauggcuucccuuggcuaggagagcgaguuccccagccccuugcacuuccugggugaggugacuccccacccugcuuuugcuugcccucuguaggcugcacccacugucuaacuagucccagugagauaagccggguaccucaguuugaaaugcagaaaucacucaccuugucuguugaucucgcugggagcugcagaccggagcuguuacuauuuggccaucuuaguaucuggauccuugaaaucugacuuuuaaaguguaaaccaaacuaucugaggcagguaucaaucaauuuagaaaguuuguuuugccaagguuaaggaugcaugccugggaggcaggucugugccuuucucagagaugauuuugagggcuuaaauauuuaaaagggaaaggauggauacuggggaaagaggaagaaauuuuaaaaagaugugaguagauaagagacagaugguuugaauucuuuaauccuugaucaccuuucagcaaauacacuauuuacauuugagagagggguagaggaauagucacuagcucagugaaucugcauuuuuacaucagaggaaggaaucagauaugcauuugucucaguugagcaaagggaugaugacuuagaguucuguccuuuguccugcaccugagaaaauaagccaucaauuuaccuugucaggguaaaauucaacagaacuguuuuagggugaagauccugagacccauaaggaauuuccuacugagcaaauugugagagaggugugcaggguuuuuaugguuguagcuaucuuauuuaggaauaaaaugagaagcugguuugccugacacaguucccagcuugacuuuuuccuuuggcuuagugauuuaaaguucacaagauuuauuuuccuuucacaaaagcauacauacuuuuuaagguggcuuauguauuaucauuggagacaguucacacauuuacucauccuuuuguuuuguuuuuaacuaaauaucauguagaagacaauucuagggaauucagguguauucugguugcuauuauuaacauuucuuuuguucgaauggcaguuggccaucuuuaucuuagagaaaaucuacagcagaugaagagacaagaaaaaucuguauaauugauuuuaugucuuuacuuuuuguaauuccuuuuucuagguuucagaaaagucauuguuagaauaaauugaccuaaguuaauucagcaaguauuagaagggucuuuuaugugcuagguacugaaggauacauagaaaccacacagaguaauuuacuauagaacuugaauucuuaaaagaagacuuguuuucucuauguuaauaaaaaacacuuuuucuuucugauucaagucagaugauccugauggcucucaaauugagaaaauaaaagaagaaauaacucagcugcgcaauaaugucuuucaggaaauuuaucaugagagagaggaauauguaaguauuugguucuuugaaguuuuacauuagguuuuacucuagaaauugaauuuaaauacccguuuuaugaaguggacuguaaucacaaggcuagagguauuauauagaaaguuuauauauauauugaccugguaagauuuuuguaaauuuagaaauaaauuucacaugacaaaauauucugaccauuguaccaguguggaaauaacugaaaauuguaaagaaggaaaaacaucacuuguaauauuuccacucagugauaauaguaguaaucacuguuaacuuuugacuuucuuuuaguauuuuuuuguuuguuuuuagaauugagauuauagcacagacacacuuuugcauauugccuuuuuucuguuuaacauaaaaccuaaagaccuuuuccuuacaucaacgucauuuucccauaauguugcagugaaaacauuaauggagcacauaauuuaguugaagaauguaacaaaauaagucuaccugguuuugggggcaggagaaguuacaucuuuuaagucucuauuuuuaccacugauuuuugugagcuugggaaaauaagucauuguauuuuuucuuuaaaauggaagaauauuguauuuuauaucugggagauguuaccaggaagaaguuaguuaagaaacagugcuuugaaaguaaaaauacugaccgggcauggcggcucacaccuguagucccagcacuuugggaggccgaggcgggcggaucacuugagcccgggaguuugagaccagcuugggcacauggugagaccccaucucuacaaaaaauacaacaauuagcuggucauggugucauguaccuguagucccagcugcuuuggaggcugaggcaggaggauugcuugaacccaggagguugaggcugcauugagcuaugaucaugccucugcauuccagccugggcaacagagcaagacccugucucaaaaaaaaaaaaaaaaaaaaagaaaagaaaagaaaguaauaauauuaauacugugaaaacaauagguaagugucaugcuuucuuuagcaaauucaucugcguauauguaaauaccuuauggaccuuggguuaaaauagcgaucuugcaaugauuugacaaguguuuagaaguuuugcuuaauaaauaugugauaaguggcuuuucuuucgugaggguacucaauuuucacauuuauuucaaaguuacuuauguagagcuauguguuuuuucucuuaggcuuuaaaaauuuuucuuaacgaaacagcuguuauuuuaaaaugucacuguguucuuaauauuuugagaaauaaugacaguuuuaugccucaaauugaaauauuaucagacauuuucauuuuaguuuggaagugggugaggacuuugaccuugcaagauuugugcuuauguauguauccaaagcuuaaaauugguaauuaaauuuuucuucaauuaguaagaugguaguuuagauggguuaaaaaaaaaaacuucagccaacuuaaauuuaaaggagcaaugaacaauucgcaaauugggcagcugaaucacagcauauucggagagacucuggggaugcuuuguggucagaacaaauuaauagacgaaaaaaggaaaguggcuuucagaaauuggcagcgagguacagaaacagcuauauugguuacagauugguguuugccuuauuugaacacaguuugaacacuuagcagucuguaagugguugaaguauggcggcugggauuggccaagacucagcuauuguuauagguccacacugcuaaguuacauuuucagucucgucugccuguuaagcuagguugcaguucauccacaaggacucaaauauagaaguacggaguccuucucaggccauguuuaauuugcuuuagcagaugcaaggugagucgugguuuucacuuguuauuucuugaaguagaaggcaaaaucagugauuauguaucuuacuggauauguuauaagguagaugcugauauauuuuccugaagagcaacaugucaaaauugaauauauauugaucuacaguuaaaaacuuuuuuuuuuuaacuuuaggagaugcuaacuaguuuggcacagaaaugguucccugagcugccucugcuucauccugaaauaggauuacucaaauacaugguaaacuuuguuucccuugcgaauuacuacucuucagaggguguugaaaagugauaauauuaaauuugugucaguguuaaacuuauaguaucuuuuaaauaaaaauacuccugaugaauauuuuauggguauuagaacuuuuucuuaugacccuuuaauaguugcaugguauauauuuguauuuuuauguaaauuugcauuauccguuuuucugcuuuccucauccucauucaguacauugcaugacacuuauuugaauuauagguguuuacuuuuugaaaugacaaaauaaaauuuuaacugcuauuucaagaguuaggauaaaaacaagauauugcuagcccugagggauuugagcacaauggguuuuuuaaguuaaagcagucugggaaaaaauucuagagagguugguuaagguagagauguugagguggguaugguuuucuagguaggcaggauucaaaagcuggagaucagcauauuaaauaggggccauagggagcaggauuaguaaacacugguuuacuaaucuguuaguccugaaucuguuaguccugcgauuuauauugccuucuacagugagggccuagaugagguauuuauucauuaagauugucacgaaguccauuauaauggcuuaaauaugguacagagagggauauuuguguagacaugugaguuuauucuaaaaaauauuuaagauuaaaguucccuaacuuaaauaauuacucuaaacucuuucuagacuagacuuuaaaaugaugugaguuuuuucuugcaacuauuuagcuuagugauuaccuuaugcagugugggcaaauaaguauguacugccacaugggacuugaaaauuaauauuuaaaaauaugcuaaucuacuuuauuauggaagauuauaaaagguuugacucaugguuuauugaagucuuuaauggcuuucugauguuuaacuguaauguaugcuuaggaauuuuuuguagguugauuauguauuguagaauacuuaaauguaccgacaagacuuaaaaaaaaaacccagaaaacaauucuacaaugccucuuacugaaacugcaccacaguaaaacuuagcuuuguuuaaaauguugaugaucauauuuuagugugaaaaauuauuccuuuuaaaaaguagcagaaauaucuaguaaaauuaguuauugaaagccauuuucacuuuugaggacuccaaacaggggcagagguguuagaauuacuucaugguagucauaauuuuuggacuaaucuuucccauuugauaccuacauuuuugucauuauuuuaccuuauuuauuuuuuguuuuuuuacaaauguuuauuucaguaguuuuugggguacagguguuuugugguuacauggauaaguucuuuaguggugauuucugagauuuuagugcacccaucaccugagugguguacacuaacccaauauguagucccucauuccucacccccgucccaaucaguuguuacuuuaguauuuuuuaggaaacauaagugguuuuucaaguaaacauuagggauccuaggaugcaugucugguugauucuagucauuuccugaaucuguucuaaaauuauagcaguaauuaaauguauggugauuacacuuuggguaggaggaguuuaagagccaggaacuggagaaaguacacaguuuuaaagauuuuaauuuuguugguuuuuccaguacaguugaugguguccaagucauuuaauaucguguaacuaauuauuuugaugauuuuuaagugcugggauuguuuggauucuuuaacugugauaaaaacuugugccuagaacucugguggucuccuuacaaugagcuuggaacgagaucuucuugaugcugagcccaugaaggaacuuagcagcaagcguccuuugguacguucugagguuaaugggcagauaauucuguuaaagguaagucuaacuucuucuuacuugugggagauucagcagcauaaaggauaguggugcuguuacauuucaagaaagaaaaaaccucacuguuaguuuucuaaaguguauaaguugacuggcaugauaauugugcuuguaguuugguugccagaacuaauuuucacuuuuaaaguuucccucaauugaacaaugagaacacuuggacacagggcggggaacaucacccgugggggccugucaugggguggggggcagggggagggauagcauuaggagaaauaccuaauguaaaugaugaguuaaugggugcagcaaaccaacauggcacauguauacauauguaacaaaccugcacguugugcacauguacccuagaacuuaaaguauaauaauaaaaauaaguauauaaaagucauuaaauaaagcuuugucucacaagaaaaaaaaauaaaguuucccucauuucccuaaauagaauauguccuuaauaggauauacuuuccuuuuuuuuugggugaacuuauuauagucauccaauaucuuuuuaaaauucuugauuuucuuacauuucuccuugaaaucucagcuguguuaucaguacaaucuucuacucuuuaauuucuucuucucauugaucugggaaacuguuaaucaugauaauaagauaauuaauuuggccuuaguugcuacacauucuagaauguguagcaggcuacagguagaauugcacuuuccuuuuccaaauuauagcauucaaagaagauagaaaaguacuuauaaaauuaaaaaauaaaauuagauuugauuuaacuuaaaauaaugaauuauguuuaaauuggaaugauguauaauuauaaugagauuuucaucuuggaauuacgagugccucuuucuuugguacaagggcuauucuguggauguugacacagaagccaaggugauugagagagcagccaccuaccauagagcuuggagagaagcugaaggagacucaggguuacugccauugauauuccuguuuuuauguaagguaaaguucuuaugcuaaucucuugcagaaaccauuuuaucuugcagaaacuauuuuauuuaaaauaaauuuuagcuccagguuuuagagcagcaguucauuccccuuaacauaaaagaaaaauuaucccauagaaucaauguaugcuaaaaauauguugaagaaguuuuuacuuggagucacauucucuguuuugcuucuuagucugauccuauggcuuaucugauggucccauacuacccuagggcaaaccugaaugcuguucaagccaacaugccuuuaaauucagaaguaaguaaaaagcacuauuuauuuccauggauguauuaaaugagaaaauaacaccugauauuuauucaggcauacuacaugcuauguauuuuguaaaauuuugacucaugguauucuauuugucaccucaagccugugauagaaguuaucguguuauauagaugagaaaaagcguuaaagggauuagauuaagugacuugcacaggguccguuagccagagguagagcugggacucgaaauuaagucuuucugguuccaaagcccaaacuuacaacugcuaagcugugcuguaugugaacugccuaauauagcacuugguacuguaagugcuuaaguggcagcuuuaauuuuugucauuguaaguuuaggauuaguaauaacaguaaaggaggcccugauucuucuuauggaguaacacuguuucagucucuuauagcuacuuuacaugguugguauuuguaauccaagucuucuuugagaugauagaacagguguccucagaccccaggucgcagacugguaccagucuguggccuguuaagaacagggcggcacagcaggaggugaguggcaggugagcaagcauuacugccugagcuccacuuccuguaagaucaguagaggcauuagauucucauaggagcauaaacucuauugugaacugugcaugugagggaucuagguugcgcacuccuuguaagaaucuaaugccugugaucugagguggaacaguuugauccugaaaccaacccccugcauccauggaaaaauugucuuucaugaaaccggucccuggugcccaaaagguaugauuguacacacacacacacacacacacacacacacacacacacacaaacacacacaggcacacaugguaucaccauuacaaaaucaagccuucaucuggucuuucucuaugcuguauucuuauuaaugguucauuucgaggaaacuuuacucacuucuagagcagucuuuuaauuagagaacaguuucaagauuaaaaugauuugccuacuuccucacuucuuuuauguguacuuaucuauaggaaacuuuaaaggucaugaaagguguugcccagggucugcauacauugcauaaggcugacauaauucauggaucacuucaucagaacaauguauuugcuuuaaaccgugaacaaggaauuguuggagauuuugacuucaccaaaucugugguaagauaucaugguuuuacaaauagguucuagacuuuauuuaauauuauuaagcaguaguucagcacuuauauauaauauaauacuuuauuauaggaucuuugucuucaguuaaacugugucauguaguauaagcaacuauuugcccucagcuagaugcuagaacagcaggaguauuguguauuuuaaccauaagucuuaggagcuaccugacauuauauacucaauggcauugacaacauuaauaauuuugucaucauuaggaaacauuuaauugcuaggaaacauguaaggaaacuagguggccaucuccuaaaccucucuccacuggugucccuccgucuauagauacaauuuacauauacguacuuugcuguuuuuugauuaauaaugugcauuuuuagaaaccggggaaccuuggacuuuuuaguuuaaauccugauucaccucuaauggcuguuaauucagugucauauuaccucagaauaggcaguuuguagagauagcaaaaucacacaauuuaagagcauguugugauuuuuuugucguuauaauggaaacaauucucuauuuuaauugagaaauaaaaauuguauauauuuaucauauacaacaugauguuuugaaguauguauacaauguggaguggccaaaucaguaauuauuuuucuaaacauuacagcuuuauugagauacaauucacauaauguauacaauucauuaauaguuuguaguacauucacaaagucgugcagugauaaccaguauugaauuccagaacauuauuaacauucccaaaaagaaaauccauacugauuagcagucacucaaauuucccacuucuucucaagccuggaaacuacgaauacacuuucugucucuauggauuugccuauuuggacaucucauguaaauggaaugauacaauauguggccuuuuaugcuaauuucacuuagcauaguguuuucagaguucauccacguuauugacuguaucaaaaugucauuccuuuuuauugccaaauuauauuucauuguauggaugcaccacauuuuguuuauauauucaucaguugcuggacauuugguuguuuauacuuauugguuauaugaauaaugcugcuaugagcuuuagcauacaauauuuuuuguguggacauguuuucauuucucuugggaguggaauuacuggguuacauuguuuuacuuuuugaggagccaaacuguuuuccaaaguggcuacaucauuuuauauucuucccaguaauguauagggauuuuguuuucucuacauccuugccaauauuuuuuauuaucugagcaauucccuuugacuaguauauguuauaaugcuuuuauacuuuggucaucugcaagucauaguguaaugcuacuggaguauauauagucuuaaugguuuugauaugguagcucaaaaagaugagaaaaugaaacugcaacuguaaucaaaagcuggauuguacaggauuuauacagauugauuuucugaaauauuuacuuuauuacauuaguuuaacaaaauuaagauauccuaagaaauauaacuaaauuaugaauuuugaaagaucucaaccuucagggguucugguuaguuuaccuuuugagcauacuauuugcauaauuauagauaugacuacaauaauuacucuuuagucauucgucaucuguuauuauuccccaaaacauuguuuuuaauuuucaguuaaaaauauuuauucugaaauauugaucaaacucaccuuuugcuacauuuuccaugcaauuuucagauugaagugguuaucaggaagauaaauuugaaaaguagucugaggucaagaucauugcuuuucaggccuuauagugcauacaacucaccugggguucauguuaaaaugcaaauuaauauucagcauuucugcaguggaucaucugcauuucuaacaagcuaccaguuaaugcuguagcuccuggcccuuggaccauacuuugagaagcaaggaucaaaaucguagcuagaaaaaagauagcacuuagugacacaugcuaggcauuguaucucuguaagguagacauuauuuccauuuuacaaauuaauucaggcucaaagagguuuacaccuacuauguacccauaaaaauuaaaaauaaauuuuaaaaauggacaaaaaagagguuaaagcccucggucccacagcaaauaaauaggagaguggggaauuguaaccaagaucugccugaauauaggauucaugcuauugucacugaucaucuuugacauguuagaaaugguauauuuagagaaugaucaguaaggaaggaaagugcuuuguaggauuucaguucuuaaaugaauuauuuagaauuuucagaauuagaacauggcacugcugcucacucuugugaaauuuauuuuuuaaaaagaguaucaaauguuuaaucacagaauaagugguuguuaguauuaaaucuguucaagucuacaaagugaauguaaaaaaaagucccauaguuaauuuauuagacugauuuuaagagcaauuuauaauagcagaaauugguaaaaauauuugaaagcaagggaaugaaauauuuaaaaugaauuuguuuuuuguauugauuaaaugcagaguacuucacagaaagucaccucaacuguguuguaucugaaauauguaaaauauuguuuuugcagagucagcgagccucggugaacaugaugguuggugacuugaguuugaugucaccugaguugaaaaugggaaaaccugcuucuccagguucagacuuauaugcuuauggcugccucuuauuauggguauguuauuuuuuuguugaaauagaucauauauauauauauuucaguauauaaagugaugauuuuauagugauucuccuuaaaaauaaaaagcagcagacuuuuaguagaacuuuaaguuuuaacaaaaacuauugauaugcuuccuauuaccuauuguguacuuucuacaaauuggcuugauguauauuuuagguaucaugcuauugucuugguucuguugaagucaagauuaacagugaagaugauuuuguccuacauuaaucugaaagcaguucaugcauauauggaaaauaaauguuaaauaagccuuggguauauuccugcuuccaguguagaccaaauagcuguuucucauccauaguuuaagaauuaagaaguuggauggagcuggagaccauuauccuaagcgaauuuacuguggaucagaaagccaaauacugcauguucucacuuauaagugggagcuaaacacugaguacauauggacacaaagaagggacacuggggucuacuugaggguggagguugggagaaagguaaggauugaaaaacuaccuguuagguauuaggcugauuaccugggugacaaaauuaucuguacaccaaacucccaugacacacuguuuacccauguaacaaaccugcacauguaccccuugaaccuaaaauaaaaguuggaagacaaaaaaauaaaaagcuuguuucauguuguacugcuauuuuacguagagaaugccucuuuuuccaaagucuugagugugacaaaaccuuaucuuuguugaucacauaaauaaaaauaaucuccuuguuagaaaaacaagaguuaagagggauuaaguauuaagagaaggaagacuauucuuaucagcccaggggccagcaagcauuuucuguaaaggaccagauggucucuguugcaaguacugaguucugcugcuauagcaugaaagcagccauagacaguauguaaacaaaucaguguggcucuuuuccaguaguacuuuauuuauggauauugaaauuugaauuucauguaguaugcaugugcaugaaauaguauuccuucaguuugcuauuaaacauuuaaaaaugugaaaacuacccuuggcuugcagcuguacaaaaacaaguaguggaaucaguuuggugcagaggccauauaguuugcugaucucuguuccaaucaguguaauaaggucaaaaaaagaaauaaaagucauagaguuugaaaaugaagaaauaaagcugucuuuauuugcagaugacaugcuuaauuauguagaaaaucuuugagaauguacauaaaagcuacuagaacaaaugaguuuagaaagauagcaguuuuaauuucaauauaauuguguuuuuauauaagcaacaaauaauaggaaauuaaaauuuaaaaaucauuuacaaaaguauuaaaauauggaauuuguagggguaaauuuaguaaaagaugugcaagaguugcacacuauuaaaacuacaaagcauuguucagagaaacucaagaagacauaaauaaauggagcgauacaccaugcucauggacuagaagacauuguauggauaucaguuguucuuggcuuauagauucgaugcaauuucaacaaaauugcugguagauuuugcuuauuuuuucagaaauugacaauuagauuuuacaauuaauauaaaaauggagaggaucugagauagccaaaacaaguuugaaaaagaacaaaauugaaggacccaaacuaccugauuuuaugacuuaauagauucuaggaaauuaagacaauguaggccuagaguggugguucaaaacuguaaucccagcacuuagggaggcugaugcaggaggauugcuuaaugccaggaguugaagacuagccuaggcaacacaagugagcacccccugucucuacaaaaaauagaaauuagcuggguguaauggcgugucugugguucuagcuccuugguaggcugagacagaaagauuguuggaguccaggaguuuaaggcuacaguaagcuaugacugcuccacugcacuccagccuaggcuacagagcaggacccuguuucuaaaaacacaagugauacugcugugaaguuagauguccagaugaauggagcagaauagagacaauauaaauagacugcacauguaugauaacuggcuuuugacaaagaugccaaggcaguucucuggguaaaaggagaaucuucaacaaaaaugauacaggccaacucauaccauauguagagaauaaauuuugauucauuucuuauaccaugcacaaaaauuagcucaaaauguguaucagaccuaaauguaaaacgugagucuaaaacuuauagaagaaaacauaggaugaaauauuugacuuucgauuuggcaaagauuucuuaaguaggacacagaaaacaucaacucuaaaagaaaaaaaucauuuggauuucaucaaaauggaaaaccuugcucuucuaaagacauugucacaaaaaugaaaggcaagcuacagacuaggagaaaauauuugcaaaacauauaucugacaaaaauauuauauccagauuaucaagagcuccuacaaucaauacuaagaagacugcccaguuaagaaaugggcaaaauauuugaacagguacuuuaccaaagaagguguccacauggcauguaagcaugugaaagaugcucugaacaccauuugucauuagggaacuacagauuaaaaccaaaaugagauaccacuauacuacucacuauaauguauaaaauuaaaaagaucguaccaacgguugcuuagaucuguuguaccuagaacucauauauauugcccaggggaauguaaagggaacaaccacuuugaaaaacauuuggcaguuuguuaaaagguugaacauauuccuacccuaugacccagcaauuccacuucuagauauuuagccaagagaaaugaaagcauauguccacacaaagauuuguauguaaauauugaaagaauuuauguguaauagaugaaaacuagaaacaacucaaaguccaucaacagaugaauggaaaaacagucugcuauguaugugucuauccauuggaauacuacucaggaauaaaacgauugaacuauaaauauaacucaguaagauaggugagucuuaaaauaauucugccaagagaaagaagccagaugauaagguuuggcugugucuccacccaaaucucacauugaauuguaauccccauguuucaaggguggggucagguggagauaauugaaucauggggguaguuucccccaugcaguucuuguggaaguaagucucacaagaucugaugauuucauaaggggcauuuucccuuuugcuuggcacuucuugcugcccccaugugaagaagaauguguuuacuuccccuucugccaugauuguaaguuuccugaggaauccccagucaugcugaacugugagucaauuaaaccucuuuccuuuauaaauuacccagucuuggggaugucuuuuauuaguggugugagaagggaccaguacaguaaauugguacagagaguggaaugcugcuguaaagauacccgaaaauguggaagcagcuuuggaacugcgucaugggcagagguuggagggcucagaagaggacaggaagaugugggaaaguuuggaacuuccuagagacuuguugaauggcuuugagcaaaaugcugauagugauauggccagugaaguccagguugagguggucucaccuggagaugagggacuuguuggaacuagaauaaacgcgacucuugauguuuuagcaaagagauugguggcauuuugccccuguccuagagauuggugaaacuuugagcuugagagagaugauuuagagcaucugguggaagaaauuucuaagcagcaaaguguucaagaggugacuugggugcuuuuaaaagcauuguuuuguguaaucacaaagauaugguuuggaauuggaacuuauguuuaaaagggaagcagagcauaaaaguuaggaaaauuuggagccugaugaugugguagaaaagaaaacccguuuccugggagaaacucaagccagcugcaggaauuugcauaaguaacaaguagcugaauguuaaucgcuaggacaauggggaaaguaucuccagggcaugucagaaagcuucgcagcagcccuucccaucacaggcacagaggccuaggaggaaaaaaugguuucaugggcugggcccacggucccccugcugugugcagccuucagacauggugcccugugucccaccugcuccagucauggcuaaaaggggccaagguacagcucaggccauggcuuuagagggugcaagccccaagccuuguuagcuuccaugugguuugagccugaaggugcacagaagucaagaauggugguuugggaacuuccaccuagauuucagaggauguauggaaaugccuggauguccaggcagaaguuuucugcagggguggagcccuuaugaagauacucugcuaagacagugcaaaacggaaaugagggguuggggcucccacacagagccccaacugguguacugccuaguagagcugugagaagagggccacaguccuccagaccccagaaugguagauccacugacagaucacacugugugccuggagaggcaacagacacucaaugccagcccaugaaagcagccagaagcggggcuguagccugcaaagccacuggggcagagcugcccaaggcugugggagcccacucuugcaucagugugaccuggaugugagacauggagucaaaggagaucauuuuggagcuuuaagauuugacugcccugcuggauuuugaauuugcaugaggccuguagccccuuuguuuuggccaauuucucccauuuggaacagguguauuuacccaaugccuguaccccauuguaucaaggaaguaacuaacuugcuguugauuuuacaggcucauaggcagaaggaacuugccuuauuucagaugagacuuuggacuguggacuuuugacuuaaugcuuaaaugaguuaaaacuuugggggacuguugagaaggcaugauuguuuuugaaaugugaagacaugagauuuggaaggggccugggguggaaugauaaugguuuagcuguguccccacccaaaucucaccuugaauuuuaauaauuccugugugucaagggcaggcccagguggagauauuugaauuacggggugguucccccauacuguucucaugacuuuagcccuaugccugcauguauauuuaaaguugucugguuucauugaaccagcacccucauggaaauaaacuagcaugauuuucaucaaugcuucaguaaucuauucuuuauaucagaagggugaaaguaaacauaucaaguuuuuuuuuuuguuucugggaggacucauaagauaucccauaagugugguaauagcaguuuuuauuccaccuauuuccuuuaaaugauaguaaaaagcuccaugaguaaauauauugucugauuuucuacucuuauguauuguugauuaaguccuuuaaaaacuuuauuuuuagauuaacuuguacaauggacuuuuuuuuguauacauucuaugaauuuuaacacaccuauagauuaguguaauaaccacugccacagccaggaugcagaacaguuccauaacccugaaaauuccugugugccaucccuuuguagucacagccuccucccaacccuuaaacgcuggcaaccacugaccuuuuaucacuguguuuugugcuuuuaagaaugucucacacauagcaauaugaaccuuaaauguaaaugggcuaaaugccccaauuaaaagacacagacuggcaaauuggauaaagaaucaagacccaucagugugcuguauucaggagacucaucucacauacaaagacacacauaggcucaaaauaaagggauggaggaauauuuaccaagauaauggaaagcaaaaaaaaaagcagggauugcaauccuagucucugauaaaacagaauuuuaaccaacaaagaucaagaaaguguaagaagggcauuacauaauggaaaagggaucaacgcaacaagaagagcuaacuauccuaaauauuauaugcacccaauacaagagcaccaagauucauaaagcaagaucuuagagaccuacaaagagacuuagacucccacacaauaauagugggagacuuuaacaccccaccgucaauauuagacagaucaacgagacagaaaauuaacaaggauauucaggacuugaacuuagcucuggaccaaguggaccuaauagacaccuacagaacucuccaccccaaaucaacagcguauacauucuuuucagcaccacauaacacuuauucagaaauugaccacauuauuggaaguaaaacacuccucagcaaaugcaaaagaauggaaaucuuaauggucucucagaccacagugcaaucaaauuagaacucaggauuaagaaacuaacucaaaacugcacaacuacauggaaacugaacaaccugcuccugaaugacuacuggguaauuaacaaaauuaaggcagaaauaaauaaguucuuugaaaccaaugagaacaaagacacaauguaccagaaucucugggacacagcuaaagcaguguuuagagggaaauuuauagcacuaaaugcccacaggagaaagcgggaaagaucuaaaaucgacacccuaacaucacaauuaaaagaucuacagaagcaagaacaaacaaauucaaaagcuaguagaagacaagaaauaauuaagaucagggcagaacugcaggagcuggagacaugaaaaacccuucaaaaaaucaaugaauccaggagcugguuucuugaaaagauuaacaaaauagauagaccacuagccagacuaauaaagaagaaucaaauagacacaauaaaaaaugauaaagcagaaaucaccacugaucccacagaaauccaagcuaccgucacagaaugcaauaaacaccucuaugcaaaucaacuagaaaaucuagaagaaauggaaaaauuccuggacacauacacccucccaagacuaaaucagcaagaagucgaaucccugaauagaccaacaauaaguucugaaauugaggcaguuauuaauagccuaccaaccaaaaaaaguccaggaccagacagauacacagucgaauuccaccagagguacaaagaggagcuaguaccauucuuucugaaacuguuccaaacaguagaaaaagagggaauccucccuaacucauuuuaugaggccggcaucauccugguaccaaaacgugccagagacacaacaaaaaaagaaaauuucaggccaauaucccugaugaacauugaugcaaaaauccucaauaaaauacuggcaaacugaauucagcagcacaucaaaaagcuuauccacaacaaucaagucagcuucaucccugggaugcaaggcugguucaacauaugcaaaucaguaaacauaaugcaucacauaaacagaaccaaaaacaaaaaccacaugauuaccucaauagaugcaagaaaaagccuuugauaaaauucaacacccuucaugcuaaaaacucucaauaaacuagguauugauggaauguauuucaaaauaauaaaagguauucaugacacacccacagcuaauaucuuacugaaugggcaaaaacuggaagcauucccuugaaaacuggcacaagacagggaugcccucucucaccacuccuauuuaacauacuauugcaaguucugaucagggcaaucaggcaagagaaagaaaggguauucaaauaggaagagagacagucaaagucugucugugugcagaugacaugauuguauauuuagaaaaucccaucaucucagcccaaaaucuccuuaagcugauaagcaacuucagcaaagucucaggauacaaaaucagugugcaaaacucacaaacauucuuauacacccguaacagacaaagagccaaaucaugagugaacucccauucacaauugcuacaaagagaguaagauacuuaggaauacagcuagcaagggaugugaaggaccucuucaagaagaauuacaaaccacugcucaaggaaauaagagaggacacaaaaaaauggaaaacaaauuccaugcucauggauagggagaaucaguaucaugaaaagggccauacuacucaaaguaauauguagauucagugcuauccccaucaagccaccauuaacuuucuucacagaauuagaaaaaacuacuuuaaauuucauguggaaccaaaaagcccguauagccaagacaauccuaagcagaaagaacaaagcuggaggcaucaugcuaccugacuucaaacuauaguacaaggcuacaguaaccaaaauagcaugguaccgguaccaaaauagauauauagaccaauggaacaaaacagaggccacagaaguaaugccucagaaguaucuacaaccaucugaucuuugacaaaccugacagaagcaagcaauggggaaaggauucccuauuuaauaaaugguguugggaaaacuggcuagccauaugcagaaaacugaaacuggaccccuuccuuacaccguauacaaaaguuaacucaagaugcauuaaagacuuaagaccuaaaaccauaaaagcccuagaagaaaaccuagguaauaccauuuaggacauaggcaugggcaaagacuucaugacuaaaacaccaaaagcacuggcaacaaaugccaaaauugacaaaugggaucuaauuaaacuaaagagcuucugcacagcagaagugaacacaucagagugaacagguaaccuacagaaugggagaaaauuuuugcaaucuacccaucugacaaaggucuaguauccauaaucuacaaagaacugaaacacauuuacaaaaagaaaacaaccccaucaaaaagugggcaaaggauauaaaccgacacuucucaaaagaagacauuuauguggccaacaagcauaugaaaaaagcucaucaucacuggucauuagagaaauguaaaucaaaaccacgaugagauaccaucucaugccacuuagaauggcacucuuugaaaagucaggaaacaacagaugcuggagaggauguggagaaauaggaacgcuuuacauuguuggugggaguguaaauuaguucggccauuauggaaaauaguguagcgauuccucaggcaucuagaaccagaaauaccauuugacccagcaaucgcauuacuggguauauacccaaaggauuauaaaucauuguacuauaaagacaugcacacuuaaguuuauugcagcauuguucacaauagcaaagacuuggaaccaacccaaauacccaucagugauagacuggauaaagaaaauguggcacauauacaccaugcaauacugugcacccuuaaaaaaaugaugaguucauauccuuugcagggacaugggugaagguggaagccaucauucucagcaaacuaacacaggaacagaaaaccaaauaccucauguucucacucauaagugaacauguucucacucauaaguugaacaaugagaacauauggacacagggaggggaacaucacacaguggggccuguuggggagugggggucuaggggagggauagcauuaggagaaauaccuaauguagauuaugguuugaugggugcagcaaaccaccauggcacauguauaccuauguagcaagccugcacguucuucacguguaucccagaacuuaaaguauauaaaaaaaagaaaaaauagaaaaaaauauaaauaaaaauaauaucauauuagugguaucauacaguauauaauuuugugagucuagcuucuuucauucagcaugugaaucaucuuuugugauucauucaaguugucuaauguaguuuuucccuuuuuuguuucugaauagugcucuguuguauguacauaccaaauuuguuuguucaccuguugcagaacauuugcauuguuuccagugucugacuauugcagauaaagcuacugugaacauguguguauagguuuuuaugugaacguaaguuuuuguuucucuaugguaauuacccaggagugaaauuucugggucagauuguaaucguauguauuauucuuuaaggaccugccaaacuguuuuccagaguggcuguacuguuuuugauuuucaccugcaauuuaugaaaguuucaguucagcaucauugucggcaccucguauuguuauuaucuucuauuuuagccauucucauaggugugugguaguguuucauugugguuuuaauuucucuaauagauaaugauguugagcaucuuuuaguuuguuuauuauuggcuuucuguauuuucuuuggugaagugucugucuuuugccuguuuuuuaauuggauuuuuguuuuauugcuguagaguuuugggcauucauaaauacauucuagauagaaguccuuuaucagaugucauuugcaaugauuuuuuucuggccuguagcuuuucuuuuuauuuucuuuucagugucuuuugcagagaaaaggguuuuaauuuugaaguuuaauuuauuauuguuuucuuuuuauguaucaugcuuuuaguguuguguauaagaacucuucgcauaacccaaagacuugaauauuuuuucuuauauuuucuucuaaaagcucuauaguuguaugguuuacauuuagagcugagaucucuuuggauguaauuuuuguguaaggugggagguuuaugucaggguucauguuuuugcauauggauguccaauuuuacaacaccauuuuuuuaagagaguguuauucucuguugaauugucuuuguaucuuugucagaaauaaaucggccauuuuugugugagucuguuuguggacucuuucugcuguugaucugugugucuauccguuuaccaacaucauacugucuugguuacuguaucuuuauaguaugucuuaaaauuggguaguaugauucuuuuucagauuuuagcuauucagcuaucuuuccuuuuuuguauauauuuuauuuuauauuuuacaucuuaccuuauuuuauuuuauugagacguguaaggucagccgagagaaaggaaaaauagaccuaaagucaggcgcguaaguuuauugaaccugaggggcugcuucaccucacucagaggaggcagcccugaguuuacaaaaugagggguuuauauuggagaagggaguuugagggaguucuuugguguggccgcauuccaggguuguuugcugguuaauuuugucacauaucaccuugugacauuugugguagcagaacuuucaggaagguguagguaaaguuuguuuauucuuccaacgaccucccgcugugcgguccagaugguucguaauugggguuuguuuauccagcaaggucugauaagugaagucugcuggcuucacuguggugccuagauaagggcuuagaaauguaaagaggcuugggggaaggguggacagcacggagacguuugaggggagcgccaagaagcuuuauggggcaguuugucuuuaagacgcagucucacucugucacccaggcuggaguguacuggcacaaucuuggcucacugcaaccucugccucccggguucaaaugauucuugugccucagccucccgaggagcugggauuauaggcacccgccaccacacucggcuaauuuuuguauuuuuaguagagaugagguuucacuauguugaccaggcuggucucgaacuccugaccucaagugauccaccugccuuggccucucaaagugcugggauuacaggagugagccacugcgccuggcugcuuuuccauguauauuuuacaaacagcuugucugugugcacaaaagcccugcugugauuuugauuggaauugcauuaaaucuguagaucaauauggggagaauugacaucuuuacuacauugagccuuuaauuugugaacuccauuuauuuaaauuuucucugguuucuuuuaucaacguuuuguuauuuugggcuuacagauucuauacauguguuguuagauuuauaccuaagaauuucauguuuggaagcuauuguguuuuuuaaaaauuuuuguuuucuaguuggucaaguucuuuuuuacaacaguauuuuuuugauaguaaaguuaguuugguacgaaaggcuguguauacuuugaccuuccuccucaaagaauugggcaauuuauuaugaaagcacauaguguaaaauauauaaaagggcaaaaagucaagauccaagggcugugcuuaaaaagguaauauucagaguuaaacuggaagcauuaucaaaagauuuuauuuacaaggccaugaagggauuacugucacuuugucuuuaaaaaaauuuuagaaauagcaauaauaaaaaaguaauaguuugauagcaaagcucuagaauacuaacuagauauuuugggcauaucaaagauacugugguuuuagaucauuuuucuuaugagauccagauuaaaugaaguguucugaagacugccuacagaaaauucaaaacaauggacaauucaaguguuguggguuauuaccuucaguaauaaaccauaucuuuuuuuaaacguuuaaauuagguuuggggguacauaugcagguuuguuauauagauaaacucgugccacaggggcuuguuguacagauuauuuugucacccagauacuaagccuaguacccaauaguuauuuuuucugccccucuccuuccuccuacccucugcccuuaaguaggccccgugucuguuguucccuucuuuguguucaugaguucucaacauuuagugagaacacagaguauuugguuuucuauaucuuuuaacugaaauacauggacuauaguuuuaucaugacaccauuuguauuaagguucuucacuauauuuuuagguuauuauggaaaucuuaaagguguuuucuagaagccaguuuuuaaaaaguauaacaguucugucugauguuacauugaaaaagaauuguguuucuguguguguugaggaguacugcugugaagaaguugaauauaaagaagagaauggcccccuuucuuuguuuauuuuuauuuauuuauuuauuuuuaagagauggggucucacuauauugcucaggcuggucucaaacuccugagcucaagcgaucuucccaccucgaucucccaaagugcugggauuacaggcaugaacuaccacgucugucccccuuuuauuuauucagagacacauuuucaguguugcuuucccuaaaaugcauuuuuuccugcuuuauuuuucuguuaccauauuauacacuuauuuaucuuuauuauugucugcuucuaccacucgaguggaagcuuuuugggaguagcuuaucuaucuuguuugccacuauauccucaaaugccuagaacugugccuggugcaaagugggcacucaaauauuaguugaaugaauguuuaaauuuuagccacaguuauaugcugaaguauuaggcuuuaaaaaauaguuccauguuuuuuuccugaguucauuuacuuaccucucauuuauggccccauguacaucauuuuauucuuuaaaaccuugcaugaagauuuuauuccgacucuuaauauauuucuaggagauguuaguggucauacugaucacccagugaaccuaacuuugcauuucuggaccuucuuaauaacgugagacccaaaccuuuauguaauuucagucacuuccccaaaccaggauuuugugaaucucuacaauuguuauuuuucaaaaguaauagaguccaauccauuauauuuuucuccuaacaggauuuccuguccucucauuuacugugucugcuaaucuuaaaucuccaguggguuuauuuacugucucucuuuucuuccaguuuaucagcagccuucuagcuuuuuucuuuauuuacucauucuuggacccuaucauacaauucccagacuaugccuuauauucccauuuacuccuguucuucuguuuagucuuuuuggaaaaaacucaauuuuagauaagcuauggccugccauuugugaguaaaacauucuuucucauuucucucucucucuuuuuuuuuuuugagacggagucuugcucugucgcccaggcuagggugcaguggugugaucucggcucacugcaaccucugccuccuagguucaagcgauucuccugucucagccuccugaguagcugggauuacaggcgcacgcugccaugccuggcuaauuuuuuguguuuuaguagagaugggguuucaccaucuugcucaggcuggucucgaacuccugagcacaggcaguccaccugccucggccucccaaaguguuaggauuacaggcgugagccaccacgcccagccccauuucuccuuuuuaaaaaguuuuauuucuaugcgucaauaacuuuuuuaaaggcauuacauuuuauuucuuuaacagagugugaccaaacauauuuguuuuuauuuuuuauuuuuuuauuuuuuggagauggaguuuugcucugucaccugggcuggagugcaguggcacuauacagcucauugcagccucaaucuguugggcucaagugauccuccugccuuagcccccugaguagcugggacuacagguuguaucaccacucuugacucauuuuugaauuuuuuuuguaaagaugggguuucaccauguugcccagcuuggucucaaacuccugggcucaagcaauuuguccaccuuugucugccaacauggugggacuacaggcaugagccacugugcccagcccauauuuguuaauuuaaggacauuauuaugucucuuuauaacauggugguaacauccucccuuggugagagcacauagaacauguuuggaacuaacugcuuuagaaaguuuuaucucauuacacccuccuaacaagcaugugagggaguauguuauuauccaaaguauagauaugagaauuuugugugucagagaggaaguaccugagugaugccccauuucagaauuuuagugucucgaggcuccaugcaagaccaccuucugccuucacaucacauauuauuaagccuggaaggcagucuucacugaagccaaugaugaacaacugaugaagggaacccagggcugggaaauaaguuaccaguaaaugucauggcauugaccacuaugaagucccuuguaucauauuauuccccuuuuaggcaucuuuaggcuugucuccuaugugcuguuuuuuuaagaaguucucugcuuacaaagucuugcguggauguauuuaauacuuuuguuuggaauacagguacacuuuucacacgugauaccugguuuucauguguaauccaaaaauaagagacaaugggaaaguuauguuccauaugcuguccuuucuugaggaccagcucacgugacuugugauaagcucucccaccuucucugaaccuuagcagugccucucaggaauaugcuaacuaagauaaauggagagaaaggaacauggguagcagccccuuaaaaucuagagguuuuaugauucuaacaucauaaugaagcagacuggggaauagaacucauuauuguagaauugaauguaggaggauuaagagauacagguugggccgggcgcgguggcucacgccaguaaucccagcauuuugggaggccgaggcggguggaucacgaggucaggagauagagaccauccugguuaacauggugaaaccccgucucuacuaaaaguacaaaaaaucagccgggcguguuggcuggcaccuguagucccagcuacuggggaggcugaggcaggagaauggugugaacccgggaggcggagcuugcagugagcagagaucacgccacugcacuccagccugggugacagagcaagacuccgucucagaaaaaaaaaaaaaaaaaaaaagagagauacaggauggacggacucacuaaucucuuuaguacccuucccuguacaggaauuucguguauuaauauuucugaaacugcuuugagagccaaucaagaaccuuagacuggucauuccugucuuaucagauccaaaugcagagaacuuggaggagguucaccuuucaagguuuuuguuuuuguuuuuuaagauagucuauuuacccauauuuuuauucuuauucuuuuuaaaauuucuaauguuucagcauuucuccuuuuaucauuuuuauccuaauaacuucuuuuggccauucuuucaagguaagucuacuggugacaaauuuuuaguguccuuuaucugagagcaucuugaugucaccuuuauuucugaagaauauuuucacugggaauagaauucuggauugguaguucuuuuucuuuuagcauuuggaaaagauugugcuacuuucuuuagguguccaugguuucugaugagaaauucacugucauuugaaucauuuccuuuauagguaauauuacauuucucucuaaccaguuucaagauuuuuguuuucuuuaguuuuaaguuuauuaugguauguaguggcauguguuucuuuaaguuuauucuguuugagguuuucucagcuucuucagccugugggcuuauguuuuucaacaaaugugggaaguucagcaauuauuuacucaaaugcauuuuagccccccacccuuucuccucuuuuucuaggacucugauuauacaaauuuucugucuuuuauugucucacagguucuuggggcucuguuuaucaggguguuuuuuuuuguaaugaugguuguucaaauggguuauuuucuauuuuuucaucuucagauucauuagugcuuuccugucauauuuauucuaucauucaguccaccuaaugaguuuuaacauuuuugauuacuguuuuucuguuauaaaauuuccaauugauucuuuuuuauaucuucugucuucuguuucuuugcuuucuauuuuaaaaauuuaaguguguuuguaauugcucuaugcagcauuuuuaugauggccguuuuaaaauccuucucagauaaucacaacaucuguucuauuugguguccggugguugucuuuuucucagucaaguugagauuauucugguucuugauauaaagugauuuuuuauuguacccuaaacauuuggguuauuauguugugagacuaugaauccuuuuuaauauauauauauauauauauuuuuuguaggcagccacccuguuuagguauaguaugcaguuccagaugggguuagauauguaguuccccacugggcucugcugacaucaccccagcaaaaguggaaugcccaguuguacugccuuacuucuccuugcugcugacagaugggaguguaaauucagcacuuuauugaguucuuuugacaccgggagaccaggaggagcaaaguguuagcuauaacuguuucaccaccaccuuauuccaccuucuugugccuuguugcuaccuggugagaguggaaguuuuacuccccaguggguccugccaacaccguggggagugggcaaugaaaaacugaaugcugacucguacuacuucacacugcuuuguuucacuuuuuuuggcugcugggugggaguggaaguaagcccuguucugagucccacugacaguaucccagacuguagagugacagcuagugcuguuucucacugcugucuucugccucuguugauggguggaaguagaaguucaguucccuguuuggcuucauggauaccaugcuaguggaggaagcaaagggaugacuucccaugacuuguugcugcuggguagggcugaaaguccagcuccucacucagcacuacuaauacuacggaugggauagggggcaguuuuucguuuggugugugacuggaauaggguauauuaccuauuacaguuuucuguucugcuaggccacccucuucccaguccuguggcuacaggaagcaggcuuuucuuggagcuuuugugugugugugugugugugugugugugccugugucuguuggcauuucuggguggcagacuucucaaggaccccaucagagauauaggggggcaaaaagaaagcccagggaacucaccauuauauuguuccucaaguggcaagguccuagcuacuucaccuucuucuuuccaucuuuuaggguuuuccuguguuguauuauagcuagaguuguuuguuuuuuuuaagaggaaagguugaugugaaaugugacuacuccuuggcuggaaccccuugcaugcucuuguaccuugggagcugaaugcuguugcacugcauuacuuuaauugagcccuuggugcuuucuuuugguucuuugaccuccucacagccaccucauucucacauuccucucaacaauuauuuuaaaccuuuucaucaauucuccacuuaaauccuauccucauucuucucagaugaucuuacuucuuauuuuacugaaaaacuugagaucauguuaugugcuuuucaucaaauuugagcacuuacaaauuacagucaucccucaguauacacagggaauugguuucgggacccccacauaugccaaaaucugcgcaaagucccacugugaguauuguggaaccugcuaauacgaaaaguggaccuuuuauauaugcaggcuuuaugucuuauuaauaguguauuuuuccauccauguuugguugaaaaaaaucugcauguuagugggccaacacaguucaaaucuacauuguucaagggacuacauuaucuguuuacccagucuucuaucuuugccuccuauuucagagaauuaaagugcuccuuccccagugcaaguaauucaguaccguaacauacaauaugggguuguaaccuuggagcgguaggcuacauguauagccuaggugugugguaggauauaucaucuagguuuguguaaguacauuuguuaugauguucacacaaggaugaaauugccucaugaugcauuucugagaauauauuccuguuauguauuccugcuguuaaacagcacgacuguuguuuugucaguuacugagaguugaagucccuggcuauaauuguagacuugccuauuucuccuuucaacucuaucuugugguuuaaggucaucuuguauaauauguacauauuuaggauuguuauguccucuuaguagauugauacuuuuaucauuauguaauauccuucuuuuucuguaguaauuuucuuugcucuaaugucuacuuugucugauauuacagccauucuuguguuucaacauuaauguuugcaugguauaucuucugccauccguuuacuccaaagguaccuacauuguugaauuuggaguaaguuucuuguaaauaacauauaguugcauuguuuuuuauuuacucuugcugaucucugucuuuuaauugggguuuuuaggccauuuacauuuaggguaauuauugauauuuuagggcuuaaaucuaccauuguauuacugguuuuguuuguuucuuguuucuuuuucuuuuuuucccuuccugugcauuacuugaaaaaauuuucuaccauuguauuacugguuuuguuuguuucuuguuucuuuuucuuuuuuucccuuccugugcauuacuugaaaaaauuuuaagaguccaucuuuuuauauauauauauauauaauauauauaauagauauaaaauauauaaauuauauauauaaaaauauauaauauauauaaaauagauauuauauauaaaauagauauauauaaaauagauauauauaaaauagauauauauaaaauagauauauauaauauauaauauauaaauauauauuauauauaaauauauaaauauguauauauauuuguauauaaauauguauaaauauauauuuguauauaaauauguauaaauauauauuauauauaaauauguauaauauauauuuauauauaaauauacauaaaauauauguauauauguguguguguauauacacacacacacacacacacaccuacaugaugucuuauuuuuuuuaaacaacaccuguacuccagauaaauauggucaaaauaaaugaaaaacucaagaugacauuauucccauuugucuaaaggccggguguuguguagaugauaagcaccugccauuuaugaugacaggugauagauccaaaguaauugccagauuuguuaauuuuuuuccauuucuaaaucauccauaaagaaaaucacauauagggucacaucauccuuacaguaguuuagcagagcaacugugccaucuagauugauguuuucaccaguaaaggacugguaguuuuugaaauuagcaaguaugugcuugauuuguucugcagcuucugccauaaaagguuuuacucuuucuggucuucauucuucaaguuugccuuugauugauuuaauguaaucuuucauauacaucuuguaggcuucuuuuaugaagccagcuugcugcaagugaugguucaugacaauaucaauaccagugauuacugugcuuucaguaccuucacccuuggguccuucaguagaggcauuuccaccaaugagcaagucaucaauauuacccuaugucuuacugaccaucuuccucucccccuccaggcacagccuguuugcaguaucucagaucuuguaauugucagagauaaucaugaugguggcuggagguagaugauagcagugcucgcuuauagcagaagccuggagcuuggagcaaguauggugcaguuggaaaggcacuccagggaauaggaagcauccagaaaaguauauuguguuuuugaguguauugccucuuacaguuuuccuagugguugguuuggguauuacaauauacauauguggcuuauuacauucuagugaugucagcauuucaccauuuugagugaaguauagaaaccucacuuccuuugagguuccuuuauucuccccacuuuuaaauaucauugucuugaguaucagauggugguguaauuuugguuuggaucaucauauaugauuagaaaacucaugaugagaaggauagucugugguauuagucauauuucuguuuuuuuccauuguuauuucuuccuuccugaugcuccaagacuccuuuaaaaaauuauuuucuuuuuguuugaaguacuuccuuuagccacucuuuaagauugugucuagugacaaauuccuuucguuuucccuuauuugagaacaucuugauuucacuuucauuacugauggauaguuuuacuggacauagaauuuguggugguugagaguuauuuucuuuuaaaaguugaaaaaugugcuacuuccuucggucuccauaauuucauaugauaaacguuuaucauacaagguaguauuucuuauagguaguguuuuauuucucugugguugcuuucaagauuuuuucuuugucuuuaguuuucccaaacaucuuuuuucauuccuuuccuuuuuuuuuuuuuuuuuaagauuuuuuucuauuugggguuugcacaucuucuuuaaucuucuucaaaauuugggaacuuuucaaccauuauuuucuuaaacuuuuuuuuauuaaauuucucuagauuuagggagaacaagugcaguuuuguuacacagguauauuguuuaauggugaagucugggcuuuuaguguaauuuugaacaguguacauuguacucauuaaguaauuucucauaccccaccccuuucccacccucccaccuuuucgaaucuucagugacuuuuauucgacauucuguguccauaugcacauuuuauuuagcuccuacuuauaagugagaaaaugcaguauugggcuuucugauuuugaguuguuucacuuaagauaauggcuuccgauuccauccauguugcugcaaaagauaugauuuuauucuuuuuuauugcugaauauucuguuguaugcauguguguguacauauguauguauguguauauguguacucacacacauacauacacaccaccguuucuuuacucacucaucuguagucacuauuuuaaaauacuccuuuagccccauuauuuuuuuccuuuucuucugagacucugaaaguuggaucuuuuguuauugucucacagguccuugaggcucucuguucuuuuuuuuuuuuuuuuuuuugucuguuuucucucugaucaggcugagcagauuguauugaucuguucugaaguucacugauuuugucuucugucauuucugucauuucaauuuaucccauccaguuuuaagauuucgguuauuguacuuuguaguucuguaacuuucaugugauucuuuuuaauaacuuuuuucuuugcugaaauuucuuuuuauuuaccuuagagaaauuauaauuguuuguugaagcauuuuaugaccauugcuugaaaguucuugucagauaauuaugugauucauugugguguugauugcaguuucucguugaaguugugguuuuccugguacuuuguaugacaagugauuuuuaauuuuaucuuggacauuuuggauacuauuuuaauagauucuggguccuacugaaaauuuuauuuuagcaggcagucaccuuguuuagguuuaaacagagguccuggacuacuuuuugaacugugguuuuaacgacaaucuaauuuucagaaacuuuucaguuauauuuugaucugcuugaguuguugcgugcugcugggccuccaguggucccugcugaugguguuugagggaaugaaaggaacuuuucaaggcugaacugccuggugcuucuaaguaugggaauggagacccuggucuaugggaugaagcuucuugagcugggugcuaguuguggcaggaucucuccuuuccuaugaccgaugcagaauaccuccagaaccaucccuuguuauggugggaucccccuacuuaugggugucagaguguauuuacuggaccagcugcuuguggugugguuuuccuuuguuggugccuguggccucguuggugucucagguggugcugcugcugaggauggugaaugcuuccccuggcugcuuauugacagggagguuuccaguugaaccuucuugcuguuucuucuggccucacauggugguguugauggcaauccuauuaaauucaagagaagaaugaaucuaccugggcugcuuucuguugcaggcuuaggaguugggaaacaucagaucuggcucacuuauuuuuuuuuuuuuuucaguugggaggguuauaagacaaccuguuacuauguuguuccucuaguccuggggucuucaacuaguuuuucuuccuuuuuuaaaccuuucaguguuuuccuuugguuauauuuuaugguauuuucagguuuuauaauuguacuuaauggagaggaacaggaagagaccaaaagcccuuuugcucauuuuuuaauugcaauggguggaacuuauuuggaucuggauuuaaauaaacuaaaaaaguaaacuaauuugauaugagauuacucaaauuuugaaagcuagguauuuuguauaaaaguauuuuuccuauaaugauaugauuguguaaaaauaaaagacugucucuuagagauauguacuaagauauuuauaggugaaauuaugaaauacauaggauuugccucaaagauaauauauaugcguuuguucauaggguaagaguggucauuggcugaugguuguuagggcuaggggaugaauaugugggacucagaauaccuuuguguauguaaaaaauucuccauguuuuuaaauuaaauuuaauuaauuuauuuuuugcaucccccugauuucugaaguuuuuuuuuaaguuuagcuuauauuucuugaacaaaguuuagauauuaugguagaaagaaacuugccugauuuauuuucuuuguaccuaauuuuugaguauuggugaggcuaacauaauauaggcuaccaaguucuaacacguuuucuuauaaggugaggaaauauuaaaguguuuauaguguguacauccccucugaucgguacuuuaggagccccaggaaccauuugguugcuuguaauuagaaugaaagugcuuuuacccuguaagagaguuaaugugcuuucuuuaaguaagcucuuuucuagucaccaggaucugaaguuccagaguugacucuucuauagauuggcguauuaauacauuggacauuuauucauucuuacuuucuuucacagcuuucuguucaaaaucaggaguuugagauaaauaaagauggaauccccaaaguggaucaguuucaucugguaugugaccuuuuugacauuuacugguuugaaacacaugcaguaauauaaacuuagauaucugacugaaaguuguccuccaguuuuucuaagaauccaaauuaacauuugcaauaaaugaaguauugaaaaaaauucaggugcccuacuuaacaccacuuaauuaauacaccaggguuacucugcuggguuguuugucacacagauuauauaaauaaucuaacaauuagggaagaauauuguuuacuauguguuucaagaucauauuauaguaaaauaauguuuuauuauaacuuaguuuuuuguaaguaccuaacuauaucuuugucauucacauauguauucagccaacauauuuugaguagcuauuucugugauaggaauugaaccaggugcuaggauuacaaggauuguggcauugagaaugaaaugaauaauuuagaaaugugaacaaguaagugauuaacaucuauaaguugaguaauuagcaaguacuuuggggguacuccauuuacccugauuugauuauuacacaucauaugcuuguauuaaaauaucucauguacuucauaaguaugcccauaaagauuuaaaaauaaugaagccccuaaaaaaaguacuuggggggaagcugauuuuuaguucugcaaagaaagggggaauucaguaugacuagauauaaagaggauaaauauggcaguaaaugagucuauaagaguauaaugaucagacucuggaaguucuuagcuauuuugaguuaagauuacaaugaaagaguacauauaauuuuguuaaacucaguaguuccuuauuugaccacacaaauauuguauaauaccuucuaaugucccacgaaaucauuuuaaaaaaacauaccuuagaaaugauauuaaggagcuuugccacacuucuuggguagcaguaaaaagcauuucagacaacuuuugugagauuauaaaacuuuguguuacacuuccugauuaucucuguggaaggggauaacaaagaagguugacuaugguuuacaguuuugaaaaggcuaugauaaaaauuuauugcuauuagauagaaaaauaccagaaauucuguauuagagguuacaacuucaccaaaagugcacauccagaacccuugcuuucagguuugauagaaaaauuaccuuguaccaaguuauccugaaauuuaguuuaaacuuaaaacuuauauuacaguuucgugagucaggaaucuggacacagcuuauuugggauuucugcuucaguuaauuuaagguugcaguuaagauguuggcugggcuacagucaucuuaaagcucgauuggagaugaauaugccucuaaccucacauguuuguucauaggauucuguuucuuucaguuuauuagaaugaggaccucaguuguucucuaguuguuggccagagguugcccucaauccuuugcccuguuuccaucauggcagcguguuucauugaaauguauacgcagagaaggcaguagacucuguucacuaagacagaagucacaguuuuucauagcaaaaucauauaagugauaucccauaguuuuugauaguauucucucuaaagcaauucucuagguccaagaggaaagaauuauguaaaguuaugaauaacagaagguuggggucuuggggcaaucuuagaagucugcuuacucuaaaauguaaucuggccaggcaugguggcucacgccuguaaucccagcacuuugggaggccgaggugggcagaucaacugaggucagaaguucaggaccagccugcccaacauggugaaacccugucuguacuaaaaauacaaaaaaauuagcuggaugugcuggcgggugccuguagucccagcuacuugggaaucugaggcaggagaaucacuugaaccugggaggcagagguugcagugagccgagauugugccauugcacuccagccugggcgacagaacaagacuuugucucaaaaaaaaaaaaauaauaauaauaaucugccuguaaucugcaaguaaucaugccuugcuaggcaugcagcuagguauauguauaaugaaaguaaauguaaauacacaguccccguuuaauguggguagcuacucauggauucaaggauuguggcauugaaaaugagauuaauaauuuagaaauuugaacaaguaagcaagauuuauaaauugaguaauaagcaaguucaaauuauaaaaaucuuggcuuguauaguauuugcuucugugaucugagucaguuauuagugcugggaauggaauuaccuuuaccuacauuuuguguucacacauagcugcaaaacaagucaaggcucuguagucagcaccuuacagauaccauaccacaaauggagaagaauauaaauguauggaaccauguaguugagagaguuauuagaggauaauuaauacacccuucucauccuucagaaucccuccaauaauauccccaagagauggccuucagccucugcuuaaguagaguaaugcugauuuugguaguuugugucuaaaaguugguccauuccauuuaaguuaucuagcuuguuggcauacaguuguacauauuuucuuuauaauuauuuuuauuucucuaaguucaguaguguccccuuuuucauuucagauucuggcaguuucagucuucucucuuuuuuuucuucguuaguccaaauaaguuuaaauaccuagcuuuugguuuuauuaauuuuucuguauuguuuuucuguugucuauuuucuuacuuucuaaucuuuauuauuucuauccuucugcuugcuuuagauuuaguuuacaacauauauuacacaguuaucacaccuuauaaaauuaacaaauuguaauauuauauuuaaauuucccuaauugucuuaaauauauuuuuaaaugguugcuuuuuugaaauuagcauaucaacaagaucuaccuguauuggguuaauauaucucuuaaucucuguugagcuauaaaguucccccacaacucuuuuucuccaugccauguauuaugugaaaaaaaugauuucauuuuccauacuuuggaguuggcugauugcauccuuaugguauuauuucauaguucucuuuuccccaguugaaaaaagugguagauacagagguuaauuaaauuuacauucaguuuuuacaggcaguauauuuuauauuauugugucauaugagggggaucauuugguguuugauugucacaguaagauugaucaguguguucaggcagaaaauuuuguauguacagggguauauuuuuaguuuuucuaucccauugguuuguuuauucauaucccagugccucacucauuuaacuaaaauagacuuuauaguagcuuuuuaauacuuauagggcuaguuccuucuucacugcuuuuuuguuuuguuaaaaaaaaaaacaacaaaaagcaacaaaaaaauaaaguccgaagucccagguuggagugcaguggcacgaucucagcucacugcagccucugccucccagguucaagugauucucgugccucagccucccgaguagcugguacuacagucacaugccaccacaccuggcuaauuuuuguauuuuuaguagagaugggguuuugccauuuuggccagguuggucuugaacucuugaccucaagugauccaccugccucagccucccaaaguucugggauuacaggugugagccacugcuggcccucauugcuauuuuuaaaaucagcuuucauggcuauucuugguugucauucuucuaagacaucuuuauaauuaacuuguuuggucucaaggaaaaaaauuauauuuuuauuggauuaauauaaacuuuuuaagucaacuuagggaaaauugucccauuuguuaugagagucauuuuuguugaagaccauaauaagacuuuuguuccugaucuacuuuugugguuuucaggagcauguguuauuuuuucucauuuggauuuuguaauauuuaauuguuugcaccuagggaagguaacuaucuuuaaauguucuuaaaaacauauucuguagaguacagacauuggcauucauucauuuaucaaauauuuacugaaugucugcuauauucagauacuguuuuuugcuacuuucuggagaugaagugacaaacuaaaauuucaaaucuuaaggaucuuagaguguaaugcagacacuagcaguaaacagaugauuucuuuccuuuuuuuuuuuuuuugagacagucuugcuugguugccaaggcugaagugcaggggcacgaucucagccacugcaaccucugccucccagguucaagcgauucuccugccucagcagcuugaguagcugggauuacuggcaugcgccaccaugcccagcuaauuuuuguauuuuugguugagacagaguuuugccauguuggccaggcugaucuuaaacuccuggccucaaugauccacuugccuuggccucccaaagugccugccugaccagcaguuaaacagauuauuuuuauucagucugauaugugcuuugguuggaguaaucauaagaggcaaauaaaagguauacuaaggugucaaauaauggaauagcaacauuacaggaucauuuacauguucuaauacaaauaauguccuuugaaauggagggauauaauaaauucuagcucccauaaugauggugauaaugauagcagcaguagaggugauccuagagagugaucacuuaaaaaccaaaaccagaaauaguugacuagaugaagaaauuuacccuuccagacagagaagcuucagugugacauuuuaauagugucaaauucugaccaguaccuuguuaaaagagggagaaggaaguaauaaaauuuauuuguucguauuucacuuguuuuugagagauuucagcuaugauuuuuuuccuuuuacacuuuuuccccauaauucaauuccauuguuucaguauuggaggcauuccauuucaccaaaaaguacagucgucccucuguauacacaggggauugguacagauaaaaucuacgcauacccaaguccuacaguuggcccaguggaaccuaugcauaugaaaaaucagcccuuuguaucuguggguguugaguccugagaauacuguguuuuugaucuguuugguugcagauguggaaacugcagauagggagugcugacuguacuuacuuauuucauauugauacauaauauuuguacauauuuaugggguauaugugauauuuuguaacuuguauggaauguguuaaugacagucgguauuuaggguauccauuaucuuauuuauuauuucuauguuuugggaacauaucaaguccucucuucuggcuauuuugaaauauuuaauacauuguuaacuggagucauccuacucugcuaucaaucacuaguacuuauuucuucugucaaccugguuguuuguacccauuaaacaacucucuucacccccuuccaccucacccacauucucuuagucucugguaucugucauucaacucuaccucuaugagaucaacuguuauagcuccgacauaugagugagaacauuugauauuugucuuucugugccuggcuuauuucacuuuacagaaugacuguuccauccuuguugcugaaaaugacagaauuuaauuccuuuuuuaugguugaacaguauuccacauuuucuuuauauuucuuuaauaguguuccacauugucuuuuuccauuuguccauugauggacgcuuagguuggaguccuuaccuuuguaauugugaauagugcugcaguaaacaugggggugcagguuucauauacugauuuccuuuuuauuuugaugaauaucaaauauuuugacacuuagguugaguccuuaccuuuguaauugugaauagugcugcaauaaacauggggaugcagguuucauauacugauuuccuuuuuauuuugauaacuaucaaguagugggauuacuggauuguaugauaguuccauuuuuaguuuuuuggaaaauauuuguacuauuuuccauaguggcuauacuaauuuacauuuccacuaacaauguauaacaguuuccuguucuccacaucuuuguggagauuuuucaaaauaguauuuggcuauuuuuugucauuuuuuaaaauaguggcauucuagcugauguaaaaugauacuucauugugguuuugauuugcauuucucugaugauuagugauguugagcauuuuucauauacuuauuggucauuuguaugccuucuuuugagaaaugucuauuuauguccuuugcccacuuuuuaauggaauuguuuucccugucgaguuucuuguauauucuggauauuaguccuguguuggaugaauaguuugcaaauuuuuccuucaauucaacaaauugucucuuacacucuguugauuauuuccuuugcugugcagaagcauuuuaguuaaguauagucccauuugucucuuuuuguuuuuguugccugugcuuuugaggucuuagccauaaaaaucuuugccuaggccaaugucaugaaguguuucccuuauguuuucuucuaguauuuuuauagucuuggguuuuacauuuaagucuuuaaucaaucuugaauugauuuuuauauauggugagaggugagggucuacucuuacucuuuugcguauggcuauccaguuuucccagcaccauuuauugaagugggugucuuuuccccaguauauguucuuggugccuuugugggaaauugguuggcuguuuauuucugggguuucaauucuauucuauaggugcauauaucuauuucuauacuaauaaaacgcuguguugguuacuauagccuuguaagauauuuugaagucagugugaugccuccaccuuuguucuuuuugcugauaacuguuuugacuauuugugcucuuuuuuaguucuacaugaaauuuaggauuuuuuucuauuuaugugaaaaauuacauugcuauuuugauagggauugcuuugaaucuguagauuucuuuggguaguaugggcauuuuaacaauacuaaucuucugauccaggagcauggagugucuuuccauuuguuaguguccuuuucaguuucuuucaucaguguuuuguagcuuucuuuguagauaucuuccaccucucuguuuaaauuucuuccuagguaauauauuuauuuuguagcuguuguaaaugggauuacuuucuugaugucuuucuuagcuaguucauuauugguuuauagaaaugcuacugauuuuuacauguugauucuauauccugcgauuuacuauauuaaucagaucuaaaagcuuuuugguggagucuuuagguuuuucuagauagaagauuaugucaucugcaaagagggacaguuugacuuuuucuuuuucuuuuuuuauuauuauuauacuuuaaguuuuaggauacaugugcacaacgugcagguuuguuacauauguacacaugugccauguuggugugcugcacccauuaacucgucauuuagcauuagguguaucuccuaaugcugucccucccaccaccccacaacaguccccgguaugugauguuccccuuccuguguccauguguucucauuguucaguucccaccugugagugagaauaugugguguucgguuuuuuguccuugcgauaguuugcugagaaugaugguuuccagcuucauccaugucccuacaaaggacaugaacucauccuuuuuuauggcugcauaguauuccaugguguauaugugccacauuuucuuaauccagccuaucauuguuggacauuuggguugguuucaagucuuugcuauugugaauagugccgcaauaaacguaugugugcaugugucuuuauagcagcaugauuuauaaucauuuggguauauacccaguaaugggauggcugggucaaaugguauuucuaguucuagaucccugaggaauugccacaccgacuuccacaaugguugaacuaguuuacagucccaccaacaguguaaaaguguuccuguuucuccacaucaucuccagcaccuguuguuuccugacuuuuuaaugaucaccauucuaacuggugugagaugguaucucauugugguuuugauuugcauuucucugauggccagugaugaugagcauuuuuucauguguuuuuuggcugcauaaaugucuucuuuugagaagugucuguucauauccuucauccacuuuuugaugggguuguuuguuuuuuucuuguaaauuuguuugaguucauuguagauucuggauauuagcccuuugucagaugaguagguugcaaaaauuuucucccauuuuguagguugcuuguucacucugauggugguuucuuuugcugugcagaagcucuuuaguuuaauuagaucccauuugucaauuuugacuuuuguugccauugcuuuugguguuuuagacaugaaguccuuguccaugccuauguccugaaugguauugccuaguuauucuucuaggguuuuuauaguuuuaggucuaacauguaagucuuuaauccaucuugaauuaauuuuuguauaagguguaaggaagggauccaguuucagcuuucuauauacggcuagccaguggucccagcaccauuuauuaaauagggaauccuuuccccauugcuuguuuuugucagguuugucaaagaucagguaguuguaggugugugguauuauuucugaggccucuguucuguuccauuggucuaugucucuguuuugguaccaguaucaugcuauuuugguuacuguagccuuguaguauaguuugaagucagguagcgugaugccuccagcuuuguucuuuuggcuuaggauugacuuggcaaugcgggcucuuuguugguuccauaugaacuuuaaaguaguuuuuuccaauucugugaagaaagucauugguagcucgauggggauggcauugaaucuauaaauuaccuugggcaguauggccauuuucucgauauugauucuuccuacccaugagcauggaauguucuuccauuucuuuguauccucuuuuacuucauugagcagugguuuguaguucuccuuggagagguccuucacaucccuuguaaguuggauucuuagguauuuuauucucuuugaagcaauugugaaugggaguucacugaugauuugacucucuguuuguuuguuauugguguauaagaaugcuugugauuuuugcacauugauuuuguauccugagacuuugcugaaguugcuuaucagcuuaaggagauuuugggcugagaugaugggguuuucuagauauacaaucaugucaucugcaaacagggacaauuggacuuccucuuuuccuaauugaaugcccuuucuuccuucuccugccugauugcccuggccagaacuuccaacacuauguugaauaggaguggugagagagggcaucccugucuugugccaguuuucaaagggaaugcuuccaguuuuuguacauucaguaugauauuggcuguggguuugucauagauaccucuuauuauuuuaagauacaucccaucaauaccuaauuuauugagagucuuuagcaugaagcguuguugaauuuugucaaaggccuuuucugcaucuauugagauaaucaugugguuuuugucuuugguucuguuuauaugcuggauuacguuuauugauuuucauauguugaaccagccuugcaucccagggaugaagcccacuugaucaugguggguaagcuuuuugauguguugcuggauucgguuugccaguauuuuauugaggauuuuugcaucaauguucaucaagaauauuggucuaaaauugucuuuuuugguugugucucugcccggcuuugguaucaggaugaugcuggccucauaaaaugaguuagggaggauucccucuuuuucuauugauuggaauaguuucagaaggaaugguaccagcuccuccuuuuaccucugguagaauuuagcugugaauccaucugguccuggacuuuuuuugguugguaagcuguuaauuauugccucaauuucagagccuguuauuggucuauucagagauucaacuucuuccuggcuuagucuugggaguguguaugugucgaggaauucaaccauuucuucuagauuuucuaguuuauuugcguagagguguuuauaguauucucugaugguaguuuguauuucugugggaucacuggugauauccccuuugucauuuuuuauugcaucuauuugauucuucucucuuuucuucuuuauuagucuugcuagcaguuuaucaauuuuguugaucuuuucaaaaaaccagcuccuggauucauugauuuuuugaaggguuuuuugugucuauauguacuucaguucugcucuaaucuuaguuauuucuugccuucugcuagcuuuugaagguguuugcucuugcuccucuaguucuuuuaauugugauguuagggugucaauuuuagaucuuuccugcuuucucuuaugggcauuuagugcuauacauuucccucuacacacugcuuugaaugugucccagagauucugguauguugugucuuuguucucguugguuucaaagaacaucuuuauuucugccuucauuucguuaugugcucaguagucauucaggagcagguuguucaguuuccauguaguugagugguuuugagugaguuucuuaauccugaguucuaguucauugcacuguggucugagagacaguuuguuauaauuuauguucuuuuacauuugcugaggagagcuuuacuuccaaguauguggucaauuuuggaauaggugugguguggugcugaaaagaauguauauucuguugauuugggguggagaguucuguagaugucuauuagguccucuuggugcagagcugaguucaauuccuggauauccuuguuaacuuucugucuuguuggucugccuaauguugacagugggguguuaaagucucccauuauuauugugugggagccuaagucucuuuguaggucacucaggacuugcuuuaugaaucuggguccuccuguauugggugcauauauauuuaggauaguuaguucuucuuguugaauugaucccuuuaacauuauguaauggccuucuuugucucuuuugaucuuuguugguuuaaagucuguuuuaucugagacuaggauugcaaccccugccuuuuuuuguuuuccauuugcuuggcagaucuuccuccaucccuuuauuuugagccuaugugugucucugcacgugagauggguuuccugaauacagcacacugaugggucuugacucuuuauccaguuugccagucugugccuuuuaauugaagcauuuagcccauuuacauuuaagauuaauauuguuaugugugaauuugauccugucauuaugauguuagcugguuauuuugcuuguuaguugaugcaguuucuuccuagccuugauggucuuuacaauuuggcauguuuuugcaguggcugguaccuguuguuccauguuuagugcuuccuucacgagcucuuuuagggcaggucugguggugacaaaaucucucagcauuugcuugucuguaaaguauuuuauuucuccuucauuuaugaagcuuaguuuggcuggauaugaaauucuggguugaaaauucuuuucuuuaagaauguugaauauuggcccccacucucuucuggcuuguagaguuucugcugagagauucacuguuagucugaugggcuucccuuuguggguuacccgaccuuucuaaacucuggcugccguuaacauuuuuuccuucauuucaacuuuggugaaucugacaauuaugugucuuggaguugcucuucuugaggaguaucuuuguggcauucucuguauuuccugaauuugaauguuggccugccuugcuagguuggggaaguucuccuggauaauaugcugaagaguguuuuccaacuugguuccauucucuucgucacuuugagguacaccaauuagacguagauuuggucuuuucacguagucccauauuucuuggaggcuuuguucauuucuuuuuauucuuuuuucucuaaacuucucuucacacuucauuucauucauuucaucuuccgucacugauacccuuucuuccaguugaucgcgucgguuacugagucuugugcauucgucauguauuucucgugccaugguuuucagcuccaugagguccuuuaaggacuucucugcauugguuauucuaguuauccauuugucuuauuuuuuucaaaguuuuuaacuucuuugccauugguucgaacuuccuccuuuagcuuggaguaguuugaucuucugaagccuuccucucucaacucgucaaagucauucucuguccagcuuuguucaguugcuggugaggagcugcguuccuuugucggaggagaggcucugauuuuuagaguuuccgguuuuucugcucuguuuuuuccccaucuuugugguuuuaucuaccuuuggucuuugaugauggugacguacagauggguuuuugguguggauguccuuucuguuuguuaguuuuccuucuaacagucaggacccucugcugcaggucuguuguaguuuacuggagguccacuccagacccuguuugucuagguaucagcagugguggcugcagaacaguggauacuggugaaccacaaaugcugcugccugaucguuccucugggaguuuugucucagaggaguacccggcugugugaggugucaguccacccguacuggggggugccucccaguuaggcuacucgggagucagggacccacuugaggaggcagucugccuguucucagaucuccagcugugugcugggagaaccacuacucucuucaaagcugucagacagggacacuuaagucugcagagguuauugcugucuuuuguuugucugugcccugcccccagagguggagccuacagaggcagggaggccucuuugagcuguggugggcuccacccaguuugagcuucccagccacuuuguuuaccuacucaagccugagcaauggcaggcaccccucccccagccucgcugccgccuugcaguuugaucugagauugcugugcuagcaaugagcgaggcuccuugggcguaggaccuuccgagccaugugccggauauaaucuccuggugugccguuuguuaagcccauuggaaaagcgcaguauuagggugggagugacccgauuuuccaggugccaucugucgccccuuucuuugacuaggaaagggaauucccugaccccuugcgcuucccgggugaggcgaugccucgcccugcuucagcucacgcauggugcgcugcacccacuguccugcacccacuguccggcacuccccagugagaugaacccguuaccucaguuggaaaugcagaaaucacccgucuucugcgucgcucacgcugggagcuguagacuggagcuguuccuauucggccaucuuggcuccacccccugacuuguucuuuuucaauuuggauuccuuuuauuuuucuugccugauuguucugacuaggacuuccaggacuguguugaagagaaguggugaaaguggagauccuugucuuguuccaguucuuuagaggaauguuuuucuuuuucuuucuuuuuuuuuguuuuucuuuuuuuuugagauggaguuucguucguguugcccagcuggagugcaguggcgugaucucagcgcgcugcaaccuccaccuccuggguucaagcaguucucuugccucagccuugccaaguagcugggauuacaggcgcccgccaugaugcccagcaaauuuuuuuuuuuuuuguauuuuuuaguagagacgagguuucacuguguuggucaggcugaucuugaacuccugaccucacgugaugugcccaccucggccucccaaagugaugggauuacaggcgugagccacugugucucacuagaggauugcuuuucuuuuccccauuuaguaaugauguuagcuguggcuuuguuacagauaggcuuuauuuuguugagguguguuacuuauauaccuaguuuguugagagcuuuuaucauaaagggauguuuuaaucuaugaaauacuuuuucugugucuauugagaucguuugccauaugguuuuugcucuuuguucaguugaugugauggaucaugucgcugauuuggguguguugaaccauccuagcaucccugggauaaaugcuaauuaaucaugguguauuauguuuuugaugugcuguuggauucggauugguaguauuuuguugaaaaauuuugcaucuguguucaucagggauacuggucuauaguuuuuuguuguuguuguguccuugucugguuuugguaucaagguaauggugggcugggccuuguagaacaaguuagggagaauucucgccucuugaaccuuugcaguaguuugaggauaauugauguuaguucuuugaaaguucaguagaauucagcagugaagcucugugguccuggacuuuucuauguugggagacuuucucuuacugaccaaaucccguuacuuguuacuggucuguucauguuuucuauuucuuacugauucaaaccugguagguuguauguguccaggaauuuauauauuuccucuagguuuuccaguuguucauguauaguuauucauaauagucuuuauguuuuguauuuuuuuguuuguuuguuuugagacagagucucccucuguugcccaggcuggaguacaguggugcaaucuuggcucacugcaagcuccgccucccggguucaugccauucuccugccucagccuuccacguagcugggacuacaggcgcccgccacaacgccuagcuaauuuuauguuuuguauuuuugugauaucaggcauagugucuucuuuuucauuucugauuguguuuauugcagcuuuuuuaaaguuuuaguacagcuagcaguuuauugauuuuguuuaucuuuuaaaaaaauuuuuuuuguggauccuuuguauuuuuuuuaguguauuucacuuaguucugcucccaucguuauucuucguuuucuacuaauauguaucagguuguuuauuuguaaucuuacuccuuuuuugauagaagaauuuauugcuauaaacuucucuuuucucacugcuuuugcuauaucucaucaguuuuguuauguugcuuugauuuucaauuguucuaagacauuuucuuauucccucuuuaacuucuuccuugaaccagugauugcucgaagacauuuucuaauucccucuuuaauuucuuccuugacccaguggucauucagcagcacguuguuuaauuuccauguuguguguguguguguguguguguguguguguguguguuguuuuugagcugggggucucacucuguugcccaggcuggagugcaguggugugaucucaucucacugcaacuucugccucauggguacaagcaauucuccugccucagccucuugaguagcugagauuauaggugucugccaccacacucaucuaauguuuguauuuuuaguagagacgagguuucaccaugucagccaggcuggucucaaacuccugaccuuaagugauccaccugccuccaccucccaaagagcugggauuauaggcaugagccaccgugccuggccaauuuccaugcguuuguauaguuuucaguuucucuuguugauuuuuaguuuuccauuguggucugagaugauacuggauaugauuuuaauuuuaaaacauuuuuugagcuuuguuuuguggcuuaagauauggucguuuccuauagaauguuccauaugcuuaugagaaguauguguauucuguugcuguuggguaaaguguucuguaaauaucuguuagguuaauuugguuuuuaagugcaguguaaaaucaguuuuuuuaaaauuaauuuucucucuagauuaucugucuaguggugagaguuggguggagucuguuucucccuuuagaucuaauaauauuugauuuauauaucugggugcucuguuguuggauccauguauauguuuagaauuguuacauucucuugcugaauugaucccuuuauuauuauauaaugaccuucuuugucacuuuuugcucuuuuugacuuaaagucugucuuaccugauacaaguauaguuacaccugcuugcuuuugguuuccuuuuguauggaacaucuuuucccaucuuuuugcagcauacaauugggucauuuaaaaaaaagaaaaacuccuuucaaccagucuauaucuuuuagguggaaaguuuaacugguuuacauucaaggcugucauugauacaugcaugaggguuaauuucugucauuguauuaauugauucugguuguuuuguguaucuuuuguuucuuauuuucucucuuauucauugugguuuggugguuuucugucgugguaacacuugaauuauuucuuuuauuuguguguuuguuuuaccaguggaguuuauauguguuuuguaaugguagauauuguucuuucacuuccaaguauacaacucucuuaguagagacgggguuucacuguguuggccaggcuagucuugaacuccugaccgcaggugaccucaggugauuccccccaccacggccucccaaagugcugggauuacaggcauaagccacugugcccagccagaugaucuauuugcagugugauuaucggcucauuauuuugguguuuuuuuuuguugaggggaguaccagauaccucgucagucaucuugaaaccccuccuuccugacuguauuuauugaaaaaauaaguccacuuccuucuucauuacagauuuguccuuuuguuccuuuguuuuguaacaccuguuuuuccuugcaggaugauaaagucaaaucccuccucuguagcuugauauguuauagaaguucaaugacugcugaacaaguuuuaaaugcugaauguuucuugaugccaaaggagcaaucaguuccaaacccagaaaaagauacugaauacacccuauauaaaaaggaagaagaaauaaagacggagaacuuggauaaauguauggagaagacaagaaauggugaagccaacuuugauuguuaaauuauuauuguuguuguugcagagguucuuuuuaaaaacuuugguuugguuaauacacagaaauaucuagaaauguucugggacuaguugaguuguaucuuuaguauucagguugugaaaaauaaagauguuuggcuaugca

SEQ ID NO: 191614 - RNA, 89673 nt, Homo sapiens
ggaagagaccgccccgugggcggaagugacgcaaggccuacugucggcugggaggggagguguagccggucuuuggggguaggcgguaguggcggaagagguucggcggcugauggcggaucaggaucggaagccugcguaacuuucucccuugauccgggagucuuuccacuggguaaggcgccuccccgguccaccccagcgccuugugcggggcggccuccagcugcaucucuuuuagggcucgugcuacacccuucagccccuguacuguaggggccuggccggucucgggagaggucucuguggugacgaggcuuuccuucccgaagacaaaccuuccuuuccagacugcgauugugacgggggugugggcgacucggaucagcuguggaguuuuggaauggcaacggguggccgccccacgcggugggaggcccgugggacaggccuucgcgauuugggggaggcgugugggacgggggcccuuuggcuggggacgagugacgcuggcgacccccgaaggaaaagcuucugguguccaaggcuaaacucuggggugacuguuuugagggcaguguggguuuuaccggcgcaguaagcugagaaaacacguaggucgcguccgagaaggacgcugggguuugccuuugcggagagaaacccagcuguuuugguuugagucgccgguggcgaagggggcggagacucccugcgccgccuacuuuugagggccgcgggcggaguuggcgguucuggcugauggccugcuucaccuggaauccauuccccaccccgccccguucgcaagguguggacuagucccgaccgacuugcacuccuggcuuagggaaucuguggcuagaguuuagcgugcgcgcgcgcgcguacaccuuauuaguaaaaaauugagcuuagcgugcgucuguguggguguguguacacaccuuauugguaaaaguuuuguuagaaaacacuggcauuugacuuuagacauacacaguguuagauuuccgguuucacacagugguuaugaauugcuauuauguuaggcuuuagaugggaaaauaaaucuugauuuuucagcugucugcauucugcuaauguuaaaauuucuacgagcugugcacgaacaauuaauaguuacaaguuuggugcucaauuccuaaaggauuuaaagagaucauuugaauagaaacuaaaagugggucgaucguccucaaagugcuuuucggguuuagggaaggagcuuaggacagccuuucucuuucguucuguuccuuucaaggguaaacuugaaggauuguuugaugaugccgacuucuaauaagguuuuauuuauuuuucaaacugauuguucaacuucaaagaacauuguaguuuuuguuuucuagucaucacguucuuuuuuuuuuuuuuuccuugagauggagucuugcucugucucccaggcuggagugcaguggcgcgaucgcggcucauugcaaccuccgccucccagguucaagcgauucuccugccucagccuccugaguaccugggauuacaggcgcgcaccaccacacugaagggguggguugccccuccacaccuguggguguuucucguuagguggaaugagagacuuggaaaagaaaaagacacaaaguacagagaaagaaauaaggggauccggggaaccagcguucagcauauggaggaucccgccagccucugaguucccuuaguauuuauugaucauuuguggguguuucuccgagagggggcuaugucagggucacaagacaauaguggggagagggucagcagacaaacacgugaacaaaggucuuugcaucauagacaagguaaagaaucaagugcugugcuuuuagauaugcauacacauaaacaucucaaugcuuuacaaagcaguauugcugcccacaugucccaccuccagcccuaaggcgguuuuucccuaucucaguagauggaacguacaaucggguuuuauacugagacauuccaugcccagggacgggcaggagacagaugccuuccucuugucucaacugcaagaggcaugccuuccucuuauacuaauccuccucagcacagacccuuuacggaugucgggcugggggauggucaggucuuucccuucccacgaggccauauuucagacuaucacauggggagaaaccuuggacaauaccuggcuuuccuaggcagaggucccugcaggcuuccacaguuuuugugucccuggguacuugagauuagggaguggugaugacucuuaaggagcaugcugccuucaagcaucuguuuaacagagcacaucuugcacaacccuuaauccguuuaaccgugaguuugacacagcacauguuucagagagcacgggguuggugguaaggucauagauuaacagaaucucaaggcagaauaauuuuucuuaguacagaacaaaauggagucuccuaugucuacuucuuucuacacagacacaguaacagucugaucucucuugcuuuuccccacacauacccggcaaauuuuuguauuuuuaguagagacgagguuucuccauguuggucaggcuagugucgaacuccugaccucuugauccgccugccucggccuuccaaagugcugggauuacaggugugagccaccgcacccagcccaucacguucuuaaauuguagaccgcuguuuauaguucucacugcagccauguuuguagaauuaaccagcaaauaccuuuuccauaacaaaaguaaaauuuuggaauucaaaguuucaaccuuuuuaauaauguuaaaauaaucaugaaagauccuaaugaugcuccuuguauacuucuuuuggggacuuuguuguauucuuuuggaauggauauguuaaaucugggcuuuaugcauuucugucuuuuuaaagcuuauuuugucccaaauaaaccuuuagaagaagauaaaaauguccucuacccuaauaugugugggccaauaucauagcauuuuagaaaccaacuuauaaaaaucuaaaaaguaaauaaaaguggugcgggugauaccugggcggaaugucuuggcacucagguguaaaggauucuggaaauagggaugucugcaagggugcaaauuaauagacuggggcuuuugcuguugccuccuagaaaaauugcugauuacauuuuuugggagcagaggucuguugagaguuguuagucuuucuuuuuuugagccacagugugaauaauuggaaacuauuugaaugcuggacauuuuuuccuuucauauguuuguguguccuaucggauuaaaguuuggagauaauucuaaagguuuuuuagcugaagaugugaaaaacuuucaguaacucuaucaaccauuaccugaauuacaacacuucuaaggguacaaagcguucauauucuaaaaugcaguguuucugcuacagugggucauauguggaguguuacuaaucuguuucauuucuuuauuugcuuugguuuuacuauuacagaaauuuucaaacauacacaaaggagaaugaacaguaaaaugaaccgacacuuuacuaaucuuguuuuauuacccccucuaacauuaauuuuuuccccuggaguuuuuaaagcaaaucuuagacaucaagacauuucacuuacaguuaguuuaguaucuuuauuuuuuuuuuuuuuuuuuuuuuuuuuuuuuuuuuuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuaguaucuuuauuuuuuauuuuuauuuauuuuuuauuuuugagacggagucucgcugucacccaggcuggagugcaauggcgugaucucagcucacugcaggcuccgccccccaggguucacgccauucuccugccucagccucccgaguagcugggacuacaggcgccugccaccucgcccggcuaauuuuuuguauuuuuaguagagauggguuuucaccguguuagccaggauggucucgaucuccugaacucgugauccgcccgccucggccucccaaagugcugggauuacaggcgugagccaccgcacccggccuaguuuaguaucuuuaaaugauaaagacuagaaaaacacagaaucaccauaauuauauuaucacacauaacaaaauuaccuuauuuuugaauucuaauuguuaggacuggcaaauuauauuuaguauuuaucuaaauuaaaaagcuuaauuuggcuucauauguuuaauguacagaaguucuuacuauggucuauuuuucaguaaguucacuaaggcuuacauuuuugggcuaaaguaaaacaaguauugggaaccacuggaaaaauacuaccacaaaagucaaaucugcuuugggcuugaaaaaguuacaagaggaguaaguaaagauaacauugaaaugcuucccugcccccaccccauguuuauuuuagcuguauacauaacugagugcccacuauauauuauuuaucuuuuuuauagacauuaaugcauucgcaaaauaauaaaauuggaauuuagaccaaagacuuuauaauauacaguuuacagcauaacacacauaaagaaauucuagaggcauuggaacuuggggaaguguaguaggaaaccuggaagagggcacuguagccagcauguauaagcauuucugauuuuguuucccagccaaaugugucuggccccuuaauuguugacuggacguuucauacuuauccuuggcuugccuacuuacuauacuccuguuuguagaggugcacuuuagagaaggggaaucagaauuugacaugguaaagcugcuugcuucuacuuuccuuuuuguguagggaguguacuucucuccaacugagaggagguuuguacuuuuucucaggauguuagugaagcuacacuucccaggcauuaccacaaggugaugcagugacuuugcauauuauuucuccacucccgugcgaccuugacauucucagugaauuccaacauuuuuguaagcuugccuaagucuguuaucuguaggaggagugaaccagaggaacuaugugggaauuagaaauuuuauuauuuaaaauggguugauaaugacauaauuauauuugauugcauucauccauguaaacuuuuuaaaugauuaguagcuauauuguaauuuaauaagaguaaaaaaugacaagguacuggaaugacuuuuguaaaauauuucuauaauuauagcaaugaaauuuuaaaaagauuggaguguuggagagagauuaaugaaggccauuaauaggauaaucacaaauuauuuuacuuuucagacuuguaaccauugugaauacuauauuuuaaagugaaauacuaguguuuucuauuagaaaaugugaaauucaggggaggguuuaaaaauggaauuucuuguuaauagggcuauuuaaaacaauagaaauaauacauuuauauauacuuguaaaaauucaaacaauaaauugauguaaaauuuaagguccuuaagucuucuuuuuacacacaucccuuauaagacuauuaacucuauaguguauacuucuugaguuccuuuugaugcauuuguaaacauauacaaauacauauauguauaccuaugugcuauuuuguaccucaaaaacuucagugaacuaaaaguauaagguuggauuguggguuuuuaaaaaacuguuauaauugagguuaacagaaguugaaacacuuuugccuuguuuuauaaaaaaaauaguuacagcuuuguugguuuaauuuauuuuaggaaaugauauguuaaauuuuaagaaaaaaguauuauccuuaaucagcuuuugauuaaaaacaugggacguuuauucuaagcuaguuuauuuccuucuuacugaauaucuuucuuaaaggaagcgugacuauucacucacuucauagaaaaauauuauucucuuaauucaguuuugguaguuguaucuaauagauguugguucuguugauuuagcuauaguuucuuuuguuggugucuuguaaccaguagugaguuuuuuuuuuuucuuuuuuuuuuaaagaacuggaauugguguuuuuuuuuuuuuccuuugugaagccagugacuugagauaaucauuaaugacuucauuaguaucaugaccucccugggagcccaaauuagcucagacaacucaaagaaacaaaauaauaaaacucuucaguuauuuuaggcagaguucuccaguguuuguaaaugcuaccuguucauuuuucugauggcuuuagguuaccagguagagaguauucauaguuaagucuuuccaugaaauaugguugcugguagcaaagucccuuuauuagugcagagguaaagggggauugcuacugaauauacucuuuaucuuggaaugcuugcaaaccucagguagggagaggcugacaacuagccugauacucuacagugguuuccagguucaugauugacagucucuuuuugggauauccauuauauucaguaaagcaggacuuuggccauaacagaagcagaggggacacaagaagaaaguugauauuuuuuaaagugcuuauuauuacaaaacuuuaaaaauuugccuuaguauuucaaacaggucagcaaaagaaacaguuguaaaagcacacuguuuuagaucuuagcaauaagccuucuuacuaauggcuaaaauaugaguagagccuuacugcugugcuugcucuguagaaacuucauugauuugugaaguaaauuagauuaauuugguuagcaaaaaccuugccccaguuuuccccauuauuacagagaugccuguuuuaaugacucaagcaagugcagucaggacagucauaguuucuuauguguauuguagaauuagugauuguacggagccugugacaaacucuacagauugcuuuuuuggguaaauccucauuuguuucuguuuucucaaaaguagagcacaaaauagggaaaacauuuggaucuugcaguuuuuauaaucugcuuucaccauucaucugcuauccagugcuugguguuuacuaagccagugagcguucaugaaucucuaagagauuuucaacaguguguauuuuauuaacacuacacuuuuauuuuuauuuuuaaauauaaguuuauuuuaaucaguaaacauguggaaaggguacgugaauacuagaaguugagguaggaucauugauuggaccuaugaugaaaugauagguuuguuauagguggagaagaacaaauaggcugagccauuucaaguagaccagcuaagauuuuacaugguuugagagauuugaacaagcuuguaacagaagcccaagaagacaggcugggucugggaucuguggaaaugagugagagguagaaguuguuggauagugguucucuuuucugguugcauacaggauugagauuacuuggggcgauguaggggcagggcuauguauauucguauacacacccacagacacacaugcacacacucccaggccccaaucccagaaaguuguugucaucuauuuuuuuuuuuuaaaggccccuaaugauucuaauguguaaccaggguugagaaaugcugguccaggggauuagaagggcaggaauguaggcacagagauguuagcgucagguuuaguuauaggaccccaaaaccuagggagaggggaagagaugaaugggaugggcuagguuagggaggagaaugaugaagcccaaggguucuacauaggaaggaaauguuaauugacccauagccaguaaaauacugacuuuuaacuguucuuguuucuguuucuuaguguuuguuacuaggagccagcagguuuauauuggcagcgugugcacaaaaacaccucugguucauuugcuuuugauuuaaauagaagcagagggcuaggcuuuccaggagaguuaauuuuugguuuugguuuuuuaacuuuuaaaugcccauauaacuuucugagccaaauggguuuuaguuauuuuuccaguuugucuguauuuuuauauuuaaucaauuuuuaagaaguuccaguauuuacaaaguauauauuuucuuaauuaugacaugcaaauauucaugaaacuuauauuaaauauuauguauuuucugaaggcauaaguuuauucuuaguugguauaauuuaacuuguaugaauuacuuguuucagauucacaaugacauccuuucaagaagucccauugcagacuuccaacuuugcccaugucaucuuucaaaauguggccaagaguuaccuuccuaaugcacaccuggaaugucauuacaccuuaacuccauauauucauccacauccaaaagauuggguugguauauucaagguaagaaagcuuucugaauauguucuccauguaaacacuuaaaauuuucuuuuaaaacagauugauaaguagcuuuuacuugccuuaacucugcauuaagacucauuuuuguaaacaucaccaugaaauauuuaacaguggggaguagauaaaauggauguugggaacuccauuucaccagauuuuccucucccugaucagaaaguuuaccuucacuuaaggacuugugaaaauuuuuucagaaucuucuuuuccuauuuucuccauucauuaccugcaauaaaaaaagaucuuuuucuuuggguucuuauauuauuuaccauuuuuuccagucauuugaaauuaauuuuauacagcuugacagccauguuauuaucccuucuacuguccugcauggcuuaaauauugcucagauuguauuacacaguuuuaagaguauucuguuuguauuacacaguuuuaaaguauucuguuuaacaugacugaauaguaaacucuuugauggcaggaguucuaguucuuauauuuuaccagugauuuuguauaauacuuucuugaaaaugaaggugaucauuacagugguacaccucacugugcaggacuuuuucuggcaauuuuaacucuucaaaauguaguggaaaaccaaaacauaagaauguccucugagcagucaaaauaaugucacgaauguccaaacaguaaaacacauucacuuuucuccuguguuauucuguagucuuccucagaaucaguuuguuuuauuuuaguuaagauuuuuaugggcuugaaauuuugauugucuaaucuguauaaaguuaaacaacaaggaagaaagaaaugaauagcugcuagaaauuaggcacauugaaagugucuagaaguaaaaguccagccugacgggaaggcagaaaaacauuuggacaaaacaauuuuggcauuuaaugacuuaguuccuuucuuugaauuccucauuucuugauguuucugaauacaacacaauaguuauuuacuguuuacuuuuugugucaguuuuuuaggcuugucaaaucccaaaauggagaaacauucauuguaacaauuuuaugaaauuaggaguaguuuuuaaauuuuauuucuuauuuuuugagacagggucuuauucuaucacucaggcuggagugcaguggugggauaguggcuuacugcaaccugaccuccugggcucaagugauccuuuccccgcagccuuccaaauagcugggauuauagacacaacaccacgccuggcuaauuuuuaaaauuuuuuguagagacagggucucacuauguugccuaggcugguuuuaacuuccuaggcuuaagugauccuccugucccagccucccaaagugcugggauuacaggugugagccaccgcaccuggccucaguaguaguuucgauuuuaugggagauacugguaucaaguuaaagauacugauugagaacugauguuuucuguaguaacagagcagagaggaagaaaacagaaaugugacugaggaaaaagaagggcauuuccagcaggaaaaugguacagguugaacauccuaaaucugaaaaucuaaaaucugaaaugcuuuaaaauccaaaacuuuuugaaugcugacaugaugugcaaaggaaaugcuuauuggaacauuuuauguuuuggauuugggaugcccaaccaguagguauaaugcaaauacuccaaaaucugacagauuuagaaauccaaagcacuucuggucucaagcauuucggauaagggauacugaaucuguauaagcagaggcuuagagguaggaauguucaugagaaugaguaagucaguuuaacuagagcauaagcuucaguuagggaaguugugggagaugagauuggagauaaguuucauucugucuauggacgaccuucaguguuagagaguuuauggacuuuuuucugaaggacagugggaagucuuuguauauguauagguuguuugaaaaaguauguuucaggaagaugaauuauuaccuuuuuccugcagacuacuuguuuauuucuuauauuuuuucauuuuuuuaaagccaaaagacugugacuuucccuucaaauccaaacaaucaguucuaaccauuuuacugcuuacauauuucuaaauccuuaauaucacuaguucaugccuuccauauuuuuuaccaagacuauugcaauaggucagcuguuuuacccacuuucauucuuguccucuaaccuuuguuuuuuaacugcucuauauaagcuguaaaauggaaaccugaacaugucuuucuguuguuugaaacucuucauugguucuucaucaucuguagaauaaugccaagaccaaauaaccuagagccauacagggcuccuguauaagauuuuauuuccagcuucaguuuuggucauuccugcugcugccuuuuugcuuugguaaugcuaaacuauacuucuuucauugugcacuuuaaggauuguaaguuuucucucagcaaaaaagaaaaaaaaaucuucuguuuaauacccuuuccauccuuuuugccagcauaaaacuuuaaaacucaauaggaaguucaggcauguaguaaagauuucagguaauacaggaaggcucaaggaagaaaauaaucaugcuuaacacuuuuaccuacuguuaacuauuguuaacauauugguauauagcuacauguaauaaaauuacaaauaauuauacacaugcauaauguguguauaauaaauauauacacacauacuacugaugcaucauaguguguguauauauucguugaaccaguuucuuacuauuggaauuuacauuguugcuaaaugcuuaucauuaauacuuaauaaagaucucuaccuaucuuuauuuugucuacuuauuucauaagguaaguucuuggaaguagaaucaccauguuuauggcauuguuuguuuuuaagcacuuuauguguacugcaaauugcccucuagagugauuuugauagacaccauauugacaagcaggcaggaagagagugccuggguagcaauuguaagggaggaggaaugaagaugggaaaguaguaugcuugagaaaguguuaaggaauuugauuugccugggacagcuaucaauuaaaaauuuauuauuauuauuuuuuuagagacuggguuuugccauguugcccgggcuggucucgaacuccugggcucaagcgauccacccgccucagccuaaauaagugcugggauugcaggcgugaaccaccaugcccagcuacagauaccaguuuuagaagaugaaugggaaaaguuaguuuggaucauguuguagauuguuuuaauauuugagggauaguuuuuaaguaaggaguaauaaaguuuagaagugaagcuuaaucuuauagugcugaguaagauaaauuggaauucgaaaggaauggagguaaagagaacguuuagacuauccuaauuuucuaugugagauaaugaaagccuaaaguggagaaggaaguaaguuguguguaauaauccauaaguagaauucauaggauaugucaacagucaauugaauuagaacuggcacucauucuauggcaucucaguaaggaggagcaaggucauauguuaaaaguuggggagggcuugaguauagauaauuggucuugcuacuguggaauaaugucauagggaaucggaguggcuuaaccagaagauuacuaagcagcaauuuuaugacuuuuuccagagagauucagcaucuggaguugugucaagagugccagaaguggcugucauucaaauuggguguuggaaaagggugggaaugggaagggaaguuaagaggacaaaggauacuauggugguuuugaguacauuauugaaaugauugacugauagugaaguccagguuggguagggaaaugagugaagccaaacaagggauauagacuggguuggagguuuuuguuccuuuuaguuuuuucacucccucugaaguauugauugauuaguuuuaauuauaaugaaaauaaacauuuaacauguugggaauuuuauacauucaccucucaucugagcauuauacucccuguuuuacagaugagggaacugagguucagagaauaaagugacuuguucaaaguuauccauuauacguuggagcugagauuugaaccuuauguaaauuggcauucaauaauuauucucugguuguuugguuaagugagagaucugauuauucaaaauuaacaacagaguugcuaauaaguucagcauggauuuucuuuagugacagaauugaaguaaaauuacagggaaagauuuagaacugcaccugaugcaggcugggcacaguggcucacgccuguaaucccagcacuuugggaggcugaagugggcagaucacuucaggucaggaguuugagaccagucuggccaaaauggcgaaacccugucucuacuaaaaauauaaaaauuagccgggugugguggugcaugcugguagucccagcuacucaggaggcugagacaugaguaucgcuugaacccaggagguggagguugcagugagcagagauuguaccacugcacuccagccugggcgacagagcgagacuccgucucaaauaaaaaaauaaaaagaacugcaccugaugccauaucuuuauuauuaaaccaacguuaauugcaguaaaauacuauauguuacauuauauuugaguuuuguuccguuuuguguuuaugaauuugauuuggucuuaguuguauaaguacauaagcaugaggaauugguguauguuuagauuuaugcuuaguacaaauuaaauuaccuuacaguuaaagauccccaguggaugccugaaauuacagguaguacugaacucuauuuacacuguacuuuucugauacagucauaccuaugauaaaguuuaauuuauaaauuaggcacaguaagaguuaacaacaauaacuaaaaauagaacaauuguaacaugaaauuguuauauuaccugauacccagccugcaucauuagcaacucuguugcuaauuuugaauaaucagaucuuucacuuaaccaaacagccggaguaaaaguuaugugaaugugguuucucucacucucaaaauauuaaaauaucuuauuguacuauacucacuuauuuuggggucuugguugaccuuagguaacuaaaaccacacaaagugaaaccuuagauaaaggaugacuacuguaguaauguuaaagguccaugaguuuuuguuuuuuaaacuuuagagucuuagaauucucacaucucugagauacuguucuaauuggaauucucacaucuccgagauacuuuucuaguugaggaaacuggaagugcaaaguggucaugugacauguucaaagucacauugcuaaugcauaacauguccuauacuagacaaacaaaaccucccuguaagguacuguuuucacugcauccugcugucaagcacaucaaaaacuaaguugccugauuagaagguggauccaaacagugauuuuaugcuugaauauccuguuucaagcuuuuguuucuuuguuccuuguuuuuccuuuucaaauuuuuuuccuccuucuucucuuuuccugccuuggucuccccuucaguccugucucauuccacucauuuucuguuuuuaaaaaaaguccucugguuguaaaaaaaaauuacaauuauaauauauauaauauauaaauauuuauaauuauacuuauuuauaauuauaaaauuaaaauguccuacagucccacuacccaaguauaucccuaccuaauuaauaucaaugguuagcacuguuaauguuuuaaguauuuccuuccagccuuguuuuauuaauggaaggagacuuucagucuuuuuuguuuuuuguuuucguuuuuguuuuuugagacagucucgcucuaucgccgaggcuggagugcaguggugcgaucuuggcucgcugcaaccucugccuccuggguucacgccauucuccugccucagccuccugaguagcugggacuacaggcacccgccaccacgcccggcuaauuuuuuuaaauuuuuuuuuauuuuuaguagagacgggguuucaccguguuagccaggauggucuccaucuccugaccucgugauccccccaccucagucucccaaagugcugggauuacaggcguaaaccaccccaccuggcuugucuuuuuucuaaugcauauauuuugaauguugcuggcauaucucaugccuuuuuuaaugccgugauuuuuucacuuaaucacuuacaauuaguucuguaccauuuuaucucauugaggaauuuaugcuguuuaugauauuucucuuuugaaucaauguugcauacucccuguguauaucuaggcauuuuugcagucauuuuuuuccuaaaggaacuuuucuaguaacaugauuuuuagaagcuacauuguauacagaagaaggaaaaugaaugcuucuacccauuguacuccuaccuuccccagugaugucuguuguuguauguuucuggauuagaaaaauucauaggcucauuugauacuuuuuugugggcguuuuuccucacuuaauuauauuucuugggaauccuccuauauccauauguaaucagcucauuuauuuucagugccuuuccuacuccaaggcuugucucccuuuauucaucuccaaacaucaguccccucuucucuauuucuuucuuucuuuccaaguggugucucauaugcuuuccucaaccuaauguuucugucuuuuucucaauguuucuccaggauuuauuaucuugauguuuuucuagguaacuuugauguuauucuggucuucuguauguucuuucucagaauuuccuuuaugaucaaaacuuauccaacauguuuuucugaaauguuaauccuauuuaaaaggaacacuuuguggcuuucucccuucucugucacccuuguuuaauuuccauuuucucauuuauuuugcuguugcaguaguaacaagaaugaugcccacugcuguuguaauucuucaaacuaaaguaugugacauauucauugcuuuaguuucucucuuaacauacauacagccuccagugguaucugugacuacaauuaacugguuaacuagauucagguauaucuccuagaagcaauguauuuuggcaguuuuauauaacugguauuuugucccauuguccaaaguguugccauguucucccugccauuuuucaauguuugaaaauugcuguuauuaacuuuaaguguaauaauuuucuuuacacuugguaaugguggacuaaaagacaagauuucuugcauuucaguguguccuguagcauugagcagcaaguucuagcccggugaccaggaaaauaaaacagagaaucaaccuuugguuuggacacauuaugguuuauugacccuucuaauuagauuuauuauuauugcaguggacuccugcauaauuuccugauguucaucuuuuguguuccuuccaguauuauccacucuagcauacuuucaugugggagcuuagauauaagacaguuacaucccaaaggagcccauucucuguaucuuuccagguugagagacuucuacauuuauuuuuuauguaugcccaacaugccccucucuaaguaacuuaagaacuauuguuuaguuuuaguuuuccuuacucaaaagcaauuugaaguguaguucuauauuucugacuuuuuacucaggauuguaucuugcccccaacuucuugguaggcucaguucucaggcugcuaacaagcacuuaugugauaggcacugugcuaaauacagggaugaacucacuuaauacagacacaaccuuuugagacuguuuuuguuaucagaggagaaaauagaaaugaauaacuuuuccaaaaccauacagcuagcaaauuaucuuuucugguauucugaccucacacccuaugcucuuaguuauuacaaaauacuacaccuauaauaacuaccauucauggaguguuugccauggauuaggcacuucagaugcugcuuuuagguucauuaccuaauuuaauucuuccaacaacugugaaaggaaaaaaaugggcucaaacaggugagguaaaugacuuguucacugauuccucagguuucauauccguaaagagaugaauagugucaaauguuuuuuaccuugacacagaacaaaguaaauuguaagauuugucccagcaugcagauacaccagaaacuaaauuucaugaaacacuuacccuuaauauacuccaguacuuucucuucuauauaauuacaaaauaaaugccagucaugaaccacuaaauugguuuuaucacuucuuacuggguuuguaaccuguaguuucaaccauuccuuuggaggcuaaaggugacuaagguucguccagcuucaguauucuguugucuacaaucaggccaaucagaaucauagaacauggauaaucuaaccuuguggcugaugcauaaauuuuuguaauauuccuagcaaauggauaucuaguaccuguuuuaaacaucuccaauuuucaauauuuaacaugguauuuaguccaucuggaaaauacagauugagguauguauauauucauguuguaaguagaaaauguguuagcauuaggugagacauggguggucuguuugugcauauauaaacaucuuggugcuaaaggucuuuuuacaaaauuugccaauuggcugcaggcaagacuugccaaagaugagagauuagugaauuuaguggauuuagggggaggcagaugucuaaguaaaacaaauaaaacacuuacauuggagguauaaauuaaguuuuuugaauuuugauauaugugaaaauucuucagaggugaauuuguaaugcaugucuaauauuuuaaauauuaauuuucuuuagucuauaacucccucaguuguuggaucugcuagacauucaguaugugccaccuuugaaaauaauacucuguggucaauaaaaaauaaauaacaaguauuuaaaaacucacuguguuuagugaaauuaaauuuuaaucaaaacacauuuuuauauuugaucauauggauaguuagauuauccuugagaaauuggauagcaaauugcauuuuaauauaguagaaacucuacuauucaauuuauguagauuuuuauagcauuaggcuguaguuuaauuuagaaauaauuugacaugcuuguuaaaauacucaugauuuguaaacauauuaaauguauauuuuaacuguaaaauacaauaaauaaacaguaugcuguaugagccuaauauuaaacuauuugcuuauaaauccgccuuuuuuguuauuucccuuuagguuggauggaguacugcucgugauuauuacacguuuuuaugguccccuaugccugaacauuauguggaaggaucaacagucaauuguguacuagcauuccaagguaaggacugaaaacugcagaacucaaugaaacuagaugucuuauugccauuaaagauguuguacuccauuguaaugauuuguucagguaucuccaggguaccaaaguugaauuaguuagugucuuuacuuagcaaaagcccuaagaauguaacugucugguguaggccacaugauauuuuauguagacauuuaaaaguuauugguuguugucuuaacuuucacugaagaguggguuucuuuuuagguacuaauuuuuggagauuuuuuuuuuucaagugagaaaacaauacaauaguaauaacagauauuagaauaauguaacaaaaaagaggugaggaaaauaguccagaugcaaaccacaaacaugauuaacagaacuuauaguuauuugaauucugucauguguaaguuccuuuauuauaaaaugauaaaguaauauaaaauucauuuuuguguuagcuuggcauuauuuacaaaauuuaaaaaauacucuuauucagguaauucugacauaugcuacaauaugggugaacacugaggauguuaugauaaguuaaauaagccaaucacaaaaagaaaaauacugcauaauuccgcuauaugagguacuuagaguagggauagacacagaaaguagaaugguggucugcagggcauucagguucccucaagggaggaauggggaguuauuguuuaaugaggguagagaguuucaguuuuaaaagaugagaacaauuuuggagauaauggugguggugguugcacaacaauaugaaugugcuuaacauugaacuauacacuuuaaaaugcuugagauaguaaauuuuauguguuuuuuagcacaacuuaaaaacuugaaaaaaaaauaacacuuauucagagaucuaucacagaauuugcugcagaguaauuuuguauuauaauuguacugacuuuaggauuguauuaaagugaauucuuacccuuguauaugucauagauuucuuuuggucuggugaaguuuauggacucugucucagaauaauauuuuaauguauauaaaauaagacauaaaauugcaaagaaaaccaauuauauugaaauaauuaaaauaucacaguaacaaauuuuugauauauuaauacaugugcuucaaaaucuguguguuaacaagauguauuuuauuggcagauuuaaucacugccaugauuuccaaguaagauaacauugagauaccuguaacaauuguaaugugguauuaacauauaaguaauuccuguuagugacaaaaaucacaaauacugauaguaaucaaaguacaugcuaaaauuuuaguuagauguuaguaaaaauaaaaauauaauguuuuucuccauuaaaguugauggaugaccugaauuuucuguauccuuuaaccccaaguugaacauucccuaaaacugccucuuugcuauugagaacuuuauuugccuuuauguuuaaaaaaaaaaaauucuaggacuuuauugcuuuccccuggggcuggcuauuaauaauuaagacuuuuuccucuggguuucucauaucuuuaagcaaugggcucuguuaagaauguucuuauguuagcagaaagaaguuuacauuguaugaaucacuacuuuaaaaaaaugugcucaggauuaugagaugaaugauuuaaaauaaaguuuauugucucacacauuuucacauauuuuaaugcaauuuuaaaauuuuguaaaucuuuuuuuuuuuuuuuugagccggagucacacuguguuacccaggcuggagugcaauggugugaucucaguucacugcaaucucugccugcuggguucaagcgauucuugugccucagccuccugaguagcuggaacuacaggugcucaccaccacgcuuggcugauuuuuguauuuuuaauggagacgggguuuugccauguuggccaggcuggucucaaauuccugaccucaggugauccacccgccucggccucccaaagugcugggauuacaagugugagccaccaugccuggcccuaaaucuuuaaaaugaaaccccaaaucauuucucccuuaucugaucugguuuaccauauucagaauguuaaaaauuaaauuuguuuuaacaaacuaaaagaaaaaccuuuaaaaaaccaaacuauacuaaaauauuuauuuaaugaaaauacuuuguuagcaugcaaauacuuacuucagaaaggaaccaaaaaacaguuugaauuugggauaaacauuucuaguauuauuuauuuuagaauuuuuuuuuuuuuuugagacggcuucuugcucugucucccaggcuggagugcaguggcgcgaucucggcucauugcaagcuccgccuccuuaguuuucgccauucuccugccucagccucccaaguagcugggaccggaggcgcccgccaccaugccuggcuaauuuuuuuuguauuuuuaguagagaugggguuucaccguguuagccaggguggucucgaucuccugaccuugugauccgcccgccucggcuucccaaaguguuggaauuacaggcaugagccgccgcaccuggcugaaaaauuuuuacagugaucccucccuugaguuucagucaguuuuuguuauagucgcuaagagagagcaucagccuguuuuaagggcagcauaacuuggagccuaugcacauagcuuugguauagugauuuccaaacuuaacuuuaauuuggaauccugcgugcuuuaagacacacagaaauuuaugucccaccuccagauguugugauuuaauuggucugugguauggccuggguuuuagaauuuugaaaagaucaacaggugauucuguuauguagaaguuugggaaccaguggcauggcagacaguuuucagcaaauaauuguuaacauuaucuaauugauauggucuuaucuaaguuaaaauguccuguuuuuuuaucaggcaauaucugacuuggauuuuggugacaugugcagagcagccuucuaaaauaacuaggcucagauuaaucagcuucagauaguuuaauuuuaaaaaauuaacauacuuuuuuggagcaguuuuagguuuacagaaaaaauugaaugaaaaguagaguucucuugcaaucccuuacaccacccuucccugcuuuccuuuauuuuaacaucuugugugcuccauuuguuauaauugauggaccaauauuaauacacuauuauugucugaguucauaguuuacaucaggguucacugugugauguaaauucuguugauuuugaugaauguaugaagacauauaccuacuguugcaguaucauaaagaacaauaacuucacuccccuaaaagucuccugugucccaccaacucaucucuccuucccuccugguaaaacccuggcaaccagugauguuuuacuguccccacaguuuugccguaaaaugucauagaguuggaaucauaacgauauguagucuuuucagauuggcuucuuuuacuuagcaacaugugguuaaaauucccucaugucuuuuagugguuugaauagcucauuucuuuuauuacugauuaauauucuauugaauggauguaucauaguuuaugaaucuauugaaggagaucuugguugcuuccacguuuuggcacuuacaaauaaugcugcaauaaacacucuugugcaaguuuuuguguggauguaaguuuucauuucaugugaguaaauaccagggaauguaauuaauuaauuguauaagagcauguucaguuuuguaggaaacugcgaaacugucuuccaaaguggcuuguaccauuuuauauuccuaccugcaaugaaugaugagaguuccuguugcuccacauuuucagcagcauuugauggugucauugcuuuggauuuugguggucuguuuguuuaaaaacuuuuuuucacuuuauucugaauuuugcauauguuuggucuaaacauuaauuggcaaugugaguucauggaacuugcauauauaaagaaauuuccuucuguucugugccaggaaaccaguaugcagaggauaaaacuuguggugaaauaugggcaaugauuuagguauucauagauguuuuuuggauaaggaaauguuguaaguuauauauguaguuuaucuuuuaauagccuuuuuuagauaauaaaauuuagguguguauuggaaccgguuuuguuacauuuaaaacuucuuuccugaaagcuguugguuuauuuuuagucauuuuuauugugauugguuuccccuuaaaaaauaaguuaacugccagguuaacuuauuuuuuaaguggugacucacaccuguaaucucagcuguuugggagguugaggcagguggauggcuugugaccaggaguuaagagaccagugugggcaacauagugagacuccaucuguugaaaaaaauuuauucaauuuguuauagugacuauugcuuuuguuuauuagggacuuaggaguaaguuuaaaagugguuaaaaaguagagaaaagcauccaguuuauuucuguuaauacuuuaaaaacauuuuugggccagacaugguggcucacacuucuaauguuaacauuuugugaggccaaggaggauggauugcaugagcccaggaauuugagaccagccugggcaauuuggcaaaacuucaucucuacaaaaaauacccccaaaauuagccaggcauggugguguacaccuaaagucccagcuacuugagaggcugagguggggaggaucacuugagcccaggaggcugggguugcggugagccgagauuguaccacuucacuccagacuuggcgacagagugagaaccugucucaaaaauucaugggcacuaagccuaaaugcaauauguuuuacaaguuucugaaaauucaacaguucauuuuuauuuugaauuuugaaauucagaaauaaaagcaucuccgugccuagaacuuuuuuguuauauaaggaagucagggaaagcuuagucauugaauauuagaguuauagaagggcuuucaagcauaaugcaaaucacuuugcucauuuuguggaugaguaaugagaauccugaaaugcaaaacccaaaacaucuaacaauaccuaaacgugauuguuuuccuaaaugaacccuuauuuauuuauuauaaucuuguugaauacuaaaggcacagucuguaaaauuugacucgaaaauuuaguuuucacuuuuucccauuuuauuuucaguauccaucugacaaguuuuuccaggcagcuuuaaauugcagcucugaauaauuaugucuaucucaaaugguuuugaaccauauuuuuuagcaguuuauuuuagugaaguuuuuguuuuuuaaagaaucagaccuugaggccgggcacgguggcucacaccuguaaucccagcacuuugggaggccggggcggguggauuaccugaggauaggaauucaagaccagucuugccaacauggugaaaccccgucuccacuaaaauacaaaagaauucgcugggcgugauggcgugugccuguaauuccagcuacucgggaggcugacgcaggggaauugcuugaagcagggagguggagguugcaguaagcugagaucaggccacugcacuccagccugggugacagagcgagacucugucucaaaaaaaaaaaaagaaucagaccuugaauaccuaguuuguacaguuucuaaugucuugaugccagagcugauuaauuaugcuauauauuuguuuucuaguuaagcuuuuaaauaagccuaguggcuauuuggaaguugguaugaauuaguaaguuuuuaguagcuauuaggaggguggauuuuuaaaaucuuuaaaaauguauguugccagauacaugucuaugauauuuauuuaaacuuuguauuuugaaguaauuuuagauguaaagaaaacuugcaaaaguaguacacagaauuucuguaugcccuuugcccaucuucgugucaugugagcaucuuacaugaccaugguacauuuauuuaagaaaccaauaguuuaacagugguacaguacuauugacuaaaguacaaaccuuacucagauuucaccaguguuuccauuacuguucuuuuucuguucuuagauccagucuuuaauuccucuuuguauuuaauugucauguugucuuagucuccuugguuuccuccuuaucuuucauaaccuuuacuuucuugugaaguacuguuagcauuuugugguguuguuuguuuugguagcuugucucucaucuugguuuugcucgauguuuucucaugauuagauugaaguuaugcauuuuugggaagaaugccauagaaacaguauuguaccuuucucaguacauuuuaucagggaguaugugauguccauacaucuuauuacugguuauaauaaucuugauugcuuguuuaagauugugucuucuggauuucuccacuguaaauaaaguuauuauuuuuuucccuuguaauuaaugaauauuaugagggagcuacuuugagacuguggaaauaucuuguuucuccucauauuuucagccacuaauuuuaguaucccucugugcaucuugccuacgauuauugugguguuugccuaaugaaguucauuacuuguauauuuauuaguugaucauuacguuagaaagaauuuucuucuucuccauggaaucauuaauuucuucugugaaauaaagucuaauaccauauuuuuuuuguuacuuaaauuguuucagcuuuagccauuuggagcuuuucaagugggcuccuguauuuuuuuuugacaugcuccaccccucucuuaauuccuuuuuguggacugcuacuuugcuuuaaagcgccacaagaauuucucuuaucuuauagauugucugccucuccucucuguuuuuuuuuuuuuuuuuuuuuuuugaggcggagucucacucugucgcucaggcuggagugcaguggcaccaucaugguucauugcagucuugaccuccugggcucaagcgauccucccgcuucagccucccuaguagcugggacugcagguacaugccaucacaccuggcaaauuuuuguauuuuuuguagugacaggguuucaccauguuggccaggcuggucucuaacuccaggugggcucaagcgaaucugcccaccuuggccuuccaaagugcugggauuacaggcaugagccaccgcacuggguccuaaagcuuauuuuuaccauacugcacuagcagaccucaucuuuucugccuucauauaguucacaugugcagcauauuacuuuaguuaauaucucuuauuuacauguaaugaaugucaaauuggagggaagauuucucuaaaugacauauucccacccccacucccaguccucaguagacuuuuauauugguucuucccuugcuccuccuccagccucuuucccauuguaaaguauauacuugccuguccuaaaugaguggguuuugcccuagugaagauacaaggggaaaggauauucugggaauauaagcuuaaaccuaagagaagaaaaaauuuaacuuugaguaggaaggaagaaucuaguuuugauaauuugcgaaaggaggaaggacauaucccagauucuugucaagaacaguguggggaaugagacauggcaaguauuguuaaauugaaauaacaugaauuuuauaauaggaaguuuaauaauuuuguuuguuaacuuccucuuaggauauuaccuuccaaaugaugauggagaauuuuaucaguucuguuacguuacccauaagggugaaauucguggagcaaguacaccuuuccaguuucgagcuucuucuccaguugaagagcugcuuacuauggaagaugaaggaaauucugacauguuaguggugaccacaaaagcaggccuucuugagguugguguucacagugagauagugauucauugauaauuuuaagaacagagcucauguugguuggcauuuuaagaauuuuaagguuaugugagaguugccacaaaaaucgaaugcuuuggcugggcgcaguggcucacgccuguaaucccggcacucugggaggccgaggcaggcagaucacgaugucaggauaucgagaccauccuggcuaacacgguguaacucugucucuacuaagaauacaaaaaauuagacgggcgugguggcaggcaccuguagucccagcuacucgggaggcugaagcaggagaauggcaugaacccgggaggcagagcuugcagugagccaagaucgugccacugcacuccagccugggcgacagagcgagacuccguaucaaaaaaaaaaaaaaaaaaaaaaaaaaaaaaaaaaaaaaaaaaaaaaucgaaugcuuuuuaacuaaaauaauaaauuuagagugucuuuuuuugaaaugcuuaaaaaaaucuuuuggccacaauuaugcuguugguuccacuguggcagagacuuucccuagggccuauccuuauuuugcgcauaguggauagugcaguaaguaccaauugggagaguuuaggucuaaagcuuuccuuauguuccuuugccuaacuuuuugugguggcguaaucaguucauuguagaauguuaccgauuuggggaugaagcugcuugggauaaugguguaaaucaauaaaucuaacuguaauuggaugugaacuuuguuucacuaccaugagcauucucuuucuaaaguguggcagugagucaggggagcuucccagucucuuaauuuagauuggacauuuuuagaaugauuccuguuguacuucugaugaaaugaauaagccuagauuaaccauaauuuaaaaagaaaauuuaaaaagcuauuuacuccuuacuguuuuuguaaauagaauauuguggagucaugaucauggcuuuaauauaaauuuacuauguagauggucuaauaaugccuuguguauuaauuuuuaguagucauugacagaaaaaauagagugacauucuuuucucauuuuaagaucacauuuuucaauaucuuuauccuauaccuaaaaaacuacaguguuauauuugaguuauugugauuaauuguauauagugcccucuauuauaauaauaagaaaaauaguuucucaaauugguucaguauacauuuuuggcuaauuuauauucauauuucuucuauugcagcuauugcuuuuucuuuauaguuggauagauuuuuuuaacauguaaauauuuaauaccuuugauuuuacuuuuauuuaccucaaagaacugagacuggaguaaaaagacaagagguuacagauagaauacuuuuauuagacagucaaacuagguuaggaggaacuaaugauuuuuuauugugaauucuuucauaucuuuccuuccccuuuacagaaauuccucucuuaucuuaaagaaauguaacuuuuauagggugacuaaaacauuuuguggugcaacugccugaugaucaagguuuuuagcuuuguauuugaaugccagucaaagaugcugaaacaaacccagaucuuaagaaugcagucaguauuuauauuguagcuuuuugaauacuuauuagaccacccucauuucagggccuccaacagaaaagugaugggcauuuuggcauucacauuuaucuuguacuuuuucuucaaguagauugagacauaucucauucuguuucacuccuuccuacuccacaaaggguacuuuauaaagaaugugaaaauugcuguuucuuaaguaaauauuucugagauuaaauguuuuuuuaacaaauauuuuggugagucuuuaaaauucucacauucauuaaaaucuuuaucuaaaacugcacaaaauuauuacaaaugugagacauuaucugggguccuguugacauuaaaagugauuagugagacauaauuuugcaaucuguggaccuugauuguguccuagauuuaaaaaaaaacuggggggauagugagggauauuugacuauggccuauuggaggauauaaaauuauucuuaauauucuuagcuauaauaauaguggugguuuaaagccaacuguccuuauuaggugaugcuugcucugaaguauuuaggagugaagugucugcaauuucacauuaaauggcuuagaagaaaaaaggauacauaaacuuagguauauaaagagauaaacaugcaagauauuaauaaucagugaauuuaggugauggauguuuggaugaucauuguaaaauuuuaacuauuuuguaugcuuaacauauuccaaaauacaaaauugaggcaagaaaugagacauauacauucuuaucuaauuugaauucuucuaaaaaugucuacuuaagcuuuagugaacucuugagaaaguauaugugaauuaaauaaaucacuggaaaaggugauucuuuuauaaagucuauguugugcuaugucaagauauaucuuuauuuuuaaguugccagaguuuugagccagauuuaaugccaaauuaauaaugacauuaaccuuuaugggugauauacuugccugguucuaauuuucuguugacuuuauugaaugccauuuauugcaaacuauuucaaaucauuuuuuaaaaauagauaagauauaaaaaaauucaaugauugaauaaauaaacuuuuccuggcauuuugauuugauuuguuggaacagguagaagagucauucagaaaguuugcagcuauucaacuuugauaagagccauuuuagaauuuaaucaguuugauuucauaaucccaugacccuggaaaaccaauuugggguguauggaggaaaaacauuuuaccaauuaaauguauaauaccaccuuuguuaagucuucccugugagucuucauucuuccuguaagagaaauauuaacuuuguuuuacuaucuuaugaccauuuauuuaguaaucuuuuagaauauugaaguuuauauuuuccugaacuauuagcuguucccauaagaaucagguauauuguuaauauguuguuacagucugcauguuuguccuaaaauuuguauuuuuacuuaugaagaguguuuuaauuuagccaaguagaggccauuuuauauauagaaacuauacauuucuuggugucuuaaggaaucagcacuuuuaguaguaauuccauagaugaaggccuuauauaccauauaguaaguuugugauagauucaaagauuuccuauagguuugcauucaagaagagguacaacuuuuccucuuggaguaucugauuauuacuguggauaagaaagcccuguaauuaacgggaacauuaauaugccuuauuuuuaguucugaucucaaaaaugauuagcagccaacuucauaauacaguucucucauuuuguaauauuuucuucuuugcucaaccaaaagaagguuuaaauuuaugauugaugaauuuuucuaacugaaggcuaaaaaaaggcugauugauauaaaguagguagaauguaagaguucuuucugugaaugucuucauuauuuuuuuuggaaauggaaaacuaaauuuguaauaacauauuuuaggauuaagcaaaaaacuaauuaaucugaguuuuuugcuuuauaguugaaaauugagaaaaccaugaaagaaaaagaagaacuguuaaaguuaauugccguucuggaaaaagaaacagcacaacuucgagaacaaguugggagaauggaaagagaacuuaaccaugagaaagaaagaugugaccaacugcaagcagaacaaaagguuaguugugucuuauguaacugauugaaguugauaguauauugccugaaacccaccuuuuuaaagagcugaaccaauuaaguaagugaaaaccagguacugagaaaaguagccuuuuagauagacguuuauacaagaacaggucaguuccuauuaaccuucugccacagcugcuuuuauguuuguaagaugguuaaaauacuuuuagacuuuugguaccaggcuuguugagguagucccugacaacuauuuccagauguuuuacaucuaauuguagaauacuugauuuuuuuuguuuagaaauacaauuagaaaugauaaacgcugaauaaaggaaaaaugggauacauaaauuaaaauuacuuuucaaaaaagcauaauuuggugaaauaagauguaguauuagacaaaauuuugaaauuuuuaaugggugaaaugcuauguuauccuaagaaacaaacuaguuaaaauuggcagaauuucuugagcuaagaaaaagagagacagguacaaugaagcagaaaacauuguggcuucauuagugauagaaauagacuuguaagaagccaaaaacagugaaaaaacaguuaucuagucauugacuuguuuauuuaauauuuucacaagaaaagcaguuuguucugaaacuuacacagacugugaucuuauauauuacagucucauguacaguagagccgguugggcauauuuaugcccauuuacaguauugagcuauuguuuccugaggguggggucuguucuguuauccuuuuguccaacaaggccuccagcaauugcuuaauaauugcuaaaugaaccgcuagugcagugauucucaaacauuuguauacuccaguggagugguuauauauugcacaccugggcagagauguuauacaaguaagucuuaaauucugaaaagauuuuccuugcuuuguucuauuuguuugaggauugcucuuuugaguuagaggguaaacauaaugucaaguacuauguacauuuacaaaucuccuuauaaaugugaagucuucaauucugucuuuucuaucguuagccuuuuuaguuaaaaauaugcaaguauuucccaguuuuacuccuggggaacacuuaguguccugcagcagacuauaggaguaggauuuuccauuugguuaaggaacuacuuuuuucauuugaaccuuugaagcagguauaccaaguauuaaaauauaguaaaaucucauaauaugugcccucgaugacuauuaggacauucagcaauuuuuuuuuuuuuuuuuuuuuuuuuuuuuuuuuacucauuuguuguaauucucuugcugcuuuguguaguuauuacucucuuuuucuccauucuucacauauuuuucucaugauuuauaccuggauuugguaguuuuccaaaguuuaaugucaaucuuuuuuuuuuuuuucacuguauuacaagccagagggaucaaggugagauagaugacucaugaaaaaggcccauuucaccauguccuaagcccaugagaucaagaauauccugaaaugugggcuuugagguuuugacucugauuacuuugaaauccaaggaaggaauggaugauugugagaauaggaauggcggaaugauaggccuucauuugugugaaauuacauauauauauacacacacacacaucgggccauuucucugguccauuugaguaguagcuaagauuuaaacagucucagauucucugugcucuccaggugauaaagggguuaaggacuacagacaagacuaaagugguagacugaggucaggggauuaaugaagcaaaacuuguaggacauuguggccuuggugcucagaagaggucuucagcagaaguuuuuaugccaacucuuaaaucuugaugacagucacgaaucuuggaggagacugcuucucugcugccauucuugcauuggggcauauucucugggaagcacuugaaagugauuuuuuaaaugauauuccauauuauagaaaaaaauugacaaaggaccuggaaugguacuugaugcaugggaaguucucucuaaauguaaguagcuauuauuauuuuacuguuuuucauaauaggaaccagagaaucaucaaggaaggacuacaauauaaagugucauccaacaggacuggaaauucauagcauuucccucagauucuaaaaguauaauggauacauaauguaaccaaaaaaacccucuaaguuauaagacauauguggugacaauuguuuauuucuggggauaaaacguguuggccaggagagauaguuccucuuuguuacuagucaauggacuuuuaguuuuuuuuuuuuuaugaauuugcuucauauuccaaaauuagucuccauuuuaaucaagcaugccugcugggcagcuacaacuccagacuuucaaacuggucugguuggauggcuuauaaaaucugugacauuucuuggcacuuguuuuaaaucuguuccauggugugaauccuauaguaguucuagaggucuucuauuugagguacugaguauauaaacuguugaauaucugaaagauuguucugauguaucaucuauaauuucauuuaaaguuuuguaauggauucuccauguaauaagcagagaccuucauuuucuucauaauaggagaaauuuauugcauuuccauucuuuuauaaaauaauaugacuagcuuauuaccuauuccauacuugacaaaaaauaaaagugaauuaaauucuguaauuguuuauuaauaaaauuuuucaucuuuuaucacauugacuuuuaucacucuaaagugcucuaauaauuaaaacuaaaugaaauucugauaauuacaauucuuuaacuugguaaauuaaaagaauuggauauguugggauuauuacaacagauugguuuaaauuauguguuuguuuuuaauguuauuuuaugaaauuggcugcuugaaggaauaaacuaggauuacaaaguagauuaaaacuaaaacaagauaauguuuauaaauugagaaacaauaaauuacauauuguauuuccccuagauuuuugugguaucuacuucauuauucauguacauccuagauuuaaaaaguaacucuauuauuaaggauaauuuuccauuccuuucugguucaacuguaagggaagauuucuccccuccucucuugaaaaaggcucauuaauaaaaauaacucauauaacacuuaauaaaagccagauggugauuugagugcuuuacauauguuagcuaacuucguccugugaaguaagcaguaucgucugcauuuuucagagguagcacagagaggcuacuuacuuguccgugauugcacaguuaguaagugauagaggcuagcaguauggcuccaguccgugcuuuuaaccacugcuguauacuucugagggccaaagaugugagcugaucuaauugauuauuuuucaaaacagcuuuauugagaugucauuuguguaucauaaaguucaccaguuuauacaauucaauggauuuuaauguauuuacaaaaucaugcaaccauuaccauagucuaauuuaggaacaaauucauccccaaaagaaagcuuuuacuuacuugugguuacucuaccguuuaccuucugauugcuucccccagucccagacagccacuaauugaaauuucuguaucuauggauuuguguauuuuggacauuucacaugaauggaaucauauaauauguggccuuugugacuggcuuauuucacuuagcauaauguuuucaagguucauccauguuguaauauauauuguuaauucacuccuuuuauugccaaauaaucuauuguacugaugaguauuuuuugaaaccccaucuuuacauuuaucaaagacuucugugaaaauuagcaguuuguguguuucauuguguucuuguuuguauuuuggagugcuagauacguauuggaaauugaaagaguuaaaacugaggcucagagaaccagugauuuugaaucuuguuuuucaaauaggaguaaaaagagcugugccucuguuaaguuuuucaguuaauuuagcuuauaauuuuuuuggagccuaaacuaugaauugaguuuuuuucauauaauuguauuuucaacuugaauaauaagauggaugugauguacuucaaggcauuuuugaacuauauuugagaauauuaaaguaauauugccaaaacaauguaauggaggauguuacaaacuguuaaauguauucauacuguuuugauucuuaaguuucacaaacuggguaggagacaucaccagguauuugggaaguaucauagguaugggagugagagaaugugcaagaucucuucucugguuaguguggaccucuuaagcuaucuuuaucuuuuuggcuguuucuucucuaaaacguaaagauauuuuguguuguuguagagugacagcauauacugcaaagaacaacuugucaucagauagaguuuuccuuuuuauucucauugaaauaagguggucacuuaguuuuucugaguucaggcuuccucauggauaagucgucuaguuaacaaguggcaaaguugagaaccugaaaacccaagcuagguguuuuuguuacuauauuacaauggcuuauaauaacagauacaaguauaguaugucucuuuauucaucaaguauuuauggaauaaauagauaacaaugaguuuuggggcuuguggcauucugaccagcuuuaauuguagucaaaagaagggucugaaggugacguuuuauuuggaauaugggauuuuauggucuugaaaaaugauuuaaaaaaacauauauuuaaaaacuaucauucuuggacaguccugguuuacuauaugugagcuauuuacaauguuuucuuuuuaugcaucuuuaguguuuuucuguggccuuccaguucuuuuaagaaguuuuaaaaaagcacuauuuuguacuuuaucauuuuauaaauauuguggguauucugguauuuaaagggaugaaaauaccaguuuuuaacagcuaacaaaugaauugaaagauuuuguauuacuaaaacucagcagucauuugucucccucuagcgaucacauaacugugccacauugcccauuuacuuagcauguuuugauugaaaaccagaaaaaagaaguuuaauaccuuuuaaauuauguugcacauuuuauggaauuugguuuacauuuauuuaagauuguccugauuacaauuuuaauagaaaaucaguaguuccugcaaagauuuugggaagccuuuaauaucuugcuucauugagccugagaagcuaugguuauacaucauuacugccaggaaaaaaauaauccaaguaaacuaagacauaccguugauuguaagaugcaucuccauuucagaaaggauaaauugugggaaaaaaucagcauauaguuuuaguacaguaauguaaugucuuuguggauauuagucauugaaaugguuuucucauuuauagaagaaauuuuucuuaucagaauauaccaggacacauaaugguaugguuagaugaaacucauugauaauacaauugaaggaucauauguauuaaaaguuuaaaguuuagaauuuugaguugcgggaacuuaagucaaauggaguucuuucugauaaauggaauuuuguggugguagcuuuguaauaugucaccuugcuaggcugaacuuauuuuccagaguucucuucucuguaauuuguuuaggaugagacacaagagagauucuugcaugagauuugaaggcagaagugaagcagcagccauuuuuguagcuuauacaaguuguggcuucucuccuggcucaccuuguugguaugagguaguaguagccaggcugcaauugcccuaccuucuguggaauccucuuucaguuucuccaucucuuggguuaggucugucaggaaggaccccagcaugcucaagacaucuugagacuaucagggucagaauaaaaaccaacauggacuucaguuuucaguccguucuggugggcuucaucuggugauuguggauccuauuuuguucuugcuuuucccacuuuaugaugucuuucuugauugccugccuuacacaagcuaguuccagcuucuacaguuacacaagaucaaaucucuuagugucucucucagucugucuguucgucugucugucuuucucucucuccccagcuguuugcuuaucuggucaagcacugacugauaaauuuaccaugguacauaauucuuagggagauuuuaugcaacuucaaauuugaaauucuaguaauguaaauuaacauuuaggaaauugaauuaaccauuuucccuucaaaaugguagugguaccuuuuggaguacuuaaguauucuucaguguauuguaaguaauuuuaaggauucuuauaaagaaccaaccugguaaaaugcauagauaaagguuucugucugguauaauuuuccuucuaccugaaaggacuuucuuuaacauuuuuguagugcaggucuucuguugaugaauuuguucaacuuuuguauguuaggaaaagucuuauuuuaccuuuaguuuuaaaagagauuuuuguuguguauagaauucuagauagauaguuuuuguauuugaguauuuuagaaaugugguucuucucacguuuauuguuuuugaugagaaauucagugucauugguauuuuucuuccuuuauauuuaauguguuuuuuuccucuuacuauuuuuaagauuuacucuuuaucauugaauuuaagugguugauuauguuguguccucuuuauuuucuuuauuuuuuaugcuugggguucagugaccuuuuuguaucuguauacuuaugguuuucauuaaauuuugaaaauuuuaggccauuauuucuucagcuguuuuuucugucuuuccucuucuucagggacucgaguacacauauguuuuguugcuuaaaguuguuucagaguucacuugugcuuuuuuuuuucacuugugcuuuuuuuuuaagucccuuuucucucuguuucauuuuaaauaguuaaauuuuauuugucuccaaguucacuaaucuuuucuuugcaauauuuaaucugccauuagucccauccaguauauauauauuuuuuaucucagacauuguuguuuucauuccuagaaguuugauuugagucuuuuucaugucuuucauguuucuauguguuuacuguguucaauuuucuucuagcuucuugaacauauggaauacacauguuuaaauguccguucauuaacuugaucaucuggcucauuucuguaucaguuuugauugauuggcuuuucuacucauuauggguuauauuuuucugccucucugcaugccuaguaauuuuugauuggaugucauauauugugaauuauaccuugcuggguguugggauauuuuuuauauuccuaaaaauauucuugagcuuuguucugggaugugguuuaauuacuuggcaacaguuugauuuuuuugagccuuguuuucaagcuuuguuuagugguaccagagcagcauuuagacugggguuacucucuccccacuacugaggaaagacccuucuuucaauuagagaauacuguaauuguucucccaugaauuaugaguuuuuccacucuggcugguaggaauaaccacuauuccuggcccuuuuugaguuccaggcacuguucccuguaguccuuuuugggugauucuuucuccagccuggguuaauuuccucacacgcauaugcugaucacuaaucagcucaagacuugagggggacuccuugcagaucucucgaguucuuuuucuacaugauucuucucugguacucucuccugaaacuauucuccuuagcuuuccuagacucucaguuucucuccauaacucagggagaccacuggauucugccugaguuugccucuuugcccuguggccuuaaaagucucucuagacaguaauaagcuggagcaguuauagaggugaccucuguuguuucuuuucuuucagggaucacugaccuuuuauccugauguccaguggcuugagagcuguucuucauucaguuuuuuaguuuucaggugguagaguucauuugguucuuguuacuuuaucuuggcacgauuuuaguugcaucuaauuguguguuuuagagucgcuaucaggagaaauguuuauuuagaggagccaagauauucuuucucaagugauuugaauuaucugguauucuagguacccagguuuaaaagccuguaugguuuuucugcacguauuuggcauucuguucuuaguuuucuauuccaugguacucaaaguagcugguucagaaacuuuguuacuggucuguguuggaaugaaaaauguacacugcaauguauguaaaugcauuacuuucuucacugagaaaguauugcuaugaaaagcuguuaggugaacccaacagugugguuagugauguaguugauuuauauuuuguacaagugucuugucuugauauagccugguaacugucgguggucuaguacuguucgccuagucacacucuugaguagcugcuuguacuuuauauuacguaguuuaacaaacguggacuuuuauuuaauaugcuuuuuauuguacucaagaauauagauagguucuguaagauuguauccaggauuauucaguugcagauauaaaagaaagcaagcauccaaaagccaaccuauauuaacuucaguuaccuugauuuuuaaaaaacuuauacaauuggccaggugcgguggcucacgccuguaaucccagcacuuugggaggcugagguggguggaucacaaggucaagagaucgagaccauccuggccaacauggugaaaccucgucucuacuaaaaauacaaaaauuagcugagugugguggcacgcaccuguaguccugcuacucgggaggcugagguaggagaauugcuugaaccugcgagguggagguugcagugagccaagaucaugccacugcacuucagccuggcaacagagugagacugcguuuaaaaaaaaaaaaaaaguauacaauuuggaugguuuuuuguauauuuauagagucaugccaccaucaccaaaauuuaauuuuaggauguuuuuuaucauccugcaaagaaaccuugaguccauuaacagucacuccuuacauaccccugucuccagcccuagguaaccuugagucuacuuucucugucucuauauuugccuuuuuuuuaauauuuguuuaaugauuuugagguucauccauagaucaguacuuuguuucuuuuuauugcuuaauaauauucuauaucuugauguaaaauuuucuuuuuaaaauauagagacaaggccucacuauguuucccagcuggccucagacuccuggacuccagccauccucucaccccagccucucaaguaacugggacuacaggugugcaccacugugcuuggcucauaucuagauuuuugauuuuugaggcaaauaucuugaggcacuuucugacaagugcuuugcuguuuugagauccucuaccauauguauuuguugcccuucaaauuggcuguuuuuggauuaaguguacucaguaucauagcaguguuugaacuagcuuuguaauuucccuauuuuuggcuuuuaguugcuacauuuucucuucaagauucagauauuuaaaguaauuuacaauaguaguugaauuuggguaugaucagugaugcauaucuuauacuuuauuacauagccaauuuaauuuuuugucuuaauggcaguguaucagaugaguuacuugauuugaauacuagucagggauaaauaaugaauuagagugaagacaaagaaacccaacaguguaaaguuuuuguuguucuuaauguaacagucuaugucauaagucauugaagucuggggaggggaucgcagauuugcuuugcaugauuauucgggggccuuguuaccuuuuauaucauuccacugcccacccuuagauuccuagagaauuuaugucuucgugauagaaacuuggucacugacauauccugguuucagcuggaugaaaggggaaagagaucuuagacaaggcaugaucaauaguguaaguuauagagguggaaguaauauauaucauuucauuuauauuuaacugaugauaauuuagaugacuauaaugcauugcaagagaagcugggaauacaguauaguugggcagugauauguaguuacuaugguugaaaggaggucauaauuuggcagacaaccagcagucucugccacaacacacaacaccaauauaguagucuuugaauuuagcaguuugugaaugagaucuggaaguuaucuuuggagaguaucuuauaacuuaaucuauuuauuaguaccacuguuaagaaaggucauaucaagaguagauaaaaaucaaauuaccaaaauuucaguaccucaauuauuaaaauuuucaguuauuauuuuagaaaacuuuuguuuaaagauauuggaaaguugaaaucauucucaguucuuccauuuacuagcuguguaaccuuugauaaacuacuuaacuucucuguggcucacuuuucucaugugaacgagccuuauagucguuccuaauucuuaggccaugugcucaucaaaugagaauguauuauacauaaagcacauaacauuuccuacacaguagcucucaagauagcuguuauuguuaucauagcauuagguaccugguuuuggacagaggcaguuuaaggcauuuaguaucuaauacauggaauugccaaaaaccaguuuugaauuuaugaucucauugaauuuguuuuuguuuguuuuugccaauugucaucaagaaaagauacaaaaggcuuaauuuuaauacauggggugaugauuauaacuuauguauacauagcaauauauuucuuucaagccaauuacuuuaauuuuguaccugcuuuacaaaguaauaguuuuaagaaacucauaauauauuauuucuacaauauauuuauauacuuuuaaacccauaauuuuuguauugauaaguacagaacuguacaaugaagcauuuucauaguuuauuucauaagacuacaucauugaguaguucccauucaauuuaauuaaaagguaauuuuaaguaaaguuauacuacccuaaauuuuuuuacuuauucccuaacucuuuaaaaauguauaugaaaccuaauguuaaaaaaaaaucacuaguuuguggaauaaauucauauucaggaaauaauuuagacacuaauauauuuguagccugucucucuucccccuccucuccacuccaaccacaaaaauagugcuuggaucuguuauuuucuguaaaaguugaauuuaaguacauuuguucauagcagauuuuucagugaauugaagguagcccucacauuuuuuacuauagucaugcaccacuugacaauggggauacguucuuagaaauguguuguuagaugauuuccucuuugugcaaacaucauagaguguacuuacacaaaccuagauaguauauccuacugcgcaccuaggcuauaugguauaaccuguugcuccuaggcuacaaaccuguacagcauguuaguguacugaauacuguaggcaguuguaacacaugguaaauauuuguguaucuaaacauaucuagauaucuuagaaaaggaaagguacaguaaaaauauuguauaaaauguaaaauuuguuauaccuguauagggcauuuaccacaaauggagcuugcaggacugacagugcucuagguuauucagggagugaguagugagugaaugugaaggcccagggcauugcuguacacuacuguagauuuuauaaauauuguauacuuagacuacacuaaauuaauuaauuaauuaauuuuuuuuuuugagacggagucuuacucuguugcccaggcuggaguacagugcaguggcgugaucucggcucacugcaaccuccagcuccuggguucaggugauucuugugccucagccuccggaguaacugggauuacaggugcacgccaccacaccuggcugauuuuuauguuuuuaguagagacaggguuucaccauguuggccaggcucucguacaccugaccucaggugaucugcccgccucggccucccaaaaugcugugauuacagacaugagccaccgcaccuggccagacuauacuaaauguauaaaauauuuuuuucuccaaaaauaaauuaaccuuagcucacuguaacauuuucacucucuuuuuaaaaacuuuuugauucuuuugaaauaacauuuagcucaaaacacaaacauguacagcugugcaaaaauauucuuucuuuguauccaaauuccauaagauuuuuccauuuuaaaaacuuuuuguuuucuuuucuuguuuuauuuuauuuuauuuuuuugagauggagucuuucucugucgcccaggcuggagugcaguggcauaaucuaggcucauugcaaccuccacgucguguguucaagcaauucuccugcuugaguagccucucaaguagcugggacuacaggcacacaccaccacgcccagcuaauuuuuuuuuucuuugguauuuuuaguagagaugggauuucaccauguuggccaggcaggucuugaacuacugaccucaggugacccacccaccuaggccccccaaagugcugggauuacagaugugagcugccacaccggccaaauauuauauuuuugucugguggauuuguagaaaccagagaagaugucuuuauagucuguguagcugucaucauaacuugguauuauaguugauuucaaaauuagguguuugagaaaagccagauuaaguaaaaugagugauauuugauuuaaaaucugacuagcaauuuucauaaauaauuguuuugucaauaauuuguuauuuaaaguguucaggugcuaguuuacuaaauuuuacucuguguaugugugaaucuagaauaccauaccuuuuuucuagauaauuguuagugauacuguaucugguuucuucauaugcuuuuguuuauaaucagaauuuuauuuuuuaacaugagaauaaaugugcucuguuauuuuaaauacuuuuaaaauguguuuagccaccuagaugaaugauucauaaucuuuuuaucggguuauucauaagugagaguuaugacuugugggaauugguaauaguggcucauggaaacagugauuuuuuuaguuuaggagugggaggaaagucccugcaugaaucugaaguacucaaaucucuuuaucucccuuugccccaauuuuuaugauuguuuucauaucggcauacaauguagcaggcuuaauuaucugauggagguuuucuuuguuuuaauauuagaauuaugauguccuuuuggcaugauuuacaaaugacuaaaaguguuuuagaaaaauugucuuuuagauuuuaucuuuuaaaguuaauuuuugaaagcaugauuccuaguuguuugaaauggcaaagcucuuagcuuuuucaugcuaagaacgacggagccacauugaagaugcuuaugcuuaacucagacgugaaaacuacaggccugaagaauaauccuuacuuuaucguuuucauguguuuugaaaggaggcuuguaugcugggaagcuaucaggugccuuuaugggcaccagagaaagucuaagacgcuuguuguagucagaguuaauuuauaauucacuguaaaguuaacugacucaaagcaauuaguucaugauuuacauucaguugcuagugauuuuuuucucuuuuccuaugcauuuuguagaaugcuguauacccguuauagggcuucauuacuuacaggauuggaaaguaauuuuguccuagggagaaauacuuggguuaaaucuguaguguauuugcagugccaagagagcacuggugguaaaacuaaaaauaaaaaaaaugugaacauuauuuagaaaccucucuggccaucuuuauaaaucaacaagacaaauccugaaaaugugcccaauuucacagcaaucauuaugauugcagaggaaauaaauauuauuuguuuuuuucucugguauuauggcauuggaaccaaaaaagcauuuuguacaacaguuuuugguuaguguuacaaauucagucagacaaacauuugcuuugaccaaaaauaagucaauaggguguaucugacuuuuagaaaauaauguagcaauguucauauucuagcaagauauuuaaaaugauauucuaucaagaaaauacuugggugaguucuuuuaugugaauuaaagugaauuauaaauacuauauaaucuuucauacuuuuaacuuggcagaacggugauuuuuuuaguuuuuguugcuggguagguaaguauuacuguuuuggggagaaauuuuaaaauuguucuuuaauaaaaauaauuuuaucuuaauuuaccaauucuuuuauaauauaguuuucuauaacaaagcacuucccuauauacacuguuauauuugagucuuaugaauuguccauuuaaaguagaauauuccaaguagaaauucaauucaacauucaauuuguugcacuuacuaccucuuuuauauuugucuuagugucuuugaauauuuguuuaggccucugagucacacuggcaagaagauuaggaacauggcuuuaggcauauguuagugcuuugauggcaguuagugaccugugcuagaaaaaguggguguuaaccuugauggugucguguaagacuugauaugucgugacuaauuuuuaaaauuuuuuucucauuuuucuugccugcccccugguggagaaaaguuaguaaaaucaacauacaggguacaugaaaagucugaagguggggggaaaauguauauaaauaaacgaaucauugcucaugccuguagucccagcacuuuuggaggccgaggcaggaggauuguuugagcccaggaguuucagccugggugacauggcaaaacccugucucuauuaaaaaaaaaauuagccaggcgugguggugggugccuguagucccaacuaccugggaggcugaggugggaggaucaccugagcugugauugugccaccauacugcagccugagugacaaagugagaccccaaacaaaaaacaaauuaucgauuaauuuaguauaugaaaauuuaaauauauguuaucauuucaaguuuuauagucuuagcuucucaaauuuggagggaacaaaugugggauuaaaauucuaagaauacauaguuuucuuaaagauaugcaaauuugcuuuacugauuauguuucuguguuuucucaaaauaccuuguugucacuucucagggucuuacugaaguaacacaaagcuuaaaaauggaaaaugaagaguuuaagaagagguucagugaugcuacauccaaagcccaucagcuugaggaagauauugugucaguaacacauaaagcaauugaaaaagaaaccgaauuagacagguauuucucaugcuuuuaaaaaauaaauucaauaaaaauuuuaaaacuuuaaaacauuauaauguuacuuuaucauaccuaucuuaguuuaaaggacaaacucaagaaggcacaacaugaaagagaacaacuugaaugucaguugaagacagagaaggaugaaaaggaacuuuauaagguaauuuauuuuuuaccauaucuauugccuguugcuucaaaagaaaugaccccagaacuuaggggcuguaggucagcaauuuaggagcagcuuagcugagugguucuggcucuagccucuuguguaguugcagucaggauguuggcaaggggugcagucagcuaagggcuugauugggacuggaggguuugcuuucaagauggcuuacuccaguggcuuuuggcaggagaaccuucagcuccucuugaaguggucuuuucauaggcugcuugaauauccucacagcauggcagcuagcuucucucagagugagugauccaggagagagcaaggaggaagucacagucauguuguauaucaccccuaaaaguuaguuuucagggaauuaauuugcugcuguuuuagauacuuaacagguaguguguaauaaguugaagagguuuaauggaauuaagauacuuguuuaucacaauucauguaacuauuuuuccuuuuuaagaacauauauauauauacacauuggggagaacauuaauuuaguaauaaucccauuuuagaguuugacuuuuagaauaucuucagagaugucauuuuguaaaaauauccucacugcuaacaaaucuugaccgcuugaaguuuugaauuuuuuuuuuuuuuuuugagauggagucucgcucugucgcccaggcugaagugcaguggugcgaucucggcccacugcaagcucugccucucggguucacgccauucuccugccucagccucccgaggaccugggacuacaggugcccgcgaccacguccggcuaauuuuuuguauuuuuuuaguagagacgagguuucaccauguuagccaggauggucucgaucuccugacccgccucagccucccaaagugcugggauuacaggcgugagccgccgugccuggcaguuuuuauuuauuuauuuuuuuaagcaacccugaaauauaggguaguuagcuuaauugucaguaaugcugugggugcaaauugagacuuauuuuuuuaaguggcucauaagcauuuccugaaggcaauuccagaugaggaauuucaagaacauucugaguuaaguccguuucuuguuaagucaauuuaaugagcugaugauuaugaacaucagguagcguuuuaaagugaugcugcaaggguguugguugcugaugucuucagagaaucaggaguuaauauucuauccuugugaacaggaauuaguccuucagcauucuguauauuuaaagaguaaagugcaagaaguaaguuaauucauuucuccucaguacucuuaacgaaagcaggauauacuugauaguguacacuacaggucuguauuuauaauuccaguuauugaauuugauuuguauguguguuaggagcaaaucagcaauagcgagagucaugggaaaaucaauauaguuggguuagucaacaaauacauuuuucagcacauugaaacuaaaugauaucguacuuuucgccugcagaaaauggaauuguuugagauguuguuuuugaaugcaccccuucuaguuuuccagagucuugucgugccagauuugaauaugccaaauaacauaauuuguuuccccaaaagaacaaccaaaucuauuugcauuuuuaaagagaaccugaaaccauuaaaucaaaggaaaagacuuuagagaucaggugauguuguuagggcuuagaauaaucucucuggaaaauaaaaaagcuuagaaaagcuguguucugcuccugcaugcuuaacuagucauuuggcagaaccugggucuccuaaauccuagucuaguaugucuuuccuuccuuucguugucuuuggguuagaaauauaaugguauuuuaaacuuugacuaacuuaggucauggaguuagaauauucuugacauuuucaaacaccauuacagguacauuugaagaauacagaaauagaaaauaccaagcuuaugucagagguccagacuuuaaaaaauuuagaugggaacaaagaaagcgugauuacucauuucaaagaagagauuggcaggcugcaguuauguuuggcugaaaaggaaaaucugcaaagaacuuuccugcuuacaaccucaaguaaaguaaguacuuuugcuauauauauuugaagauuguaaaacauaccuaugaaauguaugcaauaugauuuucauuuuuaauucccccaagcuuuuguucuaaaaaaguucaaacuuacaaaacaguuggaagaacagaacaaugaauacugauguacccuaaaauauuuugccauucuuuguuuuaucucccucauuuauaugccuuuuuuucugagcgaugugaguugcaaguauuacgauaauuuacucuaaauacuuuagcaugucucccuuaugaacaagugcauucuucuucauagccaugacaccguuauuacaccuaagaauuuagcacugauugaauaacagucauucucauaguuaguucacaaucacauugccccaaauguauucuuauauaaucuuuaaaauuuugugauucacaguuagucaaagacuacauauuauuuugauuguuguauuuugagucgguuucagucuagaauagugucccuacacuuuuuaugacauugauauuuuuggagaagacaggcuagucugagaaaauguucuauaaucuggauuugucuguuguuucucaugacuagauucaggugagacauuuuugcaagaaaagacauagaugauguuuuguccauccuguuggagucauaucaaaaguuauauaaugucaauuuguuucguucuugauaauguuagguuuaauaauuuguuuaaaguuaugccuaccugucucuauauaggugccuuucuuuucuuucccuguuugugauuauuaagcaaucuguauaaacacccuguucuccaacagccuuuccucaauguuuuuauuguccuuugaugcuccucaccugcaucagcuauuauguugguaauaauuaaugauagaaaaauggugauuuaaaaaauucuauuaugccuucuacauuuauuuguagguaaucuuuuaucaugaggacauuccugucacccuucccucuuuuuuaaauauaacuuuggacuuacugauuuuuugcugcauauuaugcauaaucaucauuauucuuuuucauacccaaauuguucugaauuuaaccaggggaaccuuuucaagccugcuuuuuuguccugauauguuccuauaaugcuuugaauacuuucuugcuuuauggcacaacuguauguucuaacuucagguuguucccccagaccugauauuaccauuucuccaagaaacucuguuuuuuuuaguagguaaugguauuuugaaaccaagaacuggauccuauugcuacuauggggcugcugcuuugcacauucaguggguauuuugcaucuuuaauuuauauugauagcuccaauucagauuuaguaccuuaggauucuuccuuccuuugcuccauuccauauuuauaucucucuucucgcaaugugagaacucuuguuucccaaacaucauuauuacucauguguuuccauccagccguacacaccaguguuuucacaauuauuacaucaaugccacuuccaacaauaaauguacuaaauaaagcuaagguauuuuuacagcucuuuuuucuuagaauauguuucacuaaggauguauagaaacgccauguucaaaaguuacuugaacuauuuuuuugcauaccuauguuauaaauuuguaauauaauuucauuugcuuguauuuaauuuuaauauuugcuuuuauucuucuguuugauuuauuuuuauuguuugaauauguaaaacaguugcuuuguucagaagucaaaaugauagaaaaauuuuacucugaggucucaaucucuuccuuguuuuuuuaaacccuuuucuuaccuaugcccauagauaaacauuuucauaaguuucuaguuuauucuuauguuucuuuuuguaaaaauaagcuuauauaugcauguguacauguacauacauccuucuuuauccucuucguucuuaaaaaagguagcgcuacuauacauaccauuuugcaccuuuuucucacugaacaaaauaaguugcuaguuacuccauaucaguuuguagagaucuuccucauuugaaaaaaauggccacauaauauuccauuauauagauuuaccuugauugauucauuauuucuuaugauguuauuuuuaguaauuugcuauuaaaaauacucagacauaguuaauguaauaccuaaaacgucagaagcgcaugacauuuagaauuaaugguuaauccuuguuacuuuuuaauguaacagauugccagugcaaacaugagaaguguauuugauuauuuguuauuuaauaagaugcuaaaaauuucucuaagcaucuuuuuccuauuuaagcaagacuucugugaggaaaagcguaguuauggaaguaccugagaaaaaugacuacuaguugcuaaagcuuuuaaaagauugugaaaguaguuugaggugaugguuauaaaaaaauuuaaacaguacaugaggauacaaaguaaaauguaauccucaucccuucucagauaaguaaguuauuauugaauuuaugaauauacguauauuuauauuuuaacacaaauuagaauuuauacauuuuuuccuuuuaaaaaaauuuauaaauggauaucuugcacuaugauacacauguggaucuuuuucauucaucauaacaacugccuaguauuucuucucuucauuuaacaacuguguaguauauguuuuuugauuguuuuugauuguuuauagucuucagcuuuuauaagcauccugcaguaaacauccuuauagcaauauguaggcacauuuauaauccguagaauaaguucuuucaaguggaauuacugggucaaugaguauuuaaauuuugauaguuauuuucaaauuaccuuucaaaaaaauguucuauugauuuuuuuauucccaccaagaguauaugagauauguauuguuuguaaugucugcacagacuuugauuauauagagguaguauaucauaguuuaucauaaauucucauguugguagacauuuuagguucuuaaugauuuuucauuauuuuaguauuuuauugaauccuuguaaagcuaaaccuaugucuauacccuuugauaauuuucuuggaaacuuauggaaauaaaauugcuagaucaaaagcugugagaauuuuuaaggugcugaugaauguuguaaauaucugaugagaaaagaugccaguuacaguuuauauaagcccaccuguuugugaaugugccaguugcccuaaacccaugcaaauauuggaauguuacuguuuuuuugaucuuuguuaguuugaaaggugaauggcauuuguuuuaacuuauuuguuugauuguuggugaguugaauuuuuuuacugcauaaucgcauuuauuucuuuagaaaauuuuguauguucaugacuuuugacuuuuguuuuguuucuccuuauugacuagaaaaguuauuuauaucaaguauuauuauaccuuucuugaauauauuacauauaauuuucuucuaguucuuuuucuucuccuuugacauauagaaguuggcgaucuuuuuauagguagaucuauuagugugaugccuccgaagauuuuguccaugccaacacugcauaaaaucaucauuuacauuuccuucuaaggggcuaacaguuuagaaaccaauauuggguugcauuuuuuuccugauuuuacauuauuuuuaguacagagauuaaaaacaggaaguugaauaaacuaaauuuauuguguuuauaauguuuaaauguuauaauguuuaaacauuaauauuaaaggaaauaauuucaccauggcaauuuuagcuuuuuaaagauacuuuuagguuugucaagcaguaugaauuacuuuucauuuucccaaugccucgucuuuacuauuuguauaucaauauuuuguuuuuagaacuaaggccuaaaucuguucuguguuuuuauaaugauaugaaauagauuuauauuauauuggaugucucuugggguagaaaguaggaaacaucuuuuaaccaaaauuuuugguguuacaaagaagcuuucggaaugauuuuuacugguagucauacaaaaugagggucaguauuucuagcugaagagauucugggggaugggaucuuuuguuugagccucaguuugggcagguccuuaagcacuggguauguugccugacucgcuguacuuuagcuuccuuguguauaaaguaguagcagugaaaccaaguacauaggguuguuauagagggaaccuaaaacaaaguuacuucuuaaguuuuuuguaggcauauacucuguaagucaugaguagaaaaaccaauaucuaaaauuuuggcccuguugaaauaugugcgaaaauuguuucugcuucuguuuuuuacuugagugguugaauuacaaauauauuuaucugcuuucuucaggaagauacuuguuuuuuaaaggagcaacuucguaaagcagaggaacagguucaggcaacucggcaagaaguugucuuucuggcuaaagaacucagugaugcugucaacguacgagacagaacgauggcagaccugcauacugcacgcuuggaaaacgagaaagugaaaaagcaguuagcugaugcaguggcagaacuuaaacuaaaugcuaugaaaaaagaucagguaaaacaaguuaauuuugaauuugcauuuugauuuaagaaaccacuauaaucucacaaaguaguaaauuguguuaagauaagacaggucagauuucugccuuauuuuaaauuuaaaauuuucauuccuuuuguuuagucauugugacuucuuggcuuacaguuaaugugugcuguaaggaaaacuucuguaagcagaauucuuaaugguuggugaaagcugcccuauugauuaaauauauugaugucagauauguauuguuuuguuuggaauuucuuacuagcuguauaaaacaguauuaugguuguuuaagggaguaauaauugcucuucaggagguggauuauuuuucucuaguuuuuuaaaugaaccuuaguccuaagaauguaaaacuggacuuaacaagagacccuauguugcucuguagccaaaaucccaaaauaaaaaaguggccggggacaguugcucacaccuauaaccucagcacuuuggggggcugaggugggaagaucgcuugaucccaggaauucaagaccagcccgggcaacauagugagaccucaucucuacaaaaauuuucaaaaauuacccaggugugguggugugcagcuguagucccagcuaguccaaaggcugagacaagaggauugcuugagccaggaggucaaggcugcagugagccauaauugggccacuguguuucagccugggugacagagcaagacucugucucaaaaacaaaaaaaagaaaaaaaguaagauugaaguugggguuacuauuaacauuaggagguaucagauuuuuauuuuuuucuucaaauguuuguuucuuucuaggacaagacugauacacuggaacacgaacuaagaagagaaguugaagaucugaaacuccgucuucagauggcugcagaccauuauaaagaaaaauuuaaggaaugccaaaggcuccaaaaacaaauaaacaaacuuucagaucaaucaguaaguaucauuaaauuuacacauaguaaaauguguuguuaguauuuuuguucgaaaaucaaauuuguaauauuccaaauaucaaccuuuuaaauauuauuuaucucugcuugauuucaagucauuggccaaauauuguaauaacucuucuuuaaaaaagucuggaauuuuaauuuacuggacagccaacaaaggaagcaagggcaguagcaaggaaaaaacagaaaaaagucuucuuuucuagauaauuucccucuuaaguucuugauaaauaucugucacucaaaacucaauacuuauuauugacucuugugaccaugacaucuauccucauuggaguucaccauuaaucaucccuaggucuuagauggugucucaguuguaauuggcaaguucuucauacucauauuaugaagauuccuauuccuauuagauuaggaacaguuaaagaguguuagcuaauucuuuuuuauuccauuugagaauagguagguagauuuguaauauaccaaagaagauguuuuuguuuugagguauguauguuucaauguggguccuuaaacugugcuuaaauacaaggcuuacuaucugaggaacuccuggaaauguagaagaaacauauuuaaaaccugaaauugaaagugguacuauagcucucuuuuacuaugugaugcauaugauacuuuccugguccuacuuuuuuaaaucagaggagacaagcaaggaaugcauguaguaaaguaggaaggcuuuugugaaaaaauaugauacuuuaaguaugacucacucacauguaugaauuuggccuggggccuuuugaguacguuauaacuuuguaguagauuucugugaaugacuuauuuugguggucuuuugaugaguuuauaagaaaaagcaaaauauaguauauuucuuuugcaacauuuaggucaguuagcaaaaugauguguauaacuuuagucuuuguuggcuuuuaaaacaagagcagcuuuguggacuucuuaggauuuccuaaaguaauauguaaaaauauuauuuacuuaguuacugcaaggaggaaauauaacuaauucauugacucauuuaacaacuuauuaacauuuugaauaggcuaauaauaauaaugucuucacaaagaaaacggggaaucagcagaaagugaaugaugcuucaguaaacacagacccagccacuucugccucuacuguagauguaaagccaucaccuucugcagguaaaaaucuuuuagacuuuuuguguaggguguccuacauugaaaaguacuuauacugccuucuuccauguguuagaauuucaggauguucauaaaaauuuucaugugauaagugaaggaauugaggcaacaagaaaauaaggguauaaauguaaaauagagucaugcaaguggugaauauacacaacaugaacauauaaaaugugaauguaaacuaguaguuaucuucuugagacuauucacacauguuaaaaaugagcuggugcuugugaguacucauuugggcuacauaggacaaaagccacgaauugaauuuuuacuuuauguuccauuaaaucuauggaauuuugaagcauuuuauuuguggauuuuaauuuuuaaauucugcaggggaaaaaauccccuauuauucucauauuuuucuauuuauucauuuauuuuuggcugcuuuggaucaauggggguacuucuucccuugucaauguaccuguuggcugaugaguuaaguuuuuauuaguuuauuaacuuauagaacagaauagagagacauagugagaacauuaauaacaugaaaacuuggauuaacuagguuuucaucuguccugauuuuuucacuuuuauguaaauuugacaguaaugacguuaaauacuagagaaaguauauuuucuuguuuaguguguguaguaauugaucuuuuaagucuuuuuaaauguaaacaucuuagacuauuaaauauuagguuuauccccuguaggacagaauugagccuucuguuuccauguauccucuguaguaccuaaaaugguguuauaggguauuuacuuaauaaagacuuagugguaaugaagggcuagaagaaugauuuaaaauguguucuuggugggguaugguggcaugcgcuuguacuccuagcuacucuggaagcuguggcaagaggaucacuugagcucaagaguuugaggcuagccugggcaacauagugagacccuggcuuucagagaggggaaagagaauucucagaguaugguuuuccuacuuacccugucuauucaguuauauaaggagaacaauuuuugugcuguuauggaacucuuuuuagcaaauuuuguuuuguuuuguuuuugagacagagucucacucugucccccaggcuggagugcaguggcgugaucucagcucccugcagccucugccuucuggguucaagcaauucuccugccucagccuccugaguagcugggacuacaggugugugucaccacgccuggcuaauuuuuuguauuuuuaguagagacaggauuucaccguguuagccaggauggucucgaucuccugccucggccucgacccgccuuggccucccaaagugcugggauuacaggcaugagccaccgugcccggccgcuuuuuagcaaauuuuuaaaaaaucaaagaauaauccuuuauuauugaaugcgaacuugguucuggccaaacacacauuuaacaauucucaacuagaguuuauauauccuucuuuguauaucuaggauaugaauagauauuucuguccuucagcauuccauuuacuauauuuuacaguauacugaccuuuaaguuauucugaacaggaagauaauauaaggggcaaaauacuuuuuaacagucuuauauucugccuuucuacagcagaggcagauuuugacauaguaacaaaggggcaagucugugaaaugaccaaagaaauugcugacaaaacagaaaaguauaauaaauguaaacaacucuugcagguaaguuaacuaccuuguaagugaaagagauuuauaaaauguuaaugacuuagcuuaccuuuauuguuucaauugauugguaucuuugaguuucuuuuccaucuccauauaguguuacuuaguuucacuuuggcuuuugggaugaugaggugggcguuuuguguaccuguucacauaggcguguguguagcaucaugagaccuaaaguuacuauuuucuuuucaccuaauaaaauguucuuguuuggguaaugggcaaauaguuaauugagguuagaaauuaucugucaucguauaaagaugcaugaaaaauauuugaacuucauaaaagggaagugcuguuuuuaaauuuacuauuaucggccaggugcgguggcucacgccuguaaucccagcaccuugggaggucgacguggguggaucgcuugaggccaggaguucgagaccagucuggccaacauggugaaacccugucuguacuaaaaauacaaaaauuagccaggcugugguggagcaugccuguagucccagcuacagucuccugaggcaggagaaucacuugaacccgggaggcggagguugcagugagccgaguuugcacacuguacuccagccuaggcaacagagcgagucucuaaaaaaaaauaauaaauaaaauaaauuacuauuauaauagcaaagauuuuuacaucuuaaagugacuagacuugcauaguggaaaagggaauguuaaccaaaugaauugucucuuacgguguuuauuuugauuauuauuauuuuauuuuauuuuuuuuuuugauacggagucucacucucucgcucaggcuggauugcaguggcgugaucucagcucacugcaaucuccgccuccuggguucaugccauucuccugccucagccucccaaguagcugagacuacaggcgccugccaccacacccagcuaauuuuuuguauuuuuaguagaggcgggguuucacgauguuagcuaggauggucucuaucuccugaccucgugauccacucgccucggccugucaaagugcugggauuacaggcaugagccaccgcgcccggccuauuuugauuauuuuaaacagcuucauucagacuuuucugguuugcagccuucuugguguaguauucaguacuggaauauuuaaaggaaaagggaaaaugcuucucauuuauaucaauuuggcauagagaggaaaaaguguuguuugugcaagugauuuuuguuuguuuuuuuaaaugugcuuuguguguuuuugugugcauuggggaggggaggggcauuuuuuagagcuauagaauaaaauuuacacauuagcuucauguuacuguaauuuaauuuacaguaauuauuuaaaauauuuuguugcuuauaaauagcaaaaucuuuuaaccaaaguuaaaaugaauuuuuuuuuuugcuugagagaauccuguggaaggguugauuagaacaguuuuacucuugaauucaggguaguuuuuuguaagagugaacuacauuuucguuaaagaugaaacaauucuggaugaauauuucaagauuuuucuauagaaauaguauugaaaggaagauagaauaauguucaagcaaaaaccuuccucagggugcuuuuuuuuuuuuuuaaacaaccauauugagguauaauugaaauccaaugaauugcacguaccuagaguauacaguuggaucaguuuugacauacacaguugugaaacuaucaccacagugccaucacucucccaguuuuuuugguaccuguuugcaacacaucccuuucguuauccuuaucucuaggaaauuauuggccugcuuucugucacuaucaauuagccuaccuuuuagacaauuuuauaaaauggagucauguaauauguacuuuuuucuacccacuuucagcaugauuauuugagauuuauucauauuauugcauauauuuauuccuuuuuuauuuuaucauuuguuuauccauucaccacuugauggguaguugggguuguuuuucggcugguacaaauaaagcugcuuaugaacauuuguuuagaaguuguuuauggacauauguuuuuuuuuguuucuuuuggguaaauaucuaggggugaauugccugggugauauuguaguugaauaacucuguaagaaauuaccuccugggugcaguggcucaugucuguaaucccagcacuuugggaggccgaggugggagcaucacuugaggucaggaguuugugaccagccuggcuaauauggugaaacccuuucucuacuaaaaauacaaaaauuagcugggcauggugguacacuccuguaaucccagcuacaugggaggcuggggcaggagaaucgcuugaacccgggagguggaggucgcagugagccaagacugcaccacugcacuccagccugggugacagagugagacucugucucaaaaaaaaaaaaaaaaaagaaauuaccaaacuguuuuguaagguguuuguaccaucuuacauagccagccuaauggguguguacugauagcucauugugguuuuaaugugcauuuguauaaugacuugauguugagcaucuuuucuuaugcuuauuugcucuuuaucucuuugugugaguggucgaaucuuuuugguaguuuaaauauaggguuguucaucuugaguuguguuuuuuuuuuuucuguauaugucuuuugucugauauauguaaggugaauauuuucuccaagucuguagcuugccuuuucauuuccuuaaugauguuuuuagaaaagcaaaauuuaaauuuugauaaaguacaguuuaucaguucauuuauguuuuaugcuuuuuaccuucuaaggaauguuugccuaauccaaggagauaaagauuuucuccuguguugucuucuagaaguuuuauaaucagcuuuucuauuuaggucugugaaucauuuugaguuaauuuuuguguauaauauggaauguaugguauggauauuaaacugaccuagcguuauuuguuuaaaagauuuuccucuccauugaauugcucaaaguauauuuuuaagcguucacauugaacaaaauguuccaaauggaauuggccuaauuaccuuuuugucaugauuuguaaguccuccuuuaagauaaucuggguuguagagaagagcaauguauaagaagucaaccuaaaaauuaucuuggucagcaaauccuagaguuuaucacugcauggaaacaacagcauuauaaauaugacuuuauuuccucccuuugcaaaaguaauauauacuuauugugaaauguuguaguguuccagaaaugaagaguagagauggcaaaaauuaccucuaucauucugauccccugagauaagaacuauuaauauuuugguuuauauuuuuguauacaacacaaacauauagauauuguauuauaacuguguaaaacaacuuauaaacaaaaauggauuauauauucuauuuuagcaacuugcuauuuucaauuaauguaucuuaacauuuuuucuugucaauuuguacaucugccuuauuuaaaaauauauauacuauuucauuguguggauagaaaaugauuuauccaauugucuauuaauagacauuugauuauuccaauuuuuaugcuguuacaacaguguuauaauaaauguucagcccauaucuaaguacauuaguauagauuuucacucuacaugaauuuaaaaucuuuugguaauuauacuaauuucauuuaggaugagaaagcaaaaugcaauaaauaugcugaugaacuugcaaaaauggagcugaaauggaaagaacaagugaaaauugcugaaaauguaaaacuugaacuagcugaaguacaggacaauuauaaaguaaguuugguacuccuuguauguaaacuuaaggcauaaacuucugaaaauuaguuauguauaauuuuauucaaucuaauguacauuuuaaauauggauaauugauaguuuuuucuacaaauaaaaauguacuauauauuuaguuacauaaauacuguucauuaacuuugaauugagaaaauggauaccauuugcauugcuauuguggcuuuaauucuguggguucagauggcuauuaaaauuacaucuuuuaauuguguuuauuuuuaaaguugaaaagugaucauuauccuccuguucauuuugaaacaaacaugaaugcauauguaaaauuauuuuaggauggcugggcauggugacccacuccuguaaucccagcacuuugggaugccagucugggaggauugcuugaguccaguaguuugagaucagccugggcaacauagggagauacccaccccccuaccagucucuaaaaaauaaaaauuaauaaauaaaaauaauuauuuuagggccuugacuuuuuuuggaguacaauaauaugucaucaguaauuuuaaaaauuuggcuggaguuuuaacauuuaucacuaaaguaugugacugugauccuaaaugaaauacuguaaaagcaagugauguaaucuuaacugaugaaaauuauuuuugccaauauaaucuuaggcaacagacaagcccaaaugauaaaugauacuguaagaauguuagagaaggucaggcaugauggcucacgccgguaaucccagcacuuugggaggcugaggcgggcggaucacgaggucaggaguuugagaccagccuggccaacauagugaaacccugucucuacuaaaaauacaaaaaauuagccaggcgugguggugggcaccuauaaucccaguuacucgggaggcugaggcaggagaaucgcuugaacccuggaggcggagguugcagugagccaagaucaugccauugcacuccagcccgggugacagugugagacuccgucucaaaaaaaaaaaaaaaagaauguuagagaaaaaaaaaaaacaggcuguccagcuacuuaauaaguagaaauauguauuucuucuaaggaauaaaguauaauuuaauauauuuuaagaaauguauguagauauaauuuacauuuuuuuuuuuuuuacugaagaccaggaauucuaaaugguuuaaauaucauagcuaauuguaucuaugaucuaauuuuaaaguuagaauuacuuuaguuuucccuuuuaggggcuggagauguagcacauuacaggcuaaguuacauuagcuuauuauuucugugauccuuguggauauucuuuucaauaacuggaaccuuccuuaauuauuuauuaagugugaaucaugaauucauaugaaaagaauuuuuugcauauugacuaggaaaaugguuuaguaaaugucuauugaagccuauuuuacauaaagugcuauguuagauauuaugugggcgaucacauaaggcacagugcuaugcuuaaggaguuuauaaucugguagagugcuagaaguguaaugguaguaugcacaaaauuuucacaccacccuagguaaucaucuauaagccaugggaagcuaaacagguaauuuuauuucauuaauguuaaaaguaagcauugagaucaaacaacauaucuaaaauuacguaguugguaaauguguuuggcuuuuuauuuaguuucuuuugcccuauuuuguacuguuuugacacagacuaacacugaccagacaaggcaaaaugugauaaagcuccacaugaaugauaaguuuaauugccuuagaguuguguccaaucaaauauuuagggggaagacauuauggaguaacuagaccuuugaaagaacaaacuggaggggaggagaagcagagcuagggaaaggaagcagcagcauucuaaguagauggaagagcauuaagacacguuuggaguucagaaguggagcgcguagucugcgaacugugagcagucuugaucauuaggacuugaguaucuauaauggaguagcuuaggcuugaaugauagcuugaagccagguuuuagaaggccuaaaauggaauuucggugcuaguucuguuaagaauguucuaggagaaaagagacccaaucacagcgagucuuuuugaaaauaauuuggcagcauugaagaggauuuagaggugggaaggguuugaaggugaggaaaucagguaggaauauucuuagaaugaauugauaaagaccaccuccuuuuggguaccuucccugaucaccugccauugaaugggucaugugucuacaagagaaagcugugaaagacaucuuuagggaagaaccauugaagaaugauuuuauuuguauuuguauccauuaaugcuuaaacuguaauaggugaccagugggugauugcugaaugaaugaaugauuuagagacugaaaguguuggggaguggagaaagaggaaaaggaaaaaguauuccaauauaguuucuaagcuuuagucacaguguagucugagauugaauucuguuaacagaaguacgaaaguaggcuugggacauuaaccaucaauuuaaaaggcagauuuggaacuugggaaagagaaagugguacacgaguuaauauuugugauuuauucccgggggcgugauauuugaagguuuggaagaaggugaguuuucagagagaauauugagagaagaggccaaagaagaaacuuuggagaauacucauauuuggacugggaagaaaaaaaacacaaaaaaagggcaugggaugaugaaaauauucaugcaauuucacauaaaccaaaggaauaguuuuaagaauaaggcaaguuggucaauaaaugacaaguaauucagagaagucaaagaauuagcugaggaaaauacguggauuuaguaauaggaauuauuuucguaaaacaguauaaaccagaucucaaaguugcaaggagggaguagguaaaugaaaaaaaauaaagaaauuucuuucuuuauucagcuucaauuggcagagaaagacaaagaaauaaguggucugauuucacauuuggaaaaccucuccagggagaagguauugagcaauguaguuaaacaaauguguaucacaugaaacugaauaauaauagagcuuuaugaagagacacauuuugaaguucaugugacaguacaauguucaaauuuaggaaaacagugaaauuucuaaaaauuacgugaaauguuuaucugguuuucuuuuguaauaggaaacauuuuugaaguuguuuaaugacuuacagcaaaaccucacauucacauagagcaauacauuuguaauguaaaagauacuauagugcagcauuucugaaaguguggucugugguccuuuuggugguucccaauccccuuucaggggccugcaaagaaacaauuuucauaauaauacuacaacauuauuugauuuucucccugcugugacauuugcacugugugaaagcaguguggaaaacugcuuguguauuauuaugaauuaaggcaguggcaccaaacugcauuaguaguuauuguauucaucaccaccaugugcucacaguagagaaaaaaaaagccaguugcacugaagauguuaaaacaauaaaauguguuaauuuuauugacgcuugauccuuggguacaugucuuuuuaguauucugugugauuaaacggaaaguaccccuaaaguucuuuuguugccuaaugaaguaugaugguuaauaaagguaaagugcuuguuuguuugaguugugaguugagcuagucucuuuuuucauggaaaccauuuuuacuuuaaagaacaauuucuauauucagacuuggguauuugacagauauuuucucaaagugaaaugaaaugagccuguuauaucagggaaaaacaauugauaauuuuuuuugccauugauaauauuugagcuuuuaagcaaaaacuggaauuuugaaaaacuuguuaucuuccaguguaagcuugaugcuuuccaauguuuacaaacuuuucuaaugagaugguuguaauauuuagacuguauuuuuuaauuguauagcaaaauuugucagcauuuagaagauccacauaacucagugaaccaguaguuuuccaaaugaccagcgauguuacaaaaucauguaucauaaaagagccauucuaagugcaaguuagauuucaagguuguaugagguuacugugauaguugugaaauucugauuuuucaacucaucacuuuuuccacauuuguccuuuggcauucuacuauaaggacgaaccuuccuuuguccuuguuuauguaugucugugugguauuguuccagcaacgauuuucugaugccaaaacugguauucuacaauucaguucaauucugauacuaacuaccaugaguuagcauagaccccucagguuaaggcucagucccacaggacugcucccacuuuagaugccaguuacaagugagguccucaggcuacugauagcagucauuuucucacacuuauucacacguaauucacacauaaguacuuaauagcaaaaacuauuauguaccauuaauaacagugaaaaaauaauguggcagauggggaauugucuacuuguggcaucaugucagugcucaaaaaguuucaguuuggaacauuucagauuuuggauuuuuuaucagggaaugcucaaccuguguaugcuuuuucucagcacuacuauauucugaaaaccauuccauauaugaagcucauagaaauccuccaucuuuuuuuaaacagcuguguaguacuucauuauacauaccauaauuuauucaaccaacuuccuguauuuggccauuuagguaguugcuaauauuuuacaaauaauacugcaaugaaugauucuaugcacauguaguuuucugguguuggggugguaccuucaagguaaauuccuagaagcgugauugcugguuugaaggguaaaugcauguguaguuuuguuagagauugccagaugcccuuucauagaauuuguauuauuuuucguuuccaccagcaauguaugagaaguggaccuguuucccauauaaauuguaaucaggcuuucuaauuuuugcauaugggagagauuaggaauaguaccuuaguguaguuuuaauuugcaucucuauuaugagcaagguuaaacaucuuaucuuuuuugugaguucuuuggcucauuauucucugauuuuugguuuguuuuacuuaucuuguuauauauauauuuuuccccuauuagagauauuaccccuuuauuugugauacauaugugguaaggauuuucucucaguuuauuugacuuuugacuaugcucacuauacuuacuuuuaccauguaaauguucuuuauuuuuguguagucuaaagugugguacugccuugaccagcaauguuagcaccaucuggaaacuuguuagaaaugcauaugcuuugccgggugcuguggcuuacgccuguaauccuagcacuuugggaggcugaggcuuguggaucaccugaggucaggaacucgagaccagcuuggccaacauggugaaaccacgucucuauuaaaaaugcaaaaauuagccaggcaugguggcucaugccaugagcccagcuacuugggaggcugaggugagagaauugcuugaacccgggaggcagaggcugcagugagccgagauugugccacuacacuccagccugggcaacagagugagacucuguaucaacaacaacaacaacaacaacaaaaugcauauucuugggcccuguucugguccugcugaaucagcagcucuggaagugaugccccaaaauuuguguuugacaaaaacccuccaaguguuucagauuuaugcucagcuuugaaaacuacugauguguugcauuugaauuuuuaguuuuccacagaaagcauucccuacacccagguuauagaggaguucacuuguguuuuguucuaauacugauagaguuucaguuuuuuuuuuuuuuugagguggugucuugcucuguugcccaggcaacagugcaguggcacuagcucgacucacuacaaccuuugccucucagguucaagcaauucuccugcuucagccuccugaguagcugggauuacaggcucccgccaccaagccuggcuaauuuguauauuuuuaguagagacaggguuuugccauguuggcuaggcuggucucaaacuccugaccucaggugauccacccgccucagccuuccaaagugcugggauuacaggugugagccaccaucaguuuuuuuuuuuuuuaacauuaaaauuucuuauccauuuagaauuuauucuuggauaucacagaaggaaugcaucuaaguuuaucucguucuaaauugcuaucuaguuaucucaauccauucaucaaaaugccgguuuuaugucagugauuugagauacuacauuuauuguauaauagauuuccauaugcaguugggucucuuucuguacuuugaguacuguuccauugaucugucuacucauaugguaguaacaugguguuuuaauuguaagaacuuuguagucuauuuuaauauuugguuggguuaguccuuucucauaacucuuuguuuucaguguuuuucuagcuuuucucuugaaggguuaguuuuccauagcaauuuuaguaccaacuuuucuagcucuagaaaugauuguugguguuuuuauugauauugcauuaaguauauacauuaacuuagggauaacuaacaucuuggugauauuucuaccuuuuaauaaagaacaggcaauaugggauguuuuguucaaaucuguuuugugucuuucaggaauuuuaaauaauuuucuuccuauggguguggaagaauucuuuuuaaaguuuauuccuaaguauuuuuguuuuuccucuugaaaaugggauuuucucuuucauuguauguuguaacugguuauuguuuuugaauauggggcucuugaacuuuuuguaguuuuaaauuuuuauguaauuucaaacucaaguugaaaaaauaguauagugaacucucauuuauauucuuuccccaacauuugacaguaacuggaggugaagacauaacagucccugcauauuguauccucaguacaaggauguucuuucagccauguuaaaguuaacagauuuaggaaguuuaacacugacacaguauuaucaucuaaccuacaauacauauugaaauuguauccuuaguacuuuguuuauuguuuauagucuuuuccucccugaucuaggauccaauccaugaucauacauugcauuuaguugucauguguuuaguuucccuuuaucuggaacaacuuuauagccuuucuuaaccuugacauuuuugaaaaauaugggccaguuauuuaauauaauacuaauuuugguuuaauauuucaucacgaugaaacuuagguuaugaauuuugccaggaauacuauagaauuuaaauauccuucucaauacuggugaucuuucauuauuugguuaagguauuguccaccagguuuuacugauauaaaauuaauauuuucccuuuguaauuaauaaguaauuuguagggagauacuuugagaccauguaaauaucuuguucuuuaucagacuuucaccugguauuuuaguaucuauuaaugaucuucuaacuccauaauuccuucuauauugauuagaauuuuucuguaagagcuaucuuuucuuucuccccaauuuguuuauuuauucauugauauuuaucauuguagacucauggauucccguuuuagucaauggauuacagucuauuuuuauaaucauuuugauacucagauuguaucagauuuaacuaauaagagccccugcauacuagcucuuguggcuuaaugugucuuucauuauucuuugagcacuuauuacuuucuggugcagaaggauguuccaggcucaucuuguuauuuuccugccccagccuggaaucagucuuuucuccaaggagcccuguuccauuuacugguguauguaguuuagaaaccaagaucugggcuguagguguacccucauugauucaaaguccuuagcagacagagcuggaaaauaugguucucccccucucuuucccucucuguauauuaaaaaauagcaacacacacaaaaaacuaugaguaaauacuuauaccuccaauuguagucuaaaacuacagcauaaauucuagucuucucucuuuccauaauauaacuuccuuuucuaauuagacuaggaaccuggucugaguuuccuugauauauuuacucaaguguugaauacacagaaaauaauuucagaauugcuaacccauagcacugugaaaagcacaucuaacuagaguucaacauuuguuucauuuuuuugguggguaggguggaggguguaaaauuuacauauuuaguuguccuaugguguacucuccgcgcuccuuuacucucagaacauucccaugauggcagagaagaggaauauauuauuucuccuauuuaccaguuggaguaucagaaacauccuuaacuugucaaauaauuuguaaaaccggggucacugugagccauuuuggguaccgaagaaaaaaaguauuuaggcacccuggcaaaggcaaccagcuaaacagacuuguuccugggagcuggaacaguaagagaugacuacuucugacaaaaucucuuucuuaaauugugguggcuauuuuaggaaaauuaugagucagcaguuaauacuguuuugcucaguuaagauagcuacacuuauguuauccaugccuuuguaaguaggagaggucccccagggauucuugaccauuuuuguuucuagaacccuuugauauuuugacaaagucuauuuucagaaaaugauuuaaaaugaauagagcaaaauguguagaaucacaaaggaaacacauuauuguaguuaucaaaauauuaagacaaauuugugauauauaugauagaguaugugcuuauucuuuuaaauguuaaauaagauuuaauagcaugucuaauaaugacuguaauuuugaaguggugaucaauagaaaggcuauuuugagauggcuacaacaaauguaauucgaaacaaauguaagauuuagcagcaugucugauaaugaccauaauuuugaaguggugaugaauauaaaggcuauuuugagauggcuacaacaaauguaauaugaaacaaaucuguuugaucucuguagguggccaaguuacagguaccacaaccauuacuguguuuuuuggccuacauuccuaauggaagaaaauccuaaauuuuaguuagaaguuagugaauagauacaauuuuuuuugcccauguaaguucauggaccuccugaaaucuaaacauggaccccuugaggggcuuugugaaugcaaguuuaagaaccuucucuaaguccagguauuauguuuuggaggggagaguucagucuucugauuugcaaaagaaccuaaccuuaacuaucuuguccaugugcaugcauucucugucccccaugaggaaucaaagcugcuugucaccaauccuauucuuacccugaauccuauuugcaaauaauuuauuguaucuuugaugguagaguaggcauauuagauuaaacucucuauuagguuggaacucuauaaaguugcuugacuguaccaaugcagccuaaaucuuuucaugaaacccuugacucuauuucaguaguguauuauuugcuuacagaagaauuuaaacucuacuucuuuaauuugcauaaacuuuugaauaaguauuuuauuaucucuaacuucuuuugugccuuuuuuuuuuugggagacggagaaucuugcucugucaccuaggcuggagugcaguggcgcgaucuuggcucacugcaaccucugccuccuggguucaagcaauucuccugcugcagccuccuggguagcugggacuacaggugugugccaccacgccuggcuaauuuuuuauauuuuuaguagagacaagguuucacuguguuagccaggauggucuugaucuccugaccucaugauccaccugccucagccucccgaagugcugggauuacaggcgugagccaccacgcacagcccuuuuuuuuuuuuugaaucguguuugaaauguuucuuggauuuaaccuuucuuuuuuuucuguagucacaugccagucuugaaugacuacaguagcaucucugggguuuucagucauggcaagagaugaaggauaucuuuugaaugccuuucuuguucuaaauguaucuccuauuucucaauagcccuguaaggcuuagaaaagguaaauucuuuaggguuauuagugcugaucugauaaucaaaucuaggucagccugauuccaaucuaccaugcugugcugccuuccuacuaauuugcuucugguuuugaguaugcccauuauuguuuugcuagauuaaccuuaccaaggaccauuuuuaccguguuguuauuguuaaaaaaccugaaggcccauuguaaauuguaugacagauuugacacaucugaccuucaacuugucuuuucagcuauaucuccugccugagacagggucuugccuugcuauguugcucucuaacuccugggcucaggugaucuucccucccaaagugcugggauuauaggugugagccaccauucccagcuccugcugcucuuaauaugcauccuuugcucuagucauauuuuaccaagccugaaauacguuauuauuucucauauguucuguaucuuuuuauuuacuuuaugucagaaugcucuucaucugcuuggugaaaauuccuuaggauccaucucaaauggcucuucucuauagucucuuccuaguauacaguguuuccauuuugauacauugcauuuuaccuucaucucuauacgagaccacuuaccacaauuaauugcuaauuauuuaucuagaguuguaccuuuuauuagacugaauucuuugcaggcaaaauccauuucaaguuaaucuuuguaucucuaguuccuaguacggcaccuguuacauaauagauggugugcuagguaucuugaaagaguauuuuccuuuuuugcuuaaaauuucacaagucuuauuuuugcaguuaaauaaugagugguugaaaggcaggaaugccaucuuaaccucacaguuuuacacaguaccuggcauaguugauauguggacguguauguuauguauggacuugcuuagaaagaacuuuuaauuccugcaucucuuaucaaaccuaaguugacuugcauuuuucuuaauguuugcaaguuuugcucuugaugaugacuuucauuuuaagguuacuuaguccauuuauuggaucauuuauauagguaaaaauguguuaacuuagacacagucucaucucuacccccaagaaaugacaagcagcaaaaccagcucaacuuuccagacuaaauuuuucauucuuauauccuuuguuaauaaggccucugguugauuuuuuuuuuuuaacagcucuguuaaggugcaguuuacauguaauagaaucuguucauuuaaauagaguuugaugacuuuuggcaaaugcauguaguucuguaacuaccguuucauucaagcaguguaacguuuccauuacugcacaaaguucccucuugcucauuugcauucguccccuccugcuaccccccuguccuagaaaaccucuggucugcuuucugucccugucguuuuauggcuucuagcauuucauguaauuggaauaaagcagaauuuauccauucauuaguugauagacauuaaucuaccagcugauggacauuuaaauuauuucugauauuuugcuauuacaaauaaugcugcuaugaacauucuuacguaagucuuuuuguggacauauguuuucauuuuucuugaguagauaccuaggaguggaauugcgggcuuauaugguaaguguauguuuuuaaugaaacggccgaauuguuuuuacaaaguggcuguaccauuuuuguauucccacuggcaguguaugagcauuccaacugcuccauauccucaccagcacuugguauuuuugucagucuuuaauuuuagucauccuaguggguguauuaguguuaucucauuguggauuuuaguuuuaauuucccugauaacuagugaugcugagcaucuuuucaugugcuugcaggccauuuguacauauuccuuugugaaguuucuguucaaaucuauuuuuuuuuauugagcugucugucaucuuugguugcgacaguucuuuauauaucccagauauaauuccuuugucagauauuuugguguuauuuucuuccagucugugauuucuuuuuuccuuuuuuacaacauuaucuuuugaaaagcaaaagccuugaauuuugagguaguccaguuuaucaguauuugucuuaaugcuucaugcuguuuguccuaucuuaaauuuuugccuaaaucaagguuaugaagauauucuccuauuuuuuucuuccaaaagguuuguaguuuuagcucucuuacuuuagauuuaugaucuauuuguuuuuuauaugguaugauauguagucaaaguuuauuuuguauauaaguacccaguuuuuaaagaucauguugaaaagaccauccuuuuccuccauagaauuuccucuacaucuugagguauuuuaaauguugaaaauacucuauaaguaugggucuacuuuuagaaucuauauucuauuuuauugauuuuuaucaagggucagcaaacuaaggccuauaugcuaaaucuggcuuuauauaaauaaaacuuuauuagcacauggccaugcccauucauguagguaucaucuaugacugcaauugcagagacagauuucaguaguugcaacagagacuguguggccuacaaaggugaaaauauauacuguuugacccuuugcagaaaaagauugccagcuccucaucuauauucuuaugccaauacuauaccgucuuguuuacuguagcuuuauaauacgucuugaaaucagguuucauaaguccuccaacuuuguucugcuuuuuuuuuuuuuuuuuuuuuucuuaaagacagcaucucccugccaucuuccaggcuggagugaguggcuugaucguaguucacugcagccuugaccucgaccucuugggcugaagugauccuccugccucagccucugaaauagcugacuacaggcaugugccacuguaccuggcuaaauuuuuucuuguuuucuuuucuuuucuuuuuuuuuucuuuuuuuuucugagacagggucuuacucugucacccaggcuggagugcaguggugccaucauggcuuacuguagccuugaccucccagacucaggugauccucccaccucagguuucugagcaguugggacuauaggcacaugccaucacacccagcuaauuuuuguauuucauguagagaaaggguuugccauguugcccaggcugggcucaagugauccacccagagccucacaagugcugggauuacagguaugagccacggugccuggccauuuuaaaauuuuuuauugagauagggucucacuauguuguccaggcuugucucaaacaggcaauccuccugcuuuggccucccaagugccacauugugaaaaucagugagaaacaggaaaugaagguggcuuguccaaucugauucaaaggcuugaggaguuguacaguggccaauagucacacacaucccauuaguaacuacuuauuuaggaaugaaauaaacacauuaauuuucuuucaauuuauguguaguuuuuuuuuuaacggucacuaaauuuguuagaagacaaauacuuaauggucaguaaguccucacuuaacaucauagagcaguucuuagaaacugcaacuuuaagcgaaaggacuuacagcagguugaaagaaauaacuccucaugauccgcccgccucggccucccaaagugcugggauuacaggugugagccaccgcacuuggccuuuuuuuuuuuuuucuuuuuuuugaaucguguuugaaauguuucuuggauuuaaccuuucuuuuuuuucuguagucacgugccagucuugaauuacuacaguagcaucucugggguuuucagucuuggcaagagaugaaggacaucuuuugaaugccuuucuuguucuaaauauaucuccuauuucucaguagcccuggaguuacaggcauaagccaucauguccagccuguucugcuuuuuacauaugggcuauuacaggaccuuuguguuucuguguacauuuuagaauuauuuuguuaauuuguacaaaagccuacugggauuuucuaggcauuguauuguaucuauaguuaauuuggggggggaauuaauagcauaaaaguacuaaguuuucuaguccaugaacauguuauaugucucccuuuguuuaugcucuucuuaaugcauuauuuuguuuaguguauaggcuuugcacaucuuucauauauuuauuccuaaacauuuuaucuauugauuuuacucuaaguagaauuauuaaaaauaucauuuuccaauuauuuguugcuguauguagaaauacaauugauuuuacauauugaucuuguauacugcaaccugacuaaauuauuuacacucauuuuucuaguuuuuuuuuugagacggagucucauucugucacccaugcuggagugcaguggcgcgaucucggcucacuguaaccuccaucucccagguucaagcaauucuuucugccucagccuccugaguagcugggacuacaggugugugccaccacgguugacuaauuuuuuuguauuuuuaguagagacgggauuccaccguguuagccaggauggucuugaucuccugaccuugugauccauccgccucgggcucccaaagugcugggauuacaggcgugagccacugugcccggccauuuuccuaguuuuuauagauuuuuugggauuuuuuacauuuauccucauaccauugugaauaaagauuguuuuacuucuuccuuuccagucuaccuuaauuuugccuugauccacuggcuauuuugaauggaaguguugagagcagacaucauugucuuauuauuauugaucucauuuugaucuucaguagaaucauuuaguuuuucaccauuaagggucacaguagguuuuuauagcugccuuuuaugagguuaagagagcuccuuuuuauucuuuaguuucugagauuuaaaaaaaaucaugaaugacuugaauuuuguaaaauauuucuucugcaucaauugaaaugaucauguuucuuuuuccccuuuauuaaaagguaaauuacauuuauugauuuuuggauguugaacugcauuugguuuuuggauguuaaaaugacuuuuuuugugauaaaguccauuugaucauguuuuauuuuuuaauauuggguuugacgugcuauaaguuaaggcuuuugcaucaauauuuaugagggauaaggucucuaguuuuuuugugaaauccuuguuuuugguaucagaauaauacuggcuuuguaaaacaaguuaggaaauguuucuuuguguuuugaaagaguuuauacaggacacauuuuuauaaaaaaaucuuaagugauagaauucacguuuuucuuuuuuuaaggagacuuuuuggccgggugcaguggcucaugccuguaaucccagcacuuugggaggcugaaguggguggaucaagaggucaggaguucaagaccagccugaccaacauggugaaacccugucucuacuaaaaauacaaaaauuagccaggugugguggugcgcaucuguaaucccagcuacucaggaagcugagggaggagaauugcuugaacccaggagguggagguugcagugagccaagaucgugccauugcaccccagccugggugaagcucugucucaaaaaaaaagacuuuuuauucauaccuaaguuguaagagauucacaguuuacccuacauuaacucaaugagaaugauguacuuucuuggcacaaauaaauuugaaaauacaucggcuuuauccugcuuucugauuuuguuauauguggaggauacauuuaugagaaguugagagccagcuuuucuaacuguguuuccaauugcauuccaacuucauaauaggaaauaauuuuauuguuauauuuugacuaaauguuuaauacugcuguauuuaugaaauauuuuauugcuuugcuuauucaucuuuguuuuuguuaauuuuaggaacuuaaaaggagucuagaaaauccagcagaaaggaaaauggaaggucagaauucccagaguccucaauguuucaaaacaugcucagagcaaaaugguuauguucucacauugucaaaugcacaaccaguucugcaauaugguaauccuuaugcaucucaggaaacaagagguuauuacaguauuuuugguuugggauuagcugcaucuggagauuuuuuuaugguuuauauuuucauggauuagcaaacugcugguauaaucaacccuaauacaaacauuauuuuauuuguauaauuagcaguuuuaauauuuaacacuguaacuggcuucaucuagaagugaugcaccaugagaugaguacuuuauuuacuuauugcauauaguucacaauuuaaaaaaucaccuggguuaaaaauaaaaacaucuauuuuuuucacaugccaaagugguucuuuauauccuguucaucauaucuguauauacagauguuaguuguaguaaccaguuucacucuaccuuuccaaaaauuuuauuacagauggagcagauggugcuuuuuacccagaugaaauacaaaggccaccugucagaguccccucuuggggacuggaagacaauguugucugcagccagccugcucgaaacuuuagucggccugauggcuuagaggacucugaggauagcaaaguaaauugaauuuucauugugugagccugucccuuuuuuauuuuuuagcuuauguagagaguuaaggguaugugugcauauguguaucuuugugcgugcaugcguguguguggaaggagagugugugcuugugccugcacacaauugccuacuugauuuuuugaaaacugugcuuguauuuaaauuugaaaaaucuaccaguaugcuucagacuuauacuuuaggauuuauauacuaaaguaaaagauuaaguuuagagaauaaucucagaauauuguaguuaucagauaguuuaaucuuaaacaucacuaaguaacuuacuauauucuuuugauuauagauguuaggcuugaagcagcaaaguguuaauggcaguguuaugcuucaguguacaucuuuucuuuauagcauuuauaucccacuuuagauuuuaguguggacucuucauuaucuucagccagaaaaagagaaaaguguauguaucauauagugguuuucuuuuuuggagaaauacuauuugagaugucuuuaguauuuagguaggauuucuuauucucuggcagcaacacaauacugaugauaauugaauuaguuuguauagcaugucauuauuuuuguaaauuuuauuuaagagauuccuucaauauuuaaugaauagguuuguuuccuuacagcagcucuuuuuggauagauaauauguucuuuucuucauaguagcucuuuuuggauuuccugugcauuaagaugaauuuaaaagaaaugcuuuaucgugcucuuugcaaguacagugguaucaugaccuguuucuuauuuaaucuaguuugcugcauuuaauugcuauuaaccuuugcagaaacugaucaguguucagacaggcaugauuuuagcccuagugcucaacacccauaauggagaaaaauguauuucucccuccugccuuuuggccuccuguguccauuacugggaauaauuaggaaaacugucagaacuuuuguagccuauuuaaggucuagaguaucaucuuacugcuuuuucacaccuuuacuucacauuuugcguauuuaaucugaucauucuuggcacagauguuacaugugacaagcccuucucuuccguagucaucugcuucaguuuaauuagcagaauguucuuucugaucugugugcuuugcccuccugcaaacccaggagaagcaguguuagagucuugugcucauuugcugacaugcuuagauuugguaaugagauggaggacucuuaauaugcacaccucgaguaacuuuauuuugcagucagaagauuuuucacauuagaaaguaauucuuauguauauucagaauuaaaaaaaauucuuguuguuacaacaacaaaaaucacuugcaaaugaaguguuuuaguaaguaauuuuaguaagaauauggaaagcaaauuugaguugaccuguucuuucuuucuguuucucugcccugggagugauuaauagccacaggccccagcacuuuugagucaggguugaggugaccuaccuacucuuucagccuacccuagugccuacaccugccauaucuccucucuucugcaccagaaacuguggucaauugucagaucaaaaaccuuuugugacucccguuuaccuaaugauuguaauaacuuuaacaucauaauuaugacagcagcaaacauuucuauaccccucuuugccauuaaugcugaacucuuuagauagagucacuuauuuguucuucauagcaguccuaugagguaggaauuguuacuguuacaacuuuauaguggaggaaaccaagagacagauuaaauagcaugccccaaaucacuuagcugcuguggguagagacaggauugaaucucaugagauuggcuauagaaguuguggucuuagccaccugucaaauggacuaaaccagagguuuucauacuuucuuaguucuaguaaccccuaggccaaaagaaauacaguaaguccucacuuaaugucauauauaauaaguuacuggaaauugugacuuuaaacgaaaugauguguaacaaaaccaguuuuuucccucaucaacguuguaaugaaccgaugaaagaaugauguuauuucuuucaaccugcuguaaguccuuucacuuaaaguugcaguuucuaagaacugcuccaugauguuaaguaaggacuugcugaccguuaaguauuugucuucuaacaaauuuagugaccauuaaaaaaaaaagaaaaaacuacacauaaauugaaagaaaauuaauguguuuauuucauuccuaaauaaguaguuacuaaugggaugugugugacuauuggccacuguacaacuccucaagccuuagaaucagauuggacaagccaccuucauuuccuguuucucauugauuuucacaauguggcacuugcuuuauaucacagcaacugccaaaaccagcaucucgaagauaagauggcauugaaaggaauguguagcacauuuaaaguugaaucugugagcgaucuccagugacuguaguuguucacgugguauaugacaaaugcagaugcuccucaacuuacgaugggguuacauccugauaaacccaucauaaguuaaauauguguuuuugacuugaaggauauuuucagcuuacaguggguucauuggaacguaaccccaucauaaguugaggaagguacugaauguguauugcuuuuguaccaucuuaaaguucaaaaauuguaagucuaaccauuguauguuggagaccaacucuaaugaauauuucuguguacuucugcauauauaauauccuuagaaaauuaaaauuaucccacaguaacccucggaauuuacuguggugcccuagguacuuucauaccuaguucugcaaacuaugggucuaaauccuugcuccucaaaaaagugguuuguagaccagcaguagugguaucuccuaggaguauguuggaaauggcagaaucuccugccccacuccagccuuacugagaaucagacugcauuuaacaaaaucuuuaggugaucauaugauuuuuaacauuugggauacgcuauuuuaaaacugccuaaccccaaucauucaaggccagauuauuaucucuucccuuaauucauaucuuacuuucuaguugcauucuugcauuucuuaguguuucucuucuaccuucauuccuuucuccucuaucaaagacgaaagcccacacauucuauuaauauguggcuuauuugaaacuuuucacaugagcccuucacugugaaccccuaaacugcagacauuuuuuguugauagacaauuuuuuucuuuuuucuggugaguucuagcuuuuauucucagaagcgucuguuacuccaaaaugauugagaaccagugcuugagagaguugagggcuguuucccauuuaucauguugcacuguuugaguuuuugccuuucucaaacuugccauuuuucauauauuaucuuacguuuuaaauuuaauuuuaauguguuuucuguucacaaaaauagugugugauuacagucaauucauuuuuaucaagagagccaagacaauucaagaggaaaagaauagucuuugcaacaaaugguacuggaaaaacuguauaugcaguucgaugaaagaaugaaauuagacucuugauucauagccugugcagaaauuaacucaaaauuugauuuuaaauguuaagagcuaaacuacaaaacucaaaacauacagauaaaucuuuacgacuuagauuaggcaguaguuucuuagauaugacaccaacagcauaagcaacaaaggaaaaaauagauauagguugacuaucccuuauccaaaaugcuugggaccagaaguauuucagauuucagauuuuuucagauuuuggaauauuugcauuauacuuaacaguugagcaccucuaaucugaaaauccaaaguccacagugcuucagugagcauuuccuuuaagugucaucucagggcuuaaaaaguuuuggauuuuggagcauuuugcucuucagauuuuuggauuaaagauagucagccuguaauugaauaugucaucaaaaggauuaaaugaaucuuugcuguuccauuuaaaauuuuuuguacacaguuauuuccaacagauaauauauagcugguuggcaucucuuaauucugaauauucacuuuucuauaccauauuaguauaauaccuuucauauaguagaggcuuuuaaaauguuauuaaugaguuuaaagaaauguguuuguuccauuuuugccuauuaaacuauuuaaaauucaggccaucuuagaaaaguaauuguugggcugggcaugguggcucaagcuuguaaucccagcacuuugggaggucuaggcaggcagaucacuugaggucaggaguucgagaccagccuggccaacauggcaaaaccccaucucuacuaaaaauacaaaaaaaauuuaucugggcaugguggugcacgccaguaaucccagcuacuuggaaggcugaggcaugagaauuguuugaaccugagagacagagguuggagugagccaagauugugccacuauacuccagcccggacaacagagcaagacucggucucaaaaaaaaaaaaaaaaguaguuaauuuuuugugauagcuugagauauaauucacauauuauacaauuugccauuuaaaguauacaauuuagugguuuuuaauguauucacagagcugugcaaccaucaccgcauucaauuuuagaacauuuuccucaccagcaaaaaaaacccuguagccuguagcgguuaaccucuucccauuuauucccaccagcccaggaaacccucaguccacuuuguuuauagauucgucuguucugcauaguaauauaagucaaaucauaaaauuguuaucuuuugugacugguuucuuucacuuagcauguuuucaaaguuauccauguuuuagcaugcauccauguuuaacaugaagaauggguuuuauucuuguuuguuugggugguuagauugagcauccaaaauccgaaacugagugcugacaugauacucaaaggaaaugcuuacuggagcauuuuggauuuucaaauuugggauguucagcuggcaagcguaaugaaguauuacaaaaucugagaaagucugaaaucugaaacacuucuguucccaagcauuuuggauaagggggacucaaccugucccacauuuuguuuacccauucauguguuagacauuuggguuauuucacuuuuuggcuauggcauacgugcuuuuguuuucauaccuuuuuacuucuuuggggaaaguggaauuacuaggucaguuccacuagcaacugcuguaguggaaauccuaggaguggaacugcugggucaugugguaacucuuauguuuaccuaaaccuuuugaaaaacugcccgauuguuuuccccaguggcugcaugacucuacauucccaucaguaguguaugaggguuccacuuacuccacauccucagccacacuuguuacugucuuugugaaaugguucaucauugugauuuugauuugcauuuuccuggugguuaaugauguuaagcaucuuucaugugcuugcuggccauuuguauauccucuuuggaagaauaucuguucaaauccuucugcuguuuucaaauugggccccuuaucagauaauaggguuugcauauaugucucccauucuguggguugucuucacuuuuacgauggugcucuuugcagcacaaaacuuuuuaguuuuagugaagcugaauuuauguuauuuuguugcuuauacuuuuguuauaccuaagaaaccauggucucuccaagguuuuuaauuuacucguauguuuucuuguaagggcuuuauaguuuuagcucuuauauuugguuuuuggucuauuuugaguuaauuuuugaauauggagcaaaguaaagcuuuugaaaacuaacagaugugcaaaauuauuuuuaauuuuugaauauggagcaaaguaaaacuuuugaaaacuaauagagauuugcaaaauuauuuucuuucugauuuuaaaugcuuuuaaauuagauaaauuauauauaguucaauguuauuucuucauugauauauuacuagaaaugaaugucuggcaaagcauaagcaauaacaucucauaagaagaggaggaauacugacuaauacuguauaguaauacaaaguuuugaggggcaaagagauauucucuuguuuuaaauaaaaguuacccagagucauuggguacucucuuuucucuuaugcauugauuuuggccuuagcaaauauguaaauuucuuaaagugugaauacucuugaacuaaaguaauaauuaucaacuuaguaagaguuuuguuaaguggugaaacuuuucuuccucaauauuaauuacuaauuccugaaugauaacuaaauauuucaauuaguaguuccuagcaaagguagaauuacaacacaguuugggaaaugcuaaguagagagucccacagucuggauacugaugauacagauuauguaacucagucauuuaccccugaguauguauugccauaacuugaucaugauagauggcauuuuuuuuauugugguagaauaaauauaaaauuugccaucuuagccauuuuuaagcauauaguucuguaauguuaacuuuacugcugugcagccaaucucuggaaacucuucaucuuguaaaacugaacuccuuacccauuaaacaacaacucccauucccucuuccuccagucccugaaaaccaccaguaauuugaauuugacuacucuggguaccuuauguaaguggaaucauauaguauuugucuuuuugcgaguggcuuauuucacuuagcauaaugacuucaagguucauccauguuguaaacauguaucagaauuucauuccuuuugaauaaggguaaauaauauuccacccuauggauauaugccacauuuuguuuauccgugcauauaucaauagacauuuggguuguuucuaccuuuugacuauugugaauaaugcugcuaugaacauggguucgugauugaacauaucuguucaaguccuugcuuuuaguucuuuugggcauauacccugaaguagaauugcuggauaauaugguaauuuuauuuuuaauuuuuugaggaacuaccauguaugaucaugauugcauuuugaaguuagugugaucuaacccuaauuuauuuuccaacagguuauaacccccuuuaccaucaggccaggcaggugacucaugucuguaaucucaucacuuuuggggaggccaaggugggaggacugcuugagcccaggaguuugagaccagccuggguaacauagugagauccugucucuuaaaaaaaauaccgaguguggugguacacgccgguaguccuagcuaccugggaggcugagaugggaggauugcuggaguccaggaggucauggcugcagugauccaugaucgugccacugcacuccugggugacagagcaagaccuugucucaaaaaaaaaaaaaaaaaaaaaaaauuacuguucaaauguccaagguggucguaugcuuuuaauaagaaaacaagaauguuuuuguacagaguauauccugagcagauaaugagaaguuuuugaguuucaaauugaaugucaguuuaucguagcuuguuuccuuugcuuaaaaaccaguuuguaauggaaagaguauugugcugauggguguaaacauagaugaaaacaauagggcguuuagaucuuuaaauggauuaaaguaauauuaauaaaaguuuucugaaaagguauuucuuaaaauuuggaacuguucauaaauauauuucaguacgguauucucaauaaaauuugcuuacaagauuauuuuaguaguuuagcuaaaauacuagguggugauauuuuaaaaugugcuguuaaacccuuuggguuuguaaguuucagugcugaaacugauaauuuaauaauuugggguagaaauauuucuaaaacagaaugcaugauucucuggcuuuccaugcuuucauuuaauauaaccuugaugauuaagguuuauuuaaaaaaucaguguuacauggugucauauucuuuuaagauguauaguaaggcugugugaucuauuacuaauagugaaaugccuaacauuggauauuucaaguucuugucuugcuuuucuuuuucccaguagcuuuuuuuuuuuuuuaacugucagucggccugcuuuaaaagcuucauuuccaaauuaaaguauuuuuaaucuacugugguuuugaaacuaauuaaccaggcuuguugaguaaaauagaauaaauguauucucgagugaagauuucacucaucauuuugccugucaauaucaugagagacuuuauuauauguauuggcuccuuagagugcuuacugcauacucucugauuucaaccuaugcucuggguagaugguucauguuuuauuucaugagaacuuauuguuucucauuauaacauguagaauuauacucuugagccccucuccccuuuuauuagguaauaggugguagaagauaacagaauaaucggguuaucauugccaaauuauauaugacuuagaaaguauaaauuacuucuaccuuuuuuccccuccagguauuuaacgagcaggguuaacaugucugacaguuugucugagucuggaaccuuagcuacaaacucuacuguuagcugauucauggaagcaguaaauugguguaggcuguuagcuauuauaaaacaggaaaaggagguuaugagacuuuugguuccauuacauuuuuggccccuagaaaauuguauucuauuuuaaauauuugucguuaaaaauucuaaaaaauauaauaucaagaccugccccauuuuaucuuuuccaauuauuuucuucagcauuucaauauuuuggauuuuuuuuucaaagaugagugagaaaauuuuguuccuuaucacuguuuuguaguuauuuaaguauacucaguguuucaaagauuguugcugggaggccuaaaucugggagcuagaguaaccuggcacaaaaucagaauucacuguccuacauacuaagcucagcagauucaacuacuuucucaucuuccuucuuuguaucuacagacuuaaaagcugucuggauuuuaguuacuugauugaauuuuugaaguauauaaaguauucguguuuuaucucccaauuuaaucccccauuagguuaucugucccguuuuccuuuugcucaguuauauccuaugggacucacagauaaacagaaguauuuuaccccuucuuuuacuuuucaagaggggaaaauugucagaaggauagucaaguacuagaaauacucauuuugucuuuuguuuguucacguugcacuucacaccauauauacuuuuuuuggugcuccuucccaugacagacuuaacugacccauuaauagcagcucuggggcaagcaugccuacccaguaacauaaaggcuuccucagugccggcugcgcuuggggauaugcuguuaguucaugacaugagagcagcuaacggcugcugagagauaaaaaggaaauaggcaauuuagaugaugugccugguuucaguguuaaaugagccuguguguuuggcuguugauguagcacguacagaucucuaaaaacugcugggaugcagccaugggaauccaaaucaguguuuucuuugugaugaaaacuagaugcacaaauuuuuagaagucucacuugacaaccucugaaauauuuaacuuuggauuuuguuccucuauagcagaguuuugaggcuuguaguuuagugcauugcuuugcuuuaacacguguuaauccaguuggacuugcuuccccaagaauaugcauauacaaacucacacauacuuuauuaguuuuucauuaugauuucuguauaucaugcaauggauguaucuugucagagagacugucuuucuuguaauuaagcuuacaguuauuaaaugagaacguuugggacaauaaugcagucugacaguauugaaaguagggccaggcacagcggcucacgccugaaaucccggcacuuugagagaccaaggaggacggaucacuugaggccaggaguuugagaucagccuggcuaacauggugaaacccugucucuacuaaaaaauacaaaaauuagcugggcaugguggugcacaccuauaaucccagcuacucaggaggcugaggcauaagaauugcuugaacccaggaggcagggguugcagucagccgagaucgcgccacugcacuccagccugggugacagagugaugacuccaucucaaaaaaaaaaaaagcaaaaaacuggucacccagucugcagaaugauaaagucaguaaaaguuaccuacguauauagguuugaaaaggucuacuguucucagcuucauuuacacauacagguaugguaaaugguauguguaaaugguaugucucuauuccucugaauacugcuuuuuauuucaagaacaccacaguguuaguuuauagugaaauacucugcaaaguuucaaacauguuuauuugaaagucuaauuaaaugauagcagagagaaaauuuccugaaguguaaucuucuuuuauacugucaguaugugcuugauugaauuaaggaauuuauauuugguuuuacuuuucuuaaaaguuccaaaauuauuuuuccccuaggaagaugagaaugugccuacugcuccugauccuccaagucaacauuuacgugggcaugggacaggcuuuugcuuugauuccagguaguuuucuucuuuacuuuguagaauuuggguuauaucggccagugguucucaaaggugguccuugggaacucauuagaaaugcacauguguagggccuggccuagcugaaccagaaacaccaggcguaggcccagcaauauguguuuuaacauguccuccgauuuagggaguuuugucagaaaacauuuuuaacuugcaguauuuaaaagaauauuuacuguuccuaaaaugucauucaaaugcauguauugucuguuguuuggggaugggaacuaguuuugcaaaaaacaccuaauguuguauaauaaugcaccaaugaucuugcugguuaaaaauacaguauuuuuggccaaaaacaaaaacauguccuccgacugauucugaugcauacaagcauuugagaaccagugccauaaaaacuuugcuauuaaaccaaaugcacuggugggaaguuaugaguuguauuuauccuuacagucuuacaaaaggcauuuucuguuaaacguggaagaauucuugguacuaauuucacguaauugugauuggauuugggagguuuuaagggggaaaaacgguuuuguuaaucuaauuguaaaauugaauuuagaggcucuauaaauggguuacacaauugucuacagcaagcauuuagaagcagagaaauguuucuggaguaaagacuuuuaagguagguuguuuaguaugaauaucagcuaacuagauaaauggaaccuugucauauauggacaaguuguuguucuacauuuauuagaaacauguaauucuuucauuuuucucuuuaagcuuugauguucacaagaaguguccccucugugaguuaauguuuccuccuaacuaugaucagagcaaauuugaagaacauguugaaagucacuggaaggugugcccgaugugcagcgagcaguucccuccugacuaugaccagcagguguuugaaaggcaugugcagacccauuuugaucagaauguucuaaauuuugacuaguuacuuuuuauuaugaguuaauauaguuuagcaguaaaaaaaaaaaaaaaaaccacaccuaaaauagaccacugaggagaccauagagcggaugcuuucaugcacccuuuacugcacuuucugaccaggagcuacuuugaguuugguguuacuaggaucagggucagucuuuggcuuaucaauaaauuuuaaucucuguuaaucuuaccugcuuuaaaaaaaaguucuuguguguucguaucuuuauuuauucccuaguuugcagaacugucugaauaaaggauacaaggauuauuucaauguuacugcacugaaaaacguguauguauuagugugcuagauuauuuagcagaauauucacaaguuucuguugaccuuguugauugagcaugacuacuaaauauuauguaauaaaaagcauuugucauaacagucuuaugaaguaguucuucgaauauagaaaguucuauaauuuagcccaugaaaugauagguuuuuaauuuucagaaauggagcugcauguagaaugagaucacaugcuuuuauaugugaaauauugguuuuagcaauuaacagaaggcauacuuugcuaauuuuauggcaaaauuuuagaauaaccugaaugauuauuuuuaaacuaucuugaaguuguauguauauaucuaaugggaaaauggaacaagagaugucaguauaauuguuuuccuauuaaaugaucucauaacagggguguuuguggcauaaaaaucauagaauauauaucaguaucuuuuuuacauuuuccugaugagaauauaaauuugaaauauucucaguaagugauuaaaaguacaauacauaaacccaaaucaaaguaauguguuucuucaguuaugucugugcuguauagaacugucacuaacauuaaagaaagaggacacauuuuucaagaucuguaa

SEQ ID NO: 191615 - RNA, 39468 nt, Homo sapiens
uuguucaggauuccuucaacuuuaauuguggggguaaaaucaggcagccacugaagauaaaauacggucccugggaguaaucacaaugcuguuuucuuuuguaaaguggacauaagaguaguuuuuuuuuuuuuuuauuagcgcaaguggucaaaaguugucaaaauuguccucauuccucgauugucucuuuuuuaccagucucuugcccuucaaacagaggauaccuggccuccacaucagcccaugugauguugccauuggcuaggucuuggacuaugcugggcagcucagagaucuagagacaaggaaagagaagccaaguaucaaccaacuuguucagauuuuuaagaagaagauucauccugaacucaggaaaccuuacacagagccaaacaaugucaugccaggcauggguucaugcucuucuagcccaaaacgcccaccaguucccccagacaacucaauucugccacaaagccuuuccuaacuuuucuaaaucuccaugucccuugaaguuacuucauguguauuaaauuuaacuauuagaacaaacaggacucagucaaguaacucgugugagggaauuacauaagacuggcaaacuggagagcucugaccaaggcuacuguuccucagccaaaaccaaacacuggcugccacacagcaaugguucucaaacuugagugcacgucagaaucaucuggaggucuugcuaaaacuaagaaaguucugccugcccccucugccucuccacccccaguuuaugaugcaguaggucugggguggagguuuugcuuaucucauacauuuccaggggauacugaugcugcuggucuagggaccacacuuuugagaaccacacccagauggggacacagcuccagaguagccagauggucucuaaaaagucaagcuagaaauucacgacuucuggauuagacuauaaacuccuucagaaaaaaaagcagucuuuugcuucuguuuucccuauuacuucuguaucaagcuaagcacagaacaggcacuugauguaugugcucaaaggugauaaauuaggcaggcagaugucaauuaaagcagcuacucuuuccuuucccuuaccacucauccuucuccuucugugcuucuaccaucuccauuacugccuuccuauugaccaaaacuacugaaacaugauucacuguuuugaauauaugaacacggaaaagcuuauacauacacauguauacgcgucuguaaaaauaaaacauuaaaaugucuaacccuccaaagccuaccaauaaaacuauggcaacaaauucuuaggaucauauuucucuugcccaauaaacaaacaaguauaaaagcaaacugcuggagaauaagccuggagcaacacaaauguuuauaaaauauuagagaagugcuaauggauauuuucauaauuaaaccgggggacuugagaaucugggcucugucugauacaagccguucauuaaaauuaaaaagaaaaaaaaaggaaagggagcauaaacacaucaaaauccaacacaaaucaguaagaagcaguacacauuucuaaggcuaaaaaugccaaagagaaggccagauaccucugcucuuaucugccgcauugagucacggucccucagaguugcaguguggggggucuuguucacugugucaaagucaauggugacaccaaaagccacgccaaucucaucaguccuggcauagcgccuuccgauugacccagaggaaucgucuacuuugugagauacuccaugccuggucagggcuuccgcuauccaaaauaaacaaaguaaauuaaaaauaaaacaauggaguuaagcccaguguuaucuaacuacugucuuacaagcucaggagacuuauaaaugggaccaagacaagaaagcaacaaguugaguugcaagagaaagaaauaucccuaaaguuuaauaaaucccuugcgggaauccaaaucuucacucauaccuccaucugauacagcuauagggggaacaaauaugggaccaagagccaaggccagaaggugaguccugacuccaccaccucuauuuuuauggcucuaagcaggucaauggacucuccccauuucccagcucugaaauaaguggaugugccagaugaccaccaggauuccuuucagggcuguggauucuguggcuguagauccauuaugguugcuacacuccacucagguucccucgaugaacuuggcaccaaggucaguaugagaaguaaauaauuuuuaaaucugacucuuggguccuaccuugccucacucaaaugccagaauaaaacaucugagcaagcauauccucucgcuuagaaauaagaguacaggcuaaaaucauguacucuuuauaaaaucauuuauauucuuuauucagucuauauuuuuauugaaauaaaugauacauuuccuaaaauucagucuccuugaugguguucccauggaguuuacccaauugaauuugcuuacauaauuccuugacaaauggcaugaacuccugguuuuggcucagugggaggacggaacauuugaauggagcaacuacagcagggaaacugaagaacuggaugauuuaaaaagaaaaaaauccaaauauguuaauuuguaaauaucuaaaugcuaauaucccaaaccaaaagagguuaauauucagcaaguguucaagcauaacgucauuaccaaaaugccagaaaacaugacaugaaaagcaguauggcaaaagagaagcagaaccagcaucagaaacaccugguuucagcuccgaauuuaggccaagucaugaacucuuucugaaccuuaguuucuccaccuaaaaagcaggucucuaccaccugcucugcuugcuucacaagcccguuacuaaaaaagucaaaugaugugaaagcauucugaaagcuacuguauauaaaagacgguaauuuuuugguuccacauaaaagacuuucuguggagacuaccuaaauauucaaacaaguggcagugacccaaaccaaagcccauucugucuuuuaagagaaaaaccuaugaaccucagugaccaagugaaacagaaaaguuuaauuagcucacaaacauauguccaaaagaaauaguacaaaacaaaaaaagauguuccauauaccuacacuaaaaaguacagccuucuuaaacugcccugaaauaguuucugaguaacucagaaaucaaagaaagcaaaaauaaggcuggacacaguggcucaugccuguaaucccagcacuuugggaggcugaggcagaagaauugcuugaccccaggaauucaagaccagccagggcaacauggcaagaccccaucucuacaaaaacuaaaaaauuagcugggcauugugaggcgcaccuguggucccagcuacuugggaggcugaagcaggaggauugcuugagcccagaaguuugaggcuguagucagcugagauugugccacugcacuccagcugagcaacaaagcgagaccaaaaaaaaaaaaaaaaaaaggcgaaaauaaaaauauucuguggaaggcaaaccaaucaaccacuuuagguuggaaaugggaacugaaggcaguucuuaauacuuguacaaaagguucacuugaaggcaaaaacacagaauaaauuugucccauaaaaauaaugaaugacacagguuccaguuuagccucucacccaaaguucaauuaaccuuuauugccaagcaaugaauaucccacucuaaguaaggccuguauuccaccaauauggcugcucacaucacagaagguucagaauucuauucccuuccuccaucuugugauauuucuauuuaauauaagagaguaacagggaccugccuuuauagaaaaauaauuuuuaaaauuucacuagcaauguuuuuauaccaaauuuauaggcaaauggauugaggaacuaggugcuaauaauuuagaaacauuuuuggcuucccacagccuaaucaaauuucucuucaugaugggaauucaugcaauucauaaaacacugugacuaauuuauucuuguuuagcccuuacgaaauuucuauuaaagcucuaguuauauuaauauuguuagauucaaaggaacagcuaaaagauuuucuaaaaccuuuuuauuagaaaaauaagcagacaaagcuugaagcagacuugacaucuaaaaagaacacaugcaguuauguuugucaucauuucucaaaaagaaccaagccuuauguuugcgcaccuggggccuagcccagguucuuacaaucuguugaaugaauagggcugcuccuucaagguugggaaaugaagaugcaacuuuagggcagagaguaccauacuaacuuuauuagcuauguauuacaauagugugucagacuaaaguacuggugccgagaacucacuaguucauucuuugagguuaaauguccuagaaagaaccacacgguugaugucuaacauuacguacacucaagcuuuagaauggccaaguggaugacgcuguuucuuucaauuaaccugacauauacaaccucuccuuucuagccauucuucugguuggcuuuccuaguaaucugcccaggaguguaacuucugcaggcagaggugagguaaaaauggugaaguaaggcaaggagauaaagaggaagaaggcaaggagcagugauucagaagcaucagaccgaaaagaaaauuugugggagcugaugaagacuucuuauaaacuucuaucuucagcaauacuugaaugcuaggaaaggcuauaccccagacaacuauuaucccauuuaugaucugucaagcuuucacagugaaaucacucaggauucuuauuuuuuuuaaaaaaaccccagaucccugggucucagaccuagugaaucagcaucuccagaguagaaccuaggaauucacaucuuuaccccaaaaguaccccagacaauuucaugcaguuugagaggguucccuuugauacuuuaccagaguacagauacagcuuaguggucuggcuaaauucuaggaguuaucucauccuucccaauuuucugaaacacagcauauccagaaaguaccauuccuuccauugacauaauauagauuguuccccaaaguaauagguucagucuaagaauagagagcaccaggcaacuaaaacaauagcuucuagaauaaccuaaagcucaaauaagauaacacaggaaacugguuugucuauacauacuuaagcaaagaugaguguuaauagcacuagauuauaguaauaacuaauugaccauucuagagucuuauuaauguacuucacaauguaauucagaaaauuuuuauuuucugacacuauaacagcacacuguacacaacaacuuacuguucucuguucaucuccuucucguacauggaauguauguucaaauaccguauacaugauccuacccaggccgaaggaagguucaauuacauucggaacaacuucuuccacugaaaaagagauagaaauucaauaacauucucucaaauaccacauaaugcauuucagauucucucuaaacaauucaccagcugcgguggcucacaccuguaaucccagcauuuugggaggcugagguagguggaucaucugaggucaggaguucgagaccagccugaccaacauggugaaaccccgucucuacuaaaaauacaaaaauuaacuggguaugguggcaggugcguguaaucccagcuacuccggaggcugaggcaggagaauugcuugaacccaggaggcggagguugcagugaaccaagaucgugccauugcacuccagccuggaaggcaagggcgagacuucaucucaaaaaaaaaaaaagaaaagaaaagaaaaaaauucuuagcacuaaaaauaucucuauucuagauggauuuuuaucucuguauaucagaacaaagaaacuagaacauaccuaaaaacuauuugcugauaggaaacaugccuuugaagagaaagcuggagugaaaaaaccuuucaccaaauucuguuuauacuguguaaaaaugaaaccugagguacuagaauauuccuucaccagucagcaaacuacgaauagcagcagcuacacuuuaucucuauuaccugccucggcuacccagaaagcauaaaaaaucuaaggcuuuuaauaagauuuugcuagaauuuaaaaucuaacacagcuggcaaaauucacaaaaacaauuccuacaugcaaaaaguauuacaugguuuguauuuguuuaacuuuuuagcuuguuaucuugauaagaacuuguucagaaccaaauuacuggcauuguaucaccaagguucuggggucaggacgcccuuaggggagaguuugcucaaagaacagcacuccaucaaagacaucuuacaggggcucacagcucuucauguggguaagacaacacccgugguauacacaggaaauauacugauaauuauuacuuauuauguggaaaggaagaagcacugcuaagcaauguccaggucuaagauaacuggucauaacuuuggaagaguuuauguuuuuugggaaaugagaucauugguaccaaaacucacacacauaugggaaaagagagccuguuugucuaugauaaagaguuaauacuuuagaaacaugaucaaggcauuuuccucccauccuucugugguaucugaguaauggugaugugcagcucugaaccagcugccaggaucauggcuauaaagccccagacugugacggaaaagccccagagugugauggagaagcccccgcuuacuccuaacacugcucacugaagccuggcuacaagacaagccaagaacaaaaggaaagguaugcucacucuuuccacuggcaguagcuucucaaacacccauuacuacuccguuuccaggaauuucaauucagccacaaauaaacuucagcauccuucauacgugcuccaaauuacucauugccuaauucacagaauuuguucuacaaaaaaacaucuucuuaacuuuuaaaaaagcaugcaacaucacuggucuaaauuacuuuuuuuuuuuuuuuugagacggagucuugcacugucgcccaggcuggagugcaauggcgugaucucggcucacuccaaccuccaccucccggguucaagggauucuccugccucagccucccgaguagcugggauuacacgugcgugucuccaugccuagcuaauuuuuguauuuuuaguagagacgggguuucaccauguuggccagguugaucuugaacuccugaccucgugaucuacccgccuuggccucccaaagugcugggauuacaggcguaagccaccacgcccggccccuaaaugacuuuuuaacaaguuauuuugccaaagaagacagggaaugagggccaggcguggucacucaugccuguaaucucagcacuuugggacgcgaaggcagguggacugcuugagccuaggaguucaagaucagccugggcaacauggcaaaaaccucaucucuacaaaaaauacaaaaauuaguuggauaugguagccugcaccuguagucccagcuaauucggaggcugagacaggagggaggaacgcuugagccggggaggcagagguugugccacugcacuccagccugggugacagagcaagacccugucucaaacaacaacaaaagcuuuaaggagcagugacuuuuuguuuauuauuuuuacaaauuuaccauauaguguuuucuggaaucucuucacauugaucaugucuuuuguuaacugaaauguuuucccuucaguuucaauugugaauucccuacgaagaaacaaaacacauuuuguauuaguucaaacaggcacccugugccuuaauuuaaaggaauuuuguagauugcuaaguuguuuuuucuuuuuauaacuugaucaacucuccagauauaauaagugaugucaaauuuaaauuauuucauaagaaacaccaaauuaagcauuagucuaacaauggcaccaaaaaguacucugaggacauacaccaaauuuugacuaguuuuauaaaacuccacaagugacuuaaugacaaauuccuuugguuuugaaucaagguaaaaccaaaaacaacuuuuugaaaauucaguuuuagaauaauaacaacuuugucagaaauaggccugcugguaaaaacacaaggguucucauuacugucccaacaaauguacaaaugaaccagcaugccaucuuacagaaguaauuuuacaauccaauacccacacuauuuucaaaauaaauuuggacauuuguguugaugaagaucaguuuaaaagaaguuuaauguuucuguuucauauggcaauauaaaauauuaucccccucaaaaucacuggcugccauguauuuguguccugagauaugcccauucaguuucagguuauaagaauucaucuuuauaaagagcuucauguaauaccuguauuucagcuuaggagguauuuccucacauuuugaauauccauuuggauuucuccucccucccaagcaauucagugcuaggauagagagcccucaugugguugucucagaagcuggauaguuggcauauguuauaacuguauuuugcuaguuuccaccugugauaaucucaugccucaucugacugguguucacugaauucuuccguuuuuacuauucugucugaagucugugugugcaugcauucaagguuccauuacauacacagugucacaugcauucucucugugagcacagucuaaguguaucauaguuaacagcuauaaaagaguugcaauugggucaggcgagguggcucacaccuguaaucccagcacuuugggaggucaagguagguggaucaccugaggucaggaguucaagaccagccuggucaacaaggugaaaccccgucucuacuaaaaauacaaaaaauuagcuaggcgugguggugcacaccuguagucccagcuacucgggaggcugaggcaggagaauugcuugaaccugggaagcagagguugcagugagcugagaucacgccacugcacuccagccuaggugacagagugagacuccaucucaaaaaaaaaagaguuguaauugacaaggagacagccauuauuugagaauaauuaauaaagcaaacuguguuuauggauaaugauauuuaacuaguaauauaacuuaguccauuuuaaugggauuugauauuguuuuaguauaaauagauguuaauucuggaagacgagaaauguuuuuaaauuuuucugaaacagguaucuucaacuugcaagaguucaucuuugucccaucuguucuuuguuccuuuuccuuuucucccaucuucuuguggaauauuuuuucuuauucuacuuuaucuccacuauugguuuauuaguuacaccccuuuuuuguguguguuuuuuuuccaggugauugcucuagaguucauucuauccauuuuuuaacuuaucauaguuuaucuucaaguaauauuacaccauuucacauauaauguauacaccucacaagaguauauucccaauucuuugcucccacccuuugugcuacugauagcauacauuuuacuuccauguuauaaauuccauauuacuuuaaauacuccauuaucuuuuaaagaaauuaagagaugacagagaaaaugccauuucuauuuacccacauauuuaucauuucuagaucucucaaguccucuggguacaucuaaacuuucauacuucugccugaagaagugccuuuaacaauucucauaguggaggucugcuggcaaugcacucucagagccccggauugucuaaaacagagguguucaaucuuuuggcuucccugggccacacuagaaagaacugucucggacugcacauaaaauacacuaacacuaaccacagcugaugagcuaagaaaaaaaaaaugcaaaaaaaccucauaauguuuuuugaaaguuuacgaauuuguguugggcagcaucaaaagccauccugggccacaugcagccugcaggccgcagguugaacaagcuuggucuuaaaguacuuccucuucauuuuugaaagauauuuuugcuggguguaggaauuuugucuuaaagcacuuuaaaagauuucauuccauuauauugugauccgcgcaguuuuugauaugaauucuaaucauucuuaucuuuguuugcuuuuaugugaugagucuuuuuccccacuagcugcuuuaaagguucuucucuucaucccugguuuuuagcuauuugauucucacgggucuucauguggucaucuucguguuuauccugcuuggggcuaagcuucuugaaucuguaguuuuagcguuuucaucaaauuuguaaauuuucuagcuacuguauaauauuuuuucuauacacccucucuaggacucucaauuacacaugcauuagacugccugauauugucccacuggacaucuuuuucccagucucauuuuuuucuaugcuucauuuuggauaguugcuaugucuuuaaguucaaugaccuuucuucuguaauguuuaaucuacuguuaaucccauccagugacauuuucauuugagauauugccucuaaauguuucauguuguuuauauauauaaaaaacauguguuuauauccauauuacacauauauuuuuccauuucucaccucacauguuaauguuuuccuuuacacccuugaguacaugaagcauauuuauaauaagugcuuuaacauccuuauguacuuacugcaucauguuuguuuuuucuggguguuucuuuugacugacuuuacuucucauuuuccugcuuuuucauauauauaauaauuuuuauuguuugcuggauauuguaaguuuuacacuguucagugcuggauuuuguuguauuucuuuaaaggcuuuucucuauuuuuuuuuuuuguuuuuuuuuuuuugagacggagucucacucuguugcccaggcuggagugcaguggcacgaugguggcucacugcaagcuccgccucccagguucacgccauucuccugccucagccuccugaguagcugggacuacaggcgcccgccaccaugcccggacaauuuuuuuguauuuuuaguagagacgggguuucacuguguuagccaggauggucucgaucuccugaccucgugaucugcccaccucagccucccaaagugcugggauuacagccaugagccacugugcccggccuucucuauuguuuauauucaugcuuaaacaauuacagagaguauucuaaaccuccaaaaaggagagagaagugaccugagagauaguagauguaguuucuaacccuuccuuccucagccuggcuggacaagucucuuuguuuaagacaguuacuaggaaaaaaaaaaaguauauucuauuucaaaucuuuuuucaggcuauaaugccaaaaucucggcaaagacagucuuuuaaaugcagccaagauacaguacuuaccugcaaaaaaucuuaagaaauuaaucucauccuuucagaaccuggcagaugacacaacugacuggagcccauggaagaguaaacaucugauaucuuacccuuucucauucagcagcaucuccauuucuguaauguagcacucaucacaaauggcaagauacuccaucaccaguuuugcauccuucuuauaugccuuaccaauugcucccuuacuggguucaaacugaacaacauugacuguuuuguaugaaguagucaaggaauccaaaacuacagcacugccucaguauuucagaaaaugagccugagaacaaucaaucaucaacuuaaaaccaugccagcucucuaucaguacuccagauccuguuuaugcugauuuuaaggcaagaugaaacaccuguccacaaaaucauucagacaacucucauccaaaauuaacaccaucaauagaaacuuuuccaguuacagugagaaaaaagagauauuaucuaaucagcaaugacccaacccauagcauaagaacuucugauaaguauuucuaaaaugcucaaaacaagaucuauuuccugucacugaccuaccccuaagaaaucagcucauaacuucacugccuacuaaagaaagaaaauuucuauuuugcugauuuucagaccaagugagcuaaauuauuauuucagcuacuaucaaauggcacucaucuuuuaauggaaaaagcuuucaccagguacccuuuauuuaaagagcacguagguaggugcaggugugaagugcguuuuggaaacagcugagaaaaacuauuaacguucugaaagauauucagagcauuuuucuaaauaugcuucuuuuaaaggccaaacauugagugggcacacgucagacuacaaguacagagaauaggaaaggaacaaagggauagguaaaauaauagguuuaaacaagcguuacuacagugucuaaaacaucuccauuuauccauagaacaagguaaagacuuggacuuauucauuagcaagauguucacaugugaauccugaguuuuuggagugaccagaaaggauauggguucuuucagagguuucucagcuacaagugggacuuugguggcucgugcaugacaggagaggucauaacaggaacgaucagcacauccaacaaucucaauccaacccuaaaaagauauaaucaauaaaaacauuacuuacuuauuauuacuuauauuggguucauucacaaaugcaugcagauuauaaaccuuucauauauucaaugauaauucgaugauauaaucuucauucaaauuucauaaauauuugaaaugggaauagccucauauaucaggcagcuaauaagccuauaaaauauaauucacacugaucugggugugauggcucaugccuguaaucccagguacuugggacgcugagguggaaggaucacuugaggccaggaguuugagaccaaucugggcaacacagugagacccuaucuuaaaaaaaaaaaaaaaaagaaagaaaaaaauauauaauucacacuguacacaaaguagucuuccuuucuggauggauuuauauuguuauacugagucugugggguaaacuaacauauucuggaauuuaauuauggaaauuaaaugugaaccuagacaaagccuguaaauuugguucaaauuugugaacagaaaucaaaaugaauuuggcagaaaccacuauucuuuagaugaaguaccuaguguucucacaacuugauaucagauggcugacuaaacacauacuucagcuggccauaaaugugggcauuuggauucaauucacuuucuucacugaacaaaagaaaacucaguauaagaguggguaaaguucaggucacacaauaaaauuauauaagagcauuaugaucacauugaugccagguucccuuucuuauaaauacacacauaagauacuuuuaaaaagcaaaauuuaaauuauuuucaaagaaccugcaaugaauugaaugcuuguguccuugacaaaauucguauauugaaauccuaacucccaaugugaugguauuaggaggaggugccuuugggaggugauuaggucaugaggauggagcccuaaucacuggaauuugggaccccagagagcucucuugcccucuuucaccaugugaggauacaacaagaaguuggcaguaugcgacugagaauggggcccucacaaggaucagacgaugcuggcacccugaucucucaauuccagccuccagaacggugagaaaucaauguccauuguuuauaagccacucuguauguggugcuuucuuauagaaaccccaacuaugacaaacucuuaagaacccguuauuucaauaagaacaagaguuuguaaagagcuuauuuugguagauaccuaguuaguccuucucaagaagauucauuuuuuuuuuuugcccuugauccaaagaguuuggggaaauucaaccaucaaaacuacuaagcuuggccagacacagugguucgugucucuaaucccagcacuuugggaggcuaaggcggguggaucaccugaggucagaaguucaagaccagccuggcuaacacggagaaauccugucuucaugaaaauacaaaaauuagcugggugcagugccauguaucuguaaucccagcuauuugggaggccgaggcaggagaaucgcuugaacccaggaggcagaggcugcagugagcugagagugcaccacugcacuccagccugggugacagaguaagacucugucucaaaaaaaaaaaaaaaaaaagaaaaaaagaaaaaacuacuaagcuuuccaagcacauguuaucacauggggugucuguaauaaagcaagcaaauauaaaacucauaugagcucagaaacuccaacacaaaacaacaacaaaaggaauuaaagaacaaagccuaaaaacauguaaccuggcaaucugacauucccuauacaugucgacugguuaaguauacuuauguucuuaaccauauaguuuggugguuauaauuuacugcagaugucaacuaacauuuauguacugaaagguaaaauuacaaaaacgugccugagaauaacaacauugggauagugguuacuucucuggauggaaagagaauugguguggcauuaacugcaacgguaaauuuuuuuauuaaaaaaauauauaaaguacacaaaaaguauuaaacucucuaagggaguucuccccucuccuuaagagccucugggacucuggagcuucuuguuucauuuagcccuguuuuccagugacuuuccauuuucugaucccuaacccucacaauggcacuuagauaaggacgagcaggcauccagugggguuuauaaagcaguacagcauaacuguuaagagcaugagucuggugucagacagccagguuuauaucccagccucaccacucacuggcugugagacuuaagcaaauuacuuaacugagacagcaagaacaacaucugguuuaaucugaaaucagaaucagagcaaacuaagagaaggagcuggguaugaaacaaaaagaaaaguaauaaucuuuucucauacaaaaggaaaaacauuuuauugguuugaucugaaaauaaaaagaagucccagaaaaucuaaaaaguguaaagaaauuaaugaucacccauaauccuaaaaauaauuacuauuaucauuuugacauaugucaagcaagcuugcuaagaaaauccuaacagauuacaguaauucuuucuaauuccacaagggaaaaagaauauauuaaaaacaacaucauuaauagccauuuauaaacauaugcauauuauuaugcauuuaugcaugcauguguuagaacacguagaaaaaucaucuagagaaggcagacauacccaagaccauggagcuaagcaugaucuuuuuucgucuguuuguuugagacagggccucacucugucacccaggcuugaguucaguggugcaaucauggcucacuacagccucaaccucccgggcucaugugaucuucccaccucagccucccaaguagcugaaacuacaggggcgugcuaucacaccuggcuaauuuuuguauuuuuuguagagacagggucuugcuauguugcccaggcuggucucaaauuucugagcucaagcaaucuucccaccucggccucccaaagugcuaggauuacaagcaugagccaccacacccagccaguuuggacauuuuuuaaaagcuguuuuuuacaagcuguaaaaaacaacaaaguuaugugacagagacucauaaagcuaaaaauauuuaccaucugguccuuuauagaaaauguuugcucaauacagagaagagacauaaaacaccuggggagaggcauauaacuggaaguuuaauuuucuacauaauagucuucagaauuauuuuuuccuuuuuguuuuaaaaaaaguagucauuacuuuuuaaaauaugacuaauuuugauuuuuaauuuuuaaaaauccauaaaaagaaagccauucugaaaaguaaaaacugaaccaaggguauacuggaaccagugaccccuggacuaaagucucuuucuauguaggcgaggaagccucucuaacacccaauaagagaaaugccaaaagacucucagccuuguuuuagaugccacauuuccuccugccaccaauauagacagcaucuccuauaugcaaaugccuuucgucccuccgcuucaauacugauguucauguuuggugguggaggcuggaggggugacagggcacaggggcaggaggguaccuggagaucgucugugaauuuugaguuaaauacauaacauuugaggaagguaguucuuaagccagagaucagaaucaacuaguauauuccccaaagcuacuacauagcucauugagcuaagagcacuaugacuuucuuuauucaaccucuccaccauuuccaauguuugcugggacucuugccaggaaggagaggccaaugugucuuagauccacuccaggauauugccaguaaugcugccaauacacuguacagcaguguacacauccgcacugucccaucauacacuaacucugucucucagcuaucuaagacuacaacgagcuccuuaggacacuuauaaaaaggcaggaggcaacugcuuuuucuguuuugcucaggaaaagaucucuuuucuuuucccuuuguuccucugugacauaaagugcacaaaaauucauuugguaccugugcuucuaaguuaacaaugugaaaaucacaugguaaacagcacuccacuuacguaggauguuuuggauucugcaucccaacagucacaggcauaaugggccaucucauucuccaugugcugccggaagcggaguuuaucuggagauauuccaaccuucgugagguagagguagaugcggccaaugaaauagccuaauacuguguuauuaaucacacccuaaaccaaccaauaagcaagcauggaggaagaaaagaaaacacacauuaauacucuucaaagccaagauaucgguuuccauugacucacucuacugaaaaauauuugacacccaacacaaacuauuuuaucuugcuuucaaaacaauuucaaauacucagaaugagaucuugguuauuuuuuaauggguuaaugucaagaugaugauaauggaguuauucaaaaucuguccaacauacuuacugggucagcaaaaauucagcccaguaccucauaccucuaaaucuacaguacuaaaaacaauauucauaauugacacuaaagaauggcaaagacauuccccucugaauuaaccaaaguaaugacacguugaggggauuuuaauguauccuuacccacugaaauuugugaaccccguagaguacacguaaucauuuuaguguuugcaaggaccuuagaaaacaucuagccccaucuccauacacugcagaggucuucucugcaaaguggcugacaagcuaucguccaaccuugccaggaguauuuucagggccaggaagcucacugcucccugaggcaacucauuccacuaguggacagcagcuacuguuggcaaguuuucacgcacucacuucuccaggcaaauauuuacaaagugcuuauaugcaaggccuuauuccacugcuauggguaauacagaagagucugaaacccagauggcuugcuuucuguggguccaaugcugucucccccaaaguaguacauacuguugagucagauuggugaggcacaaugcaaaccaagaucuauuuuccaagugcucugcuaaacauuuuuuuucaugcuagccccaaggcccacaaauugagauguucaggugauuuuucucuuacuauaauaauacuguauaacaaauucuguacaaaaccaaguacuguaaaaaagcaaaugacugccaaaauaaaauaucuugucacccagaacacauagaauuugcuaauugcugcaaacccugaacaggcacaaucuaaguuaaguuaccuccagaauccuaccuguucaacagcaucucccaggcgcauuuuccgagcggacuguccgcugaccugggcuuuugcugaauacaaauaaaggugaaggucugccacauucuggaacuugggguggucuuucucacugggaucuacaaagugcucaauuucugccauugugaauucucugaaagcaaaaacguaagcgauaaaccugcauauuuaacuacaaaaaacaaacaaacaaaaaacaaggccucuauuuucaacugcauucuagugauaaaggcuccauacuauaguggucuuuuucacuaaacagaaaguugguuuccuaagggaauggccaaaaaaauuuugaauuaaauuugucuggguaguuguuauuuuuauuuuuuugauguauuauauuuguacaaauuuaugggguacaugugaagguuauuuuuaaacacauuaaugaaaauuuuauuacucacuauuuaaaauaaacaugaucuaacuucucugaaguauuaauuccuucccuccagcuacauccaaaaagauuauuacuuuuaacugaaaauaacuuguuaaaggcagauuaauauaguuuuuuaaauuaggaaaacauacgcaaaaaucacaugaaaaauaagaaauaagauauugaauagugacaugcagauaaaaugguuuuccuuaaagcauuagcaagucuuuauaaguauacacuaaaugaaguuucuucaucccauuucaaagaaugggaaauuaaaagcgaaaugaaaugguucuuuagcuuucauagcaguuugauuucuucuuuuuuacugcuacaaaaaaguaaaugacugauaauggcaucauacaguugguuucuuuggagcaagagcuucuuaaauaaaguguuauucaaggcaaaggauauaaggcaugaauugaacaagcuaacaucaagcuaauuaccuaacgaugaagugcacauaguaaugguuucccaaagagauuucucugaaugcaauuuaguagcuauuugcgggagaaguguuucaaguuaauuuuaugagucaaaaucaaucucucuucuuucaagaaaaaucacauuuucuggugugcuuccaugauuaucucagauguuuuacgaguaauguaaaauugcuuaaauggauccuaaaaauacaugaaauacacugcaaaagagguuuaauuuuuuuuuuuuuuuuuuugagacggagucucgcucgcccaggcuggagugcaguggcgcgaucucggcucacugcaagcuccgccucccggguucacgccauucuccugccucagccucccgaguagcugggacuacaggcgcccgccaccacgcccggcuaauuuuuuguauuuuuaguagaggcaggguuucacuguguuagccaggauggccucaaucuccugaaccucaugauccgcccgccucugccucccaaagugcugggauuacaggcgugagccacugcgcccggccaagagguuuaauuuuuaaauuuuauuuuuuaauagugucucuuauuugguccugcugcaccuauguuuuaguugucuuucaacaacuaggaaacaucuucugugcccauauaaaugugagagaaacaaacaugguguuuguccucacauagcuuauaauugggcugacagcaacugaacaucuacaaugugggacaggauaaauuacgggcccugccuagaaucuccaaaaugcugcugccaaagucuuuccaucuguucugucacaaaucucagcacugugucuauaguuaaugauucacuguauaccugaaauccgcucaaagaguagauguuaaguagaucucaccacuaaaaaaaaaaaaaguaacuaugugaggugauaauuauguuaauuagcuugacugugguaaucauuucacaauguauaagcauaucaaagcaccacacugugugacuugaaaucauacaaaucauacaaaauuuacucaucaauaaucucagcucauagauaggaggcaggaaucaucagaauucugaguaacuguaucucaguucagcaacuguaccugaaacuguagagaacuaaaauacacacaggcuaggaagacagauaagucaaucaaaauaaaauaaaauuuuagaaaaaucuucauaugaacaaucuaauaccucuaaacuaacaaaaggacaaaaggaaauacagcuaugcaaagauuaaucaccagagaacucugccaucaagaagaaucagaacacuaaauaaaccaauccuaguccuaccauggaacaaaagccaggaggaugcugacucaugaaaaaacuaguggacuucuggucaggaacuugcaagggacauaacaaaacuagccagaauucagacaugacacuuugaagugaaaaugaccaaagaauccacuguugagaagccccagagccuuucuaccaguuaaccccugggaucacucccaaguuccaagcugguuucccuacucaccacuuuuuuacugcacaggccccagacacugccuuacuucucaguccuucucaauaaucuucccauagcuacucuguguaaacccucuucguaacacuggcuucagacaaggucagccuuacgcagcuuccucaguuugggaaggcauacuugcuagauauugaaacggugaaaaacaaaaaaacaaaaacacucagacacugggaaauaaaacaaagacucaaaucugacaaauuugucauugccaucauaccuggcuaaaguuucugaugaccuccucuuuuuacaugaaagcucagaggggucauucccccaacuuucucuaaguugggcacauucuuuccucuguaagucccuccuuccuaaaccguaaaccuguagggccuagagauacaguuugcgcagaacauaggcaucuucucccagauggcaucaugggaacuaacaagaugaggcaggugcuguggaugcuuugauccagagucagugacugggcuauguuaugacccaagucuguaauuacagugaguaagaagagaagacaggaaaugggugggcgcuggggcugggaaaacacuuuggggccuuagaaaguuauguuuagcuacaccucguauuuuauauggaauguauuacucuaagagaugauaccaggaauaacguauagaaaucacaaaaaacuuaagucauaaacagcugagucauaauaaauuucuaaagaaauauagaacucaccagccccaauaugccuucccacacaucccuggauagaucagacaaaaguaggcuauuugaauagaggccaagugagugaugaggguaagcuugcuugcuggccuuucugucauauaggccccccaaauaccuggacggagguuguuuccagaacuccaguugguuacugauacauccucaccccaacuucagcaauguugucugcccuagauaucuagaacaauccuccugccacaacuuucacccuacccccacccgaccccacccuuuuauacacaucaccauugccaguauugccuugguuuagacaaucaagauauuaccauccucaaaauauacgaugaacaaggaaaaagguaauuuuggagcaggugagacucuuaagacagucuccacccuccuuccuuucccuucaaguucacuuuugucacucaaaacugccugucauccuggagauuacauuuagagauuccaaauguaaaacaugauuuuuggagaaaacaaaaauaaauucauaaucaggauuaugaagcagaauugcuucaaaacagcaagcuuucauuuucaaugcaaugccaaggucauucacuaauuuguaagaguaaccugagcaguaccugacucugaucaguccagaucgaggggagaucucauuucuaaaagaauuuccaaucugggcagcagcaaaaggcaacuuuccuugguugaacuccaaaagucguuugaaauucaagaaaauccccugugcaguuucuggucucaaguaccuauaaauuuaaguaagucagucuguuacaaagaaagaaauuauguuuuccaacaauccugaaauucuagauacaaauccuaaaaguccuaaauauaccauuuucacaacaaaguugaacaggcccuaaaaugaaguuuuagaaauauuuuccucgguagcaaacauuuucauagcacguauuagaaaauguauuaaguaauuaguguggcaguacuacuuuggcaaugccauuucauuuaauuacaccagugagucaaaaccccacuucucaaaaagcagaaauaaaaauaaauuuaaaaacaccaccucaggccgcgcgcagucgcucacaccuguaaucccagcacuuugggaggcugaagugggcggaucaccugagguugggaguucgagaucagccugaccaacauggagaaacccugucucuacuaaaaacacaaaauuagccaggcgugguggcacaugccuguaaucccagcuacucaggaggcugaggcaagagaaucgcuugaaccugggaggcagagguugcagugagccgagaucacgccauugcacuccagccugggcaacaagagcgaaacuccaucucaaaacaaacaaacaaaaaacaccaccucucccauagugccccuuaaaccccugaugucuucuaagucaucauguacauggaggcagaugacaaucuuagguccuuuggaaaauaauacccaugccuauguuuagcccuguuaacccacauauuaaaacuuaacugaggggcuaaaaagaaaucaguauaggcucacauuuaacaucagcacucacuuaucacuaucaccucaccaagccagguaauuuucaauguuuuucaaaucauuuuauuaucugcaguauuuuauauuuucaaccagaggcuuccgcauuucucuguauuuuaaagauauagucaagcaaauacacuacuauaaccacugcccucucaauuuccuagaagauauucugugcaaaacauccacuaaggaaacgcucccaauggccuacuucagaauaaguauuuuacuaaaauaacuuuaaaaccaagggcuaaaaacccuaaaauuguacccucuucuuacuuaacagaccaacucuuuugauuuuuauggcccuuuccagauuucauccaaauguaaguaaaguuuauacauauauuuacaguuaguauguauaaaaucauguauuaccuauuuuauacuucccauuuucuaaauaauggcacaaauuucucacauuuaauagugacagaauauuaucccaaacuaauccacuuuaccauaauuuguuuaaccacucucaaauuacugaauagguuauuucuacuuucaauuuauauacuucuucuaaguauaauuuccuuuccuucugaauuauuuccuuagaucaauucccagaaauggaaugucugggucacagguuaugucucauuuuaugacucuguacauauggccaaaaugaaaggcuugccacuggccucuuuccaugaaauauuccaaaucaaccugaugucucauuagaauaauuaacugcaacacauuuugucacaauuaauuuuucuuauucuucagucccuacucugggaaacacgaucuaucuagcucauguaggaaaaacuuacucucuuacccuaucauagaaaaauaucuaaagcuaugaaauggaacacuggcuaagucuguuaaacaguggacaaggaaucagaagauaaagauuccaauucugaaucauacuguaaacuaaccagauauucuuuauccaugaaaaccacaucuuucaaaucaacaggcuauaccuaugcuguccaauaugguaggacaccaggcagaugucuauuuaaauuucaauuaagaugaaauaaauuuuaaaauucagugccucagaagaacuggacccauuaugagugcucaagagccaaauguggcugguagcuaaucauacuggacaacacacauuacagaacauuuccaucacugcagaaaguuccguuggacaguagcaugcuaaacuaaaugguuucuaaaauauccuucagcaauaaguucaacggcuuuuaaaaccauucuucaacugucccuucuacccuaugcagcuauaacuagaagauauagugaucagagacuuuauuuuaugccaaaaaaauacauauaugccaaaaaagaaauuauauucagaaagaauuuuuuaaaagauuuauuucugccauuauuucuccauaauacauucaucuguacuucuguauaucacuuuuuaaaaauuuuuccuucauaacauugauauuuaccuuuuaauauaagcaauuuuaaaaacuucauuacauaaacagguaaacaauaagugauacauacccaggcauguuuccuccaggcccaaugaaagucuugaacauuaaguuaaaagacacuggaggggauagaucauuuccaguaaugggagauuuuacauuauaguucacaaaaagauccgcaaguucuugcuguccauaguuaucaagcuaaaagacauauaaagaaauuaguguaaaagacagagaaaacaaggcauaagauauaaaguauuauauauaacccuagccauccacugcuacaaucacacaaaauucaggaacaucacaauuaaccuaaccuucaggacacccacauuaaaaccauaaccaauuuauucacuuuccauuuaucaagagagaaaaaaauauccuucugggaccuaaaacucauauagucacuguuucaaagugaaagauaaagcaaaauaccucuuauucaauuauaauaguuauugguuggcaagaaucugaaauuaccuaaauaaguuuucaaagcugaauuuuacuacucugaacauauuuaaggugcauuucugcauuucucuguauuuuaaagauccagucaagcaaauauacuauuaauagccaccacccucuccucaauggaguaauuaaaugugcauugaacuuuccuuucccauuagauauuaagcgccuagaagacagaagcuguaucuuauucaccucagcauuuuccaguguauugcacauucuauacauugaucaucagugccaaauccuguaaaaugauguaugcccuccaauuuaagaauuucaagugacuaugacaaaccaucuaauaguaagcaguauuuaaaacuuaaaaguuuccuaacagaaacaaaauaauucaguaaaucaauuaauggccauaauaacugaagcuucgaguucagaaagaccuuggcguaucucccaacucuacaccacuuauggguugugugacuaaagauuaaguucuuaccuaaccucucuaagaacaggggagaacagcuucuaccuugcuaugcaggaauaugaugaagauuaaacaaaacauguaaaguauuuagcacaggcaggaccugguacauaauaacuacucaauaaagagcaauuauauuugcuacccucauaaauccaaugguauuuccacuccauaaaaaggcaacccacucacacuaacaacauguuccagauuugaaugugcaauuuaaaauauuaagccuucuagacucuauuucuacagaauuucuaggaggaauccacaaaauaacauuauacaauuacccaagaggcuggaucaaugaggaaacuguuccagugaacuucaagacacggguaccauaaauauaagcugguccuacuagaguagaaaguuaaagagccugaggaacaucuauuucccagguaauucaagaauauauaguguuuuccaauaaaaggcauaauuuaaaaagaaaucaggaggaaaaagauucugccaauacagauagaaagcaaaaccccugggaaagggaaucuggcaauaucuaacauuacuauauuuguauuuauccuuugucccauuucuaggcaucuaucccaaagacacaauagcaaaaacaugaaaagauauaagcacaagauuauucaaugcagcauuaucuguaauguuaaagaugggaaauaaccuaaauguccagcaguggacaacugguuauguaaaauauauccacacaaugcccaauuauguagcuauaaaauggaaggaggcaaucucuauauacuaugagggaccaaucucugaaauauuuuguuaugugaagaaaaccacaauggagaaaaguguguauggaaugcaaccauuuaucuagaaaggagggcauacaaauaucuauaugucuuuguuuauauucuauuuuuuuaaaaaaggaaguuguuuuaaguuaaaaacugcucaggaagcagggaagcagaaggacggaagguaaagggaagagaaagauaguagacuaaauauaccuuguuuuuuagauuugccuuuagagguauaaaaaaugcuuuauaugauuauaaaacaaauuuuaacuuuuuuauuauacuuuaaguucuaguguacaugugcacaacaugcagguuugauacauaaguauacaugugccauguugguuugcugcacccaucaacucgucauuuacauuagguauuucuccuaaugcuaucccucccccagccucccaccccccgacaggcccagguguaugauguuccccacccuguguccauguguucucauuguucaauucccaccuaugagugagaacaugcaguguuugguuuucuguccuugucagaguuugcugagaauaauuguuuccagcuucauccaugucccuacaaaggacaugaacucauccuuuuuuaugaaugcauaguauuccaugguauauaugugccacauuuucuuaauccagucuaucauugauggacauuuggguugguuccaagucuuugcuauugugcuauaugauuauaaaacaaauuuuuaaaaaggaaacccugaauacugaaaauaaaaugaaauauauggacuaacugcauaucuagcugauggcauaaccacacagagagaaugacuccaagugacuuuaaauacaguuaucagacuguaagacuacacagugcuggcauaucccuaaagaaaagaacaauaaaaguguuuuuaacuguuuucaacauucauauugcugauggugguguugguauugucauucugagacuguuaacguauacagugggagauaaggcacaucaaucauuauguuuuguugcugagaacugcgauuuuugguaaggguaaaggagagagauuuaagauuaauauaguaaaaacccuauaaaccuaacuuuaaguuaacuauuaaguaucuauauuaacucaugaaaaguuuaucuuuuaaaaaauaucaacuuccuagcucagaucacugacaagguuuauaauuagugaucaauaccauccccacuaauaaguaccaaguaccagggcuccuuggagaaaugucugauuccaagucugggacaggaaauguauaagaugagauggcaauaucuugucauauuaaaggaaguuuucagagacuacaagggcugugucaaaaggacucagcagagaacuccuagucaccaaagacuggacaauuuaaccaccaauaagauaacugcaacugacugaauaucaaauauuugaaucuaaaguucacaacaguaggaggaaaaaacgaaaaggcaggcaggaacucgugcauuucugaaggauguuagggaaccaacuaauggaaaacagguuuaaaaagacaaggggugggagaauggaugaagcacuuauucucaccuuucuuuacaaaucgugucucaguuaaaucaaauaguugauagaaaguuuuuucauauagaaauagucuagcuaaaaaaaaaaaaaaaaaagaauaacaaugacaaaaaucaccauuuugaaauccccucaucaguuaaugcaucuaaacaauggacaucaauggccacagcccacagaagagcuaaccagguacuauguagcucuggacagaaguccauaacaccacuuaaccaaaugucucgccaaaaauaccuggucaagcuucuaaaucuaauagagaaaaagaugaacauguguaaccucacuacaauaacguaauuagccaaauccagacaguagaaaacaguaaggaacaaaugacucagcuucuugaaaaaaauuuuaaugaaaaugcggggagggaaaagggaaugaaggaaggccauacagauuggaagagauauaagaaacauaucaaccuaucacaaaguauagacuuuaucuggaucccaauucaaauuuuaaaaacuggaaacauuuaagacagccuagaaaacaugaacacugaucaaauauuugaugauauuaaauuauuaacauuucccaagguaagaggauugaaaaggauuuuuuaaauccuuuauuuuuaaaggauuuuucucuuuuagagauagauaaugaaaaauuuacagguauaauaaaauaauguuugagaucugcuucaaaaaaauucaggcugggcaccauggcucacauguguaauccuagcacuuugggaggcccagacaggaggauucuugagcucaggagguccuggcugcagugagccauguucgugccccuccacuccagccugggcuacagaguggggcucuguccccacccuaccacacacaaagaauuaggggaaagaagucaggaaagugagaggggaauagauacaaaaaaaucuaacagugaagcagggugauagguacauaauuguuuauuauguuuuuauuuaacauauaaaauuuuguauguuuugaauuuuucauaaacaaguuaaaaaugguuuuuaaaacuggaacauccagagaugggccacaaaaacagacagagaagagaaacaaaagaauucguucugagcuguuaaauccacauaauaggaguagaggucuuccuaccacagaaggugaaucagggccuuuuaaagaaacaaugaugcuucauaaagcugaaaaggagucagacacuaaggugcagaaaacgcuacucugugcuuaagcaacagaugggcuuucagccagugaauccaccagggccauuucugagugcuacaccauuucccaugggucccuuacuuuucauugaagauuauauugacagcuguacaugcaucugauauggcaagucaaaaaacaaauugcucuccuagaacacagaucugaaauaagagagaaggccaaugcucaaacaauaaauugacuugucaaaucaacuaguuacuucccaacucugacaacguacuuggaaaugaauaauacuguuaagaucaaaaacauauacacaaaaccucaguaaaucuaaaauucugaauggaaaauuuuagggauacuuagaggcauuuuccauuuuuucuaauaaagggcaugccuuuggauaagaaaaugagaugaacguguggcuucaacaguaucaaaauguaagaaauaauuuucuaaaccaugaguaauuacuaaaacaaugagcuucaagcaagggauaaaauuacacuccacaaguaucaaaauaaaucagcagaugauucaacagccaaauuaagaaaguuuucaauguaaaugaagaaggagaaauuauuuuagcuauguuggaaaguuaacuaucacagagaaaaaaagcaugcuaaaaaaaaaauuaggacaacaguggaaaaguauccaguaauucccaugaaaaacaacauauuagggaguucuauauucaggcagagagagagagagagaucgguguaaagaaaauagguauaaucacaguauugguuuuuuguuuuuugcccaaggaaguaaauaaaauuuaagaggugagccucaguagaccucaugacuaaacaugguguuggagaaauguacuuugccuaaacggaauagccaacagaugaggugagacaccagcaacauauauacaugagcacaugcaucuucccagggagacgugcaguuuugaucacauucuuaggguggucugugacccaacaaaaggauaagaacuacuucuaauauagaaaguauuccugcaauugguaaaaggucagaauaaauuaucucuguggucucuuuuuugucuucucuaaaauuugucagcuuaaauauuauacaaauuauaaaacuuuaggccuauaggcaaacugagaaaagcaaggacagaaaagucaggaccugcucaugagguucuaagaauaauagcaugaaaucaggguccaagcagaggcagaucaaguagccagugagaaagugcucaucaaguuaucugccccgaagucuccacaccagugcugaacacuacccaucaucagucacuccugugguuuuagcuauuaaauccagaaaaguaguuuccaaggucagacaaauugaaugccuauuaacacggacuuguuaguuugggcugaaauaaaggguuagucacaaaagagagaagaaaauaaaaaugcaaaaaaagagacgcuauacaggacagaauuaaccucugcuucauuacaauguggccagggucagcauaaugggaaaugcaacagucauuaaacacugaaagaaggacagcgaccaccuagguuacucugauaacaucucuagaguacucaccugggccaaaacacuuuccauuucugauuucuuuucgacagaacacuucuuaucagacaucaauuucuguaaaugagcuguaagaacaguguugacauauaucaaucaaugggaaaaaggacaaugcacuuuucaguuucaaugcuagacaauuaaaaaguaaauccaagcauaaaguucuuaauuuacaugaaucccacaguugauuuuacaacagcagucaugguauugucuugauucauuugcuaauuagaaaaauuaucuguauauaacuaauuaucuacauauaacuuuuuuaaaaaauaaaggacuugaucuauauacuuaagaucugugcacuuugcucuuugaauguuaugccucaauaaaaaauuuaaugaaagacaucugagagaaaguuuaaaccuuuuauuuugaucaauccuaccugaaggagaugaagaaccucaccuuuuaauagauggucagcacgaaaacauucuccauuuuuuacgucuuucaccaugaagucagcaaauuugucuacauggccagagguccuaaauuaacaaaugccaacccaauuugucauucucauacaaauuacacauagauauuaccuuauaagauaauuccccaucaauauuuauauccaucucaaagauggaagcucccauaucuauaguaaugauguauccaugacaguaauggaugccagagaaaauucuuccucaaaucuauuucucacccucucccacauucuuccuucccauaagaaagaagacauuaacuagacaauaaaaagacaauucuuuucuacaaguugucauaaagucuguacuauucuucaggaucaauuaauccaugccuaugccauuauuauuagugaucuaagcaaaggccaaaaucacugggaauuugacuaguuaagaauucauggcagcucaguauagacauugaaccuuaagggaaguguuuucugccacugaaaccuguacugacauugguauuaucucuacaaaguuccuauugguggaacaaguagcuaaaaugauagguaguccugaucuuauagagccaucauucagaauuccuccucuucauuggcugaaauuauuaagagaaccuaacggaugccaauaguaaaaauuagcucuccaccagucaaccuuaaaugaauaaugacgaguuacaaaauggcaagaauuccucuuucaggccgggcgcaguggcucacgccuguaaucccagcacuuugggaggccgaggcaggcggaucacgaggucaggagaucgagaccauggugaaaccccgucucuacuaaaaauacaaaaaaauuagccaggcacgguggcaggugccuguagucccagcugcucuggaggcugaggcaagagaauggcgugaacccgagaggcggagcuugcagugagcagagaucgccccacugcacuccagccugggggacagagcgagacuccaucucaaaaaauaaauaaauaaauaaaagaauuccuuucaguuucacauucugaaauucugcccuacuuugggaggccgaggcgggcggaucacgaggucaggagaucgagaccacccuggcuaacauggugaaaccccgucuguacuaaaaauacaaaaaaaaaauuagccagacgugguggugggugccuguagucccagcuacuugggaggcugaggcaggagaauggcgugaaccugggaggcagagcuugcagugagccgagaucaagccacugcauuccagcuugggcgacagagcaagacuccaucucacacacacaaaaaaaggaaauucugcccuacuuucaauaacguugguaggaauaaucuaaguuucugcauugaaacuuuaaaacaaauaguauuuaacugaaaaucucuacaaguauaccuuugcucagaacuuguauuaaggaaauaaucaaggauauacccaaaaauccaucuaucaagauauucggugcagucaaaaaugagaaacacuuuaaugcuuucaauauggcacaaacuaacauauuauggcacuuccauaaaacagaauacuaugcuaucauuaaaaaugcuuuagaugaauaguuaaugauaugaguauauguucaucaauauuacaugaaaauaagcaguguacugcuaacacugaaauacauagggacguacagaaaaaacaggaaggacaaacacaaucaucuuaacauagcuaucugugagcagaagguauacauuucuuugcuuuuccauauuuuucagauuuucuacaugaaaugaguaguucuuuauaaucaggaaguuauuuagauaaguauauuaaauaauuuaauaaguuauuuuauuuaaaguaggauacccccacuccaaaguaagaucucacuuuaaaacuggcucaggggugagcauggugcaaucgaucuccaggaucuguuccucuuggauaaagugcugccuccaggucugaauaauauuguucuucaaagcacagccaacuggcccaaagucauacagaccacuaacaccuauagaauaugagaggaaaacacauacuuuaccuuguuacucugaacaaaugaaggcaaggagacaugagaaacugauaccuauacucccuaaaaguguauucaagucaacaaugcaaaucccucaauacugaagaaccuuacuuucagcuagcugauggaaguaaaauaaaaaagcucuuacgccauuuacuaauucuauauuuguaauuucaaguaggacuagcccaaaaucuacaacaaaaguucccccuuagagaacagaaugaaaaagcagauuacaguuuucugccguaaaaauuacaaaauaauuucucaccacaucugauaacaaugaucuauaauuuuagcauccaauucucuaauuuuuuccuggguauuugaggcacuauuuaaccucaaaaggguaaacauuuacagauccacuuagccaaacucaagucaacuuucaguggcaaaguacuauaugucuaauguuguuguaauaauccguugacuaugaaaaauauaguuuuacauuucaucagugaauuguauuugccuauauaccuucauauggcauucacagugauuuaucuacaucccugggaagaauguuuucuccuggcagaugaccauaaagaauaaucuaaggacuguuuuaucacugccccugugugaaggggcauaguauaguuagccaguacuacaauggcccucuguuacucuucagucuccauugcauuuuaaaaagaguacaugaguacacagacacaucaaauacauacaugggccuccaacaauucccuacauccuaaucaaaaaaagugcuguccaggaauaaaugcaguggagaaaaauaacagguaucacaccaaauggugacuccaagcaaacaaaagcaaaacauccauccucugcuuuguggccugauacaaguggauaccaacaggcaagccauguucuugauuuaaguauaauauuagagccacuaacaacacaauaguucuuuuugucauuaaucccuuaccuccauaaauagcaaaagcuugaucauagaaaaaccuccucuucaggguaucuuccauuuuugcucggucuacaauaucaucuuugggcuguaacgccagcuccuguuagagauuaaauaaaaagugagugaguggaggggugggugggaaucugaacuuauauaucugaauuuaguuuauuccucaccagaauuaaauauaaaauuuaucaaacagacaagauuuugauagguuaaaaacaauagaagccauaggucuuuuuuucccuuugaguaauauaaaagauaucuuuacuuaaucauuuaggaaaauauaugaucauuuccaagauuacaagacuaagcuugaccaggugcgguggcucacaccuguaaucccaguacuuugggaggccgaaguggguggaucaccugaggucaggaguucaagcccagccuggccaacauggcaaaacacugucucuacuaaaaauacaaaaauuagcugggcuugguggugggcaccuguaaucccagcuacuugggaggcugaggcaggagaaucacuugaacccgggaggcagagguugcagugagcugagaucgcaccauugcacuccagccugggcaacagggcgagacuccaucucaaaaaaaaaacaagacuaaguuuacuuugauguagauacugauaagcaauauaaagcaauauuugaauugucaguggauugcuauagcaaaaugguuacuuuaaaaccccaaaacaacuuaaguuuggugaugggagaucuauuguuugaaaggucugggagcagguaucaaauaaacagaccuuuuccuuaaaacaaacaaacaaacaaaaaucauuauuuucaggcauaagagaagucguaaagaagagcacaauccuuuccauggaaauucauauagcguauugaguccagcauuugcagggucaggaaggcuuuauuaaaaaguugacauuuugaguugcauuuugaaaggaugaggagucuaccagguagagggaaaggagaaggcggcauuauggauaaacagauaaaccaaaugauacuuguucagaaacuuuucuaggucucucccauccaaagaaauuaaagaugaacaauccuauaccuacuuauguuccuauuuuagcaucccaggacucaccuuugcuuccagaacccucuugcgggcuuugagcucagccacugcuuugucuacgucuacuuggggugcuuuaucuucuuugaguuuucgcacaagaucucccuagccaagaaagagaauuuauauucaggauugguuucagaaguuaagaaauguuaggaauguguuuuuaagcgugccuuuuaaaaagucuauguaagaaugaugcaauucaggccaagcgugguggcucacgccuguaauaccagcacuuugaaaggcccuccucaccaucugagaucaggaguuucagaccauccuggccaacauggugauacaccaucgcuacugaaaauacaaaaauuagccggccgugguggugggcaccuguaaucccagccacuugggaggcugaggcaggagaaucacuugaacccggaaggcggagguugcacugagcuaagaucaugcuacuacacuccagccugggugacaaagugagacuccgucucaaaaugaaaaaaaaaaaaaaaaaaaaaaagaaugaugcaauucaaauguuuauuaugugagugaucauuaugaaucaaggucucugcccucuucauuuaauaaucuagaagaacacacgggcaaguuaacaaauaacugcucacauggugaauuuuuuccuuuggguauagaggggugaaaaaggaggagacaaaagcauugauuaaaaaguaggaaagagcaagauuuguacugagaacacagaagaaccaauaaauugaccaccuucuuaaaucucucuccucucgcuuacaaaaaaaaauaaaaacauuauucaguuuuccucccacuucucugaccauucuucucagucacugcuggcucaucuuccuuugccuuucucuuuacaguuggaauuuuuuccuugcuaauauuucugaauuauuuuauuaacuuccaacaacuuauacuaauuccauauuuauaguaauaugguggaauaggucaucugaguaaacaaacaaaauauuaccuauauaggaugaaaaacuuucagcugaguaauuaaaguuguuaaauugauauagcccuugggcacccaacagaguuucuaauuucagugauccauuuccauacaauaugugcuucauuuucacacugugugauuguuuuugguagucucuuguucuuugcucauguuuuugaguacuucuuuuauuuuaaaaauuaucuuaagcauuuuaaaaauaugugauuauucuaauacuuuuggaggaucuaauucuauuaucauuuccccuaagucucacucaagguggcuuguuuccucauggguuuuuaaauuuugaguuuggcacuuacuauuuugguaaccuuaaucugugaaaaauccuaaaagaccaauguggaaagucugcuucuuuuguaauaugacguucuggguaaaguauaugaagaaagacauauguagguggaaaaggaaaaauaauuuuaaaagccguuucggauaauuguggauauucuuugauacuaccucaaaacucugacaagugguagcuucuucaagguuauuucuaacucagaaacuauagcaaugaauuuuuuguacugucagaauaaaucuauuaauguaucuuaagcuuugaauggcucuuucaccaauaccugauuucauaacaucaugcauuggucaccuggaaaacacugguucacugaguuacgcagauuauccaaauacuaucaaaaaaaaauccacguuuguuaauaucaccacucaucucaucacagauaucuuuaaggacugugaagcugccaagcucacagcaaaagauacgagucuucccaaauucuaaaauuuccccaaaguuugaauuuuauuauuggccacaaauacuaaccguuguuuucuuaaagugacaaacucacuucauucauuuuccagauuaacaaauuucuaugaaacaugugcuacuaacaagaccagucauuaaguaaaaaucccacuccggaaagguuuucaauugcacuucacaauggaguuauccaaaauggauaggggugacagugugucucauuuccccauauacaaaaaauggguaaaauuagaucaucuuuaaauuauuuuucagcugacauaggacucaguaauucacacaauuaacuaacugauauauguguguucuuggaaaauuagaaaaaaauauccaaacuaacuuaaaucaacuaacucguauauucggaaaauaucuuaaaguacaaaacaauaaucaagacaacauaaacaauacacaagacaguaguuaguagcaucggaaagcugccgcgaucaaaguuuacuuuaguuaacuagauccugucuuaacuaccgauggaugauuuucacugcaguuccaggcuaacguggcagagggagggguuuggguguggugguuuuuuuuuuucuccaaauuaguuguaugcuuccuucuaaagggaaggauauuuuuuaaaauggcaaguuaagaaaagacaaaggaaccacaccuaauuuuauuuguggaguggaagguggguggagggagacagaauaugcaaucgguguucugacaccaaucaugaagaaaaaaguuaagcccguggugauauuucaaaaugaaaggcuauuuauuaaaaucggucaggcucaaaccagcgaagaggacagauggcaaaguggcugaauuugcggcagcuaugccccaaugaauuauuuccgagauaggguuccacccucuguagcuaaggcaaauuauugcaucaggcgcccaugcaggagaaacccguuugguguuuacuacuaagucaugaucuccgggguccuacugcaagcucuggcucucccuaauugcauaugggaaucaucugaaauaaucuuuuccuugauaucucuaaauucuaaacucuauggcagugcccuaggaaaaggaggucuauauuaaaucaccaaguccuucagcccaugaaaccuucccucaccuucgggaaaaucaaaugucaaaauauuccauacuaaggauggcugacuucacuccgcaacacuuaguuucccagguuuacgaucugagggcucacugguuccaaacggccuuuucagaagccagaaaagaugacaagagcaaaggaugaugaguucacagcauuaauagaaaaguucgacaccuccccacauccacauuucaauucuauuuucucagccaaucauuccgcuaaacuaagcacugaaugaaggaagauguuaagggggaaacacuaucaaagcauccuaaagauuaaagggccuggccguaagacgaaagaaccggcaguuuuucggcucaucauugaccacugaaagaauuaggaggcuuuccacccagggugcacaaagaguacagcagagccuggaaaacugaaguuaagguuauucaguuaggaggcgaggacaaccaaagggucacagaucccagccccacuggaaauagaggagacgcgggcugugacagaauggggaagggagaacggagccggagagggacgcaggaagucggagggguuccagggagucauccaaaaagagaggaggacggagguccgcgggagaggagguggcugacgcacgggggacuugggaccaaagugggggaggcgaagaagacgccagaggaugaagggaaagaaagggguaaccgaagaggaggacaguuccccggggaggagggaaggaugaccagaagaaggcccugggaggagagccggaggcuuagcggagagcgcaaaacaccgguaccugcuggcgcacugcuagccucagaggugccagcaccuccucagcccccgcgccguccaugcugcuccgggaggcggcggcgggcaaggagaucggggggcaggaggccgcgcugagggaccggcggagcaggagcgagggucgggcuaagagccggggcggcagcagcagcagcagagcggcgcgagcaccucuaagcagcacuggacgcggagagggcaugagccugcggcccugggcuguccagagaggguggcgacggaagcggcgcgcgccgcccggcucggagcaugaugaaaucgccgcguaaacgacgcggcgcgcgugcugccgcacauucaccaccgcgugacgcggcgccgggucgccgccgcagauucgacacaaaacccggaaggaccccgccgaagguuuucuccgguucgggagagagguagguaggguugcgagcgaacagauuugcacagaagugcgucaagccaccccagcaggguggauguucagggacacagcucugagcgagaccugcaggccgagacacacgagaaccuucaaagcauagguuuuuauacgagugac

SEQ ID NO: 191616 - RNA, 23691 nt, Homo sapiens
uagauauugaauauauacaauuuauuuaauaaauuaaugucauucaaaauacagugccagaacauggugcaguugaacaugcuaguaauguuugucaugaagcaccugugcucauguuagauuggcggcgccccacuacugcuagugguuccugggauuaaugccagagcagcgcuaguuaucugcucuucugcacagcuagugcagagaauuccugaacaguucaccuuacuaauccuaacccccacacgcacacaacagguuaaaaaaaacacacccugacagcuaacagaucuauacacaaucacucuacaguaaugcuuguuauuaaauuaagauguaaugaccugguuaacccacucuaaaucuugaagauggagaacuacaucagcagcagauaguuauaugcaugagccaauguuaacauaauacagaaaguggaggcuuuuucugauuaaagcuccacgcagacccgcacaaugaguggcuggcaauucuuacugcaagccuagcaacuuaaguccacaccugguaaaugaccagcugacuggaagaccuguauucuagauagacaaguauaaguuagugaaaagagaauacaugcaccuaauaguauaguuagacugauccugcagucauagcuuucccuguguaauaccauaaaauuauggaagaucuuccucaacuagaguauaggauuuagacauuucuauaccaacacggacauuaguguuaagugcaguugaauuaauuacacugaaaacuguauuccaggacuucagaacagaagcacgggaaugaaacacacauacuaaaauaaccucagcacaauuugugauacaucacacuaggaacaggaaacuacuuuuauaaaugaacuuuuugaacuguacauacacagggcuaacaauguuagauaauccagauucuuauacucucaugauuacacauaaaguuucucaauuauugaauaaucuauuucauauuauggaagcauaucuuucuguaagacucacugauauauauuauacugaugcaaauauuaaguagggcauaaaaauaaaauuuaucaaagauagaauuuuauguacucauauuuaguucuuucauagccucuuuuguuuagcaaagaaaaugacaaagcacauaacucaggcgugcacucccugaacuuccccacuauacaggugguagugcaaccauuucuccauccaguucaaacucuucugucccauccguugaaaaaagauaaguuggugguuuccauggagacucuucaaggcaggauggauagaguuuccccacagugcaucgaaaaucucuccccaagucccacaguacacguucagauauaugcugccgcagagaccaccggucaaguuccaggucauauugguaggugacguauuuagcucgcucauuuaaguggguuucucgcauaaacacacauagagaauuugagaucacaacagcucuaacacaggggucagaguaccucuuagcagggauguuggcugccauuuuccacucauuuuuauucacaucauaaauuuccacaguuacugaagacccaucuacagugccagaggggagucuuaugccggaauugguagcaauaugcaacccuccaauauagaaaauuuuaucaccaaaagcugcagcugaagcaaaggaccuacuagucugucucauggccauuucuacccaugagucagaccuuggaaaauaacaguacaugagguucagugucaucacauaaaugcagucaugaaccacaacugcugcacuccauugccaagcacaagguaaagggcuuaccaucguccacucaucuuucucagugucguaucuuucuacgguccuccgauuaaguucuccaccuacgcuaucuccuccaauugcauagauauagccuucacagcaaaccaaagauggcuuuaugcggacaaaaagcauuggggucuuuggaaaccagguauuuugcugugcaucaaaccaauaaaagcaauucacaguucugaaggcagucugaaguuugcuuguuuuacugugauuuguuuuuguguuuuucagaggaacuugacccccugcuauguagauaucauuaucaggaguuacaacggucccaaccuuaugcaaaucagcuggugggcuacauaacuuguaaacuuuuucugcuugggggcuguaacagacagaagaguaaagacuacaaggauuuucugaagaugcuucaaugaaaaucaucauuuccucuuuagucaucccaagucuugguuugaaaaacuugggcauggacuuauacagaccuugaaccaccacugacuuaucauuggguggcagaccuugaaaccaagcucucuguguuacuucugaaagugcaucaauucugauuuggcuaagaacagaagacaaauacugggaucgugauucuguguuauacucuagccacagcauagcagcuucucgaacgguuucuuccuuuucuacauuuaaauugucacuacugagaauaucuaucaguaggucaugugacagcugcaugaacgcguccugaugauacacagcagugaacuugugcuccaccauucuuuuagcacucuguuuuaauuccucacaacugaagagaucagcaaaacucaacaaucguacacaauucucugcauuuauuuuuuuaauuaaauauucucgacaacguuguaacacaucuucuaccuagaaugagaaggaaaaaaaaaacaggcugauagggccaggacagacacauuuuacuuuuauguaagacguaaguauauuaaucagaugcccauaguguaauuuuuauuuucagauacacacaucugggcugagauaaggucuucugguaguaauaaacucagaagacuauaaaauuuugcaguauuuuuuccugcucaguggccuacuuaacuguucuauuuaggaaccagcaguacaacaauaaauaggcucuuaaaaaacaaaacagccuuaaagaauagguaaggaaauucacacauaagucauacuuuccuagacuuuauauauaauugagagaacuauaugaaaaaauguaaauaaaucauaguauagagaaaauuauuguuguugaauaacuggauucugguuuccucaauuugaacacagucacauaaaaccagaaaaucaugcacaaugaguaagaguaguuauuugccauucuuaucgagagguaagauaacaaagcaacacgaaauagacuuacgugcaguuauaaaucaccuacauuuaaaugacccaucuuagccacuguaagcuuccuagauuuguuuuuucuuaagaagguagaucucaguugaaucagaugugcuacccacuauacuuauucagcaucacagugauuaacuagaaacuguuuacacugacaagucagguugcuuggauuuaaaacuuaauuggccaauuaguaccuggaaacuacuuauuaggaaagaagcuucacaucucuaaacuucaauuuucucuuauauaaaauggggaaauaauaguuaucucccucaaaugagcccuguaaggaucagaugagaauauauauaaaguaucaguacaccaucugguacugaaacauaugaucacuucaugugguugauagugaaaguaauauugguagucauagaaugccccaucucaggcuuccagggcaacacagucuaagaggcagaguccuguuuugcauuugagcaagcagaaguaguauacgguuuucguuaaaauggcagaaaaaaaauguuaaggagcagugucaauauuuacaguaacaaaguauucuggaaucagauuuucuuaaaauuccuuaaugccuuaguaauucugagaaaugccugcuuuuaaaagaaggaccaacaaaaaauuagcuggaugugcuggugcaugccuauaaucccagcacuuugggauuacagggaggaggauuacuugagcccagcaauuugagacugcagugagcuaucaccaugccacugcaugguggcaugccacugcauuccagccugggcaacagaacaagacaugucucuaaaaauaaaaaguaaugacaacuugcaaacuauauaaagacagugcuuccaauaagcauuucucccguucaaguuuggaauuacuagugcaccagcaagcuaccccagccucaguuuccccagaguuguggguagaguagaacacuaacgauaaaguuaguguaauaaggaguaaagguuggccagguguuguaacucgcaccuguaauccuagcacuuugggaggccuaggugagaggagugccugagcucaagaguuugagacuagccugggcaacauaagaucuugucucuacaaaaaaaucaaauaauuagccaaguguggugaugcaugucuacagacccagcuacucaggaggcuaaggcugggggaugacuugagcccagaucgaggcugcagugagcugugaucucaccacugugcugcagccuggacaacagagcaagacccugucacacaaaaaguugaguaucccuaauucaaaaauucaaaauccaaaaugcuccaaaaacugaaauguuuugagugcugacaugacacuugaaauacucacgggagcacuucagagucuagauuuuuagauuagggaugauguaaaucuaacauauaaugcaaauauccuaaaaucugaaaaaaucugaaacuggcugaacuggauuucuggucccaaucauuuuggauaaaggguacucaaccuauggaagauuaaaaaggaaggagacuacauaaagcaugaacugaguucugguuuccagaauuauacccagguguuggcauucaaccagugucaugcauacucauucagugcauauuuauuaaguacuuaacaaauaucacgaacagugcucuccaaauuuaaccuuugaucuaaagguucucccucugaagaaacuuagugaaauacaguguuauuccaaaacaggagaugaaaugaagaaaaaaacucuuauauuccucuuaaaauuuaaaaagggaacaugauggggaaauaaagaguaaaacaguuugucauacauaaauauaucaaccaucacuuguuuuguuuaaauacuucuccuuaauugcucaauauggucacauagccauuauaaauauuuaucauaauuuccaccaaguuuucugugaaaaauaguaccaugaaaaauuaguauaucuaagcucuaagcaaaaaaaaaaaaaaaaaaaauugaaacacuuaaauucaauaaacacuguuaaaaauuacuuuaauuuggcugggagugguggcucaugccuguaaucccagcacuuugggaggccaaggcggguggaucauuugauggcaggaguuccagaccggccuggccaauguggugaaaccccaccucaacuaaaaauacaaaaauuagcugggcauggugguacaugccuguaaucccagcuauucaggaggcugaggcaggagaaucacuugaacccaggaggcagagguuguugugagccaagauugugccagugcacuccagccugggcaacaagagugaaauuccgucucaaaaaaaaauuacuuuaacuugaaaucaaaauucucagguauauuagguaguaaaacacacgaaaccaguauaaaauuuucaccuaucucuuuuauuaacagauuuacauucccaucacaaaacuacuuaguuuacuggguaaucaaauccuauuguuuuucccuuacacauuuuguaaaaagaaaaaaaccuuuuaccuucuaaaacacguaauaagaaaauuacauagauaaaagacauuacugggccaggcauggugguucauaccuguaaucccagggcuuugagaagccaaugcaggaggauugcuugagccugggauuuugagaccagccugggcaacacagugagaucgugucucuacaaaaaauaaaaauauuggcccagggagugguggcucaugccuguaaucccagcacuuugggaggccaagguggguggaucacgaggucaggagaucgagaccauucuggcuaacaacggugaaaccccaucucuacuaaaaauacaaaaaauuagccggggguggugguaggcaccuguagucccagcuacucgggaggcugaggcaggagaauggcaugaacccagaggcggagcuugcaucugagcugagaucgcgccacuagacuccagccugggugacagaaugauacuccgucucaaaaaaauaaauaaauaaaaauaaauaaauaaauaaauaaauaaaaauaguagcugggcaugguggugcacaccuuuagucaucccagcuacucaggaggcugaagcaggaggaucaccugagcccaugaguucaaggcuucagugaaccaugacugcaccaaugcacuccagccugggugaccgaacgagaccccaucucaaaaacauaaauaaaaaauguuuaacaauguuuccucacaaaauaaaccacauaauaaaccaauaagcuacaacucauguauguaacugaguaaaaaaaugcuuaccuguaggcuggacacaguggcucacgcguguaaucccagcacuuugggaggccaaggcagguggaucacgaggucaggagaucaagaccagccugaccaacauggugaaaccccguacuaaaaauacaaaaauuagcaccuguaaucccagcuacucaggaggcugaggcaggagaaucacuugaaccugggaggcggagguugcagugagcggagaucgugccacugcacuccagccugggcaacagagagagacuccgucuaaaaaaauauauauaugcuuaccuguaggaagcaagcuguuucauaaagcuguucuacagugcugucauucauugccaaguuacccguguaugcauaaguuauuauuaucuguaagguggcagcaucgacauuccucagguguacauggguuuguuugcuuucacuuaguccacucauaaacauggcccuacaggggagaugaagaaaacaaaguuguaaggguuuuguguaaaacaaauguagagcugaaaagaacaauuagacaauaagagguguuuauuuaggguauuuacuuauaagagaaacuuuuucuuuuuuugagacagggucuugcucugucccccaggcuggagugcagugguaccaucauggcucaccacagccuugaccuucugugcucaaacgauucuccucagucucccaaguagcugggacuacaggcaugcaccaccacacccagcuauuuuuucuuuuauuuuuaguagagacaaggccucccuauguugcccaggcuggucuccaacuccugagcucaagcaaucuuuccugccucagccucugaaagugcucggauuacaggcaugagccacugugccuagccaaugaaauuuuugagggagacagauaagaauaaaauccagucccaaauauauaccagacuauuccaccaugccauuuugagugaaaaucucaaaauucuauucacuucuuauauucauaccaugaaauaauacucagcaauaaaaaggaacuaaguauuaauauauacuuuaacauaaaugaaccugaaaacauuaugcucagugaaagaagccacacacaaaaaaccacauaguauaugaguccguuuauauaaaacgucuaaaaaaggaaaauauagagacagaagguagauuaguaguuccuuagaacuguaagaauggggucugugacuauaaauagacacaaagugauaaaagugcucuaaauuuagauuguggaaaugguuguguaacuguaaauauacuaaaauucauuuaauuauauacuuaaaauggguagauuuugugguauguaaauuacaucucaauaaagcuguuaaaaauucauuuacucaaacaauucucuaaaaauaugcaggacacuuuccuaaaaaucuauuauauacaggaaaucaugauggaaaggcaacuggcaucauggagaauacuaaguagaaugcccauauauagguaagagaggaaaauaggagagaaaagcuucugcauguagcggucaacagugagugucacaacagucacuaacuugggcacuaacuugggccccucaaggacagagaugaagaagccauucaaaauggauaaaacaggguagaacauaagaagcaauuguucaaggggcauagcuugaacauaagggcucaugcaggaaaccagaaaaugaauuggaaagauggagagcagucagaucacagagggccuuuaaaugagacaagagagucugagcuuuuccuuguagauaguggggaaaaccaaaggguuucaagucugaauuuagcaugacaaaauguaagugauaaauguaggaugaauacucuaagcugacagacuauaagagcuaaaggcuagagacaggaaaacuggcuaucaggcuaugacaauaauauaccuaagagguaagaaacuaaguuauauuggcagaaaugaauacaaaaaccacuauagcugggcgcuugguggcucacacuuguaaucccagcauuuugggaggccgaggugggcagaucaucuuaggccaggagcucgacacuagccuggccaacauggugaaacccugucuccacuaaaaaauacaaaaauuugcugggcgugguggcaggugccuguaaucccaacuacucaggaggcugaggcaggaaaaucacuugaacccgggaggcagagguugcagugagccaagaucgagccacugcacuccaacccgggcaacaaaagugaaacuccaccucaaaaaggaacaaacaaacagacaaacaaaacccacuauaaagagccaauaggaucuggugcuuuucuuuuucuuuuuuugagacagagucucacccuguugcccaggcuggagugcaguggugguaucucaguucacugcaacacccaacucccagguucaagcgauucuccuacuucagcaucccgaguagcugggauuacaggcgcccgccacuacgccggcugauuuuuuguauuuuuaguagagaugggguuucaccguguuagccaggaugguuucaaucuccugaccucgugauccgcccgccucugccucccaaagugcugggauuacaggcaugugccagcacucccgaccagaaacagcaaauacuuaauuucauaauauuguaacaggcugaaguaccacaacagaagugcugaguaauucucaagcaauucucucauuuugggucuaaaaugaacuauaaauguuaccaagaaauauuaaaacuauuauucagagguaccuacuaauuauuggugggauagacagaacugguaacucaaacuacaaaggaagaauguauuuaguucagaaggcaaaaucucuacaguagauguauaggagcauuagauguaaagaucucgaaaucuacaauucugccagcagaaucuaguugaagaacacuugugaaaagcucaaauuauauccuguggauaugaaacugucccaggcacaagauuuuaaugauggauggcuucaaccccaaacacauauugaacuauuuuuauuuauuuaauaaauaucugauuuguuuuagguauaauacacaguugucccuugguaucugugggggacugauugguuaacaaacuucccagacuuggcuggguacaguggcucacaccuguaauuccagcacuuugggaggccgaggcggguggaucacuugagaucaggaguuugagaccagcgugggcaacauggugaaaccccgucucuacuaaaaauacaaaaaaaauuagccgggcaugguggugugugccuguaaucccagcuacuugugaggcugaggcacaagaaccacuugaaccugggaggcagagguugcagugagucgagauagcaccacugcacuccagccugggugacagauugcgacugucuuuaaaaaaaaaaaaaaaaaauuguaggcauagcaaaggcaacaacugguguuugagccuuagcuucugcaaucaucaugggauguguuagggaaugugaaguuucgguaucuucauacaaagucagucagcccugaaaggucaaaugaaaucuauccugucuauagcugccauuaaagaacagcagaacaggcggugcgcaguggcucacgccuguaaucccagcacuucgggaggccaaggcagacggaucacaaggucaagaguuugagaccagccugaccaacauggugaaaccccaucucuacuaaaauuacaaaaauuagcccaggcgugguggugcgugccuguaaucccagcuacuugggaggcugaggcagcagaaucacuugaacccaagaggcagagguugcagugagccgagaucgcgccacugcacugcacuccagccuggacaacagagugagaucgucucaaaaaaaaaaaacaaaaacaaaacaaaacagcaacaucaaacucacuaaugauugcugcuuaugucuguuaauauuuguaguagaaauauacagguccacauuuaauucaccuuuauucucccugucccuuucaaauauuaagucaaaauuaccuaaaagcaaagaacaaauaaagcaauccaucuaugccuuggcuucuauucugcucaggaaacguacaacaaagacgcaaaagaucauaaaaauguaaaguuaagcuuuauguauuuguuauuagcaaagaguaacuaaauuaacuucugcauucagaggcauagagaacaccaacguuacuaguuauuaaauauuuaaaucuggcaaagagucuaguuaguauaaagaaauaucacaaaugguaauaguaaagagugagaaaaaauauauuuuguaaagaaaagucuuaaccuaucuaacagcaccaauuuuuacccucuaaaaauuacuauuugagccuauaacuugucaguuuaaaaacagagaucacuguuuucuaaaggcagcauuuuaaaaucucaaaguguaaauuaucccauuuuucuuucucuuuuaauggaaaaagaauauucuaaaccuuucugccuucccaacauuaaaacuuuaccuuaguuaauugcaacacauuucuuguauuucaaccuuuauaaaacuucuuucaugugucucuuacacaugcaagaaugagauuugccaaguacuacaucaucugaauagaaaccuuaagcaaaacuuaaaaacaaaaauugagauguggcuuuuuaaaaaauuaaauaacauuucaaagaauuucuauuuaaaacauuaaaaguacuuaccugaaauaagagcuacauguugcaagaaccaucuuaugacaagggaauucagugcccucaacaauuaacacuaugucaguaaacaacugcuguucauaaaacaguuucaacuguuccaacaaugacacagcauauucaguauugaucugccucucgucuugaguggacaugacuguauuccauuaauaucuccaggaacagauuagaaaaguccgucuuacugauggaaggucaagugaauacuucagaaauaaaggagaaccuacuugcuguuaucugcagcauucaguaccaagacugacacauucacuaaugaguaauaucuuguuacacagacuuagaaucacuccuaggucauccuguguuaauuagguucuucagaguuuuucaacacagucugcagacauugugcucaaaucugcaauugugcagcucaugagugaaagagaaaaauacacgagguagauuuuguggcaacauccuauguucagcggauccuguggaguaacuaaaaagaaaaaaaguucaguuguaguaucuaggccaguacgguuuuagaauauaacguuuaaaauggcagccuuaaauagaaaucauauuuauuucaaguucaacuuuagacauuaccauaaaagugaaacaugacaaaaaugaagauucuuagucuacauuuaaaauuaaaaaacaagaaaauuaccaguuguaauuucaaguuaacuuuugccuucuauacaaaauauaacugucacagaaaauaacgaacacaugaauaaguacacauuuuuaaagcucuuucaaaauagacaacuuaaauuaccaaagccagaucucuuaguuauuugucugguagcaacaaaugaucauaauauuuaagaaaaaauauuuuuuuaaaaaaacaaaaaaccugcucuccuacacagagauuucucguucuccgaauauauuuuaaacacguucacaaagucuucauauuuaauuuaaacuauacgguaaauagauucaaacuguuaauuuucaaauuugccauucaauucacuaggagaacuauauguaauuuguuucuuuguggagugguucuuuccuaggaaucuuuacaaauaaaaguauauuuuacuuaaaaaaaaaaaacauaaaauguaauggguauauguuccuacccagaaaacuccauauuacacaaauaugaauguucuccgaauuaauauguaacuuuaauacaaauccaaucuaaauccuauuuucaagggauuuaucuggaagaaugcacaaagguugcuaagauauuugaggggaagaagggcaaguuuuuaaugauuuuuaugaaaauauuaaauguacuauaaaacugccauaaaaccaaguacacauaagaaaccagagaugacuggccgggcacaguggcucaugccuguaaucccagcacuuugguaggccgaggcaggcggaucacaacgucaggaguucgagaccauccugaccaacauggugaaauccugucucuauuaaaaauacaaaaguuagcuggccgugguagugugugccuguaaucccagcuacucaggaggcugaggcaggggaauugcuugaacccgggagguggagauugcagugagccaagaucgcaccacugcacuccagccugggugacagagcaagacaccgucucaaaaaaaaaaaaaaagaaauuagauaugauaaagauaaauaugguaucucaaguuaggaagaaugguuuauuucaacaaauaauguuggaaguggcuaacugcucaagggggcaaaaaaaccuaggcuuuagucauacugcauaccauucaucaaaaaaaaaaaccaaaauuccagcugaauaaaaauuuaauuuggaacucaguauucacaacacauggcaaaggaauuacaaaucaggaaaagaggaaaaucccaaauagaaugcuacuaauauguuaacuauaaaaacugccaccucuuuuuucaccaacuguuaagaugaccauuaguuaccauaaugagaaaugacuccaucauuagaaucacuguuauuuuuccucacaaaauaccauccauuaugucaaagagaaugacauacacuuccugacaaacuauacuauuacaguaacugcuaacuugauauacagucaaguuuccagccaaguuaacuuugaaaguaacuaaaacaggugcaaaggcagagugagacucugggucauuuaagguaauaacuuugcucuuccagaacagcaugucacacuauaaaucugaguucuacuacuauaaucucuaaggcaaauaauacuuaaaaucacuggcuauuuccacacauuaauaaugcagcaaggcauaguguuguugaggguguggaaaaacaagcauucuuacacagaggaguaaguugauacauacccacaaucccuuauucaaaacucuugacacaagacacgcuccagaauuuacacuuuuccagauuuuauagagguauugugacacauguacccuacauuaugaaauccucucaagaagucucagguagcaauggauaaucaaacauauuaucuuugcugaggcaacuaugaauggugucaaaaauaaagacuauauauagccucacguuacuucaggucagguuuuacuagcaaagauuuuuuuuuuuuaacaacuugauuuuucagagcuuuuugaauuucaaaauugcaaguauuaauaauacuuggcacuggaaaugcuuaauaccaaucuacuaauccuacuucuagaaauauauuuuacagaaauauaugcauuaauaaaguagaaguccuaaucccaguagcuggacucaaaauuguccccauccauguuuaaacaaggugacagcaacugguggccagggccaagacagacuuaaaucaugccgcuagaccccagaauuucuugcaggcuagcgguacaggcucacucuggucauuucauuaaccauauaauaauaugauuuucugcaaugauuuuggggaggccucauuuacgacuggguuuugccagauuugauuuuuuaucguauccaugaaaccguauuaaaacaauugaagucugcuucuaaaaaaguacaaagucauacucauuaacacagcuuuauuagauuccccuauuucccacucuucuuuuguaauccaggauacauuuucuuccuggagaggcagccuacguaaaaguuaccuuaaaauaggcagaaaaaguaagucauucagauaugacacuaaguaaauaaacaaguacaauuaaaaauaaaauuaaagucaggagugguggcucaugccuggaaucccagcacuuugggaggcugaggucgguggaucacuugaggucaggaguucaagaccagccuggccaacauggcgaaaccccaucucuacuaaaaacacaaaaaaauuagcuggacaugguagcacgugcuguaaucccagcuacccaggaagcugaggccagggaaucaccugaaccuggcagacggagguugcagugagccgagaucgugccacugcacuccagcccaagucacagagcaagacuccgucucaaaaacaaaacaaaacaaaaacaaaaaauaauaaauaaaauuaaguaucucaccccucugggagcauggacuucaaaagguauuaacuaaaaaugugaaagcuuggccaggugugguaacucacgccuguaaucccagcacuuugggaggccuaggagggcagaucacuugaggccugaggccuggaguucaagaccagccugaccaacauggcaaaacccugucucuacuaaaaauacaaaaauuagucggguaugguggcucaugccuguaauacuagcuacucuggaggcugaggcugcuucaagcugaaacucacuugaacccaggaggaggagguugcagugaacugagaucacaccacugcauuccagccugggcaacacagcaagacucugucucacgaaaauaaaaauaaaaaugugaaaauuugcaaaguuuaggacgaucaaccaaccaucuucaaaugcccacaacacaaacauuuucuguaaaaggcuccuucccuccuaaaacuugaaaccaguacucuaaauccucugaagcaauucaguauguacuauauuaauuaccaacugaugugacguauuuuacaaauuuucccuuuucaauaauuacauuuuguauaucauucuauaucuaaaaucagcuucaaaacgucacagacccuguuaucuguagaagccagcuuccccagauuaauucucagguaucaaggaaacuguugacuuaauuuucuuuucugaaugaauggcuaaauuccacaaauguuuauugaauacuaagugccaaucauugcacuuuacauacucggauucagagaagccaaacacuaaagcuccaaaacaccaagggcuuuuacucuuacuacagauuacagccacagcuacagcugucauucaaaaacaugguguuuuaaaaaccagcuauucuagacaaacuuaaaagccaagaagcaagcaaaugagugaagcaagcuggguauaugaaacauuuuucuugaaauguagcuaucuuaaucuuuuucuuucaaacuuuuaauagagacaugaguucaagaaauuuuacucuuuaccguaagaaaaauuguaguacagguaaaaugagcaaagguaucuggugcucagcccuacuacuaacaguggaucacacaggaggaaggaaaaacuuauugaagaccuauuuaaaccuucuggauuuucuuaauauaugcaaugauuaccugauuuuuacaaaauaaacuuuuggccagcugugcuggcucaugccuguacucccagcacuuugggaggccaaggcgagaggguaccuugaggccaagaguucaaggcugcagugagcuaugaucaugccacugcacuccagccugggcaacagcaagauucugccucuaaaauuuuuaauuuaaaaaaaaaaaaaaaaaggcugggcacaguggcucauaccuguaaucccagcacuuugggaggcugagguggacagaucaccugaguucaggagauugagaccauccuggccaacauggugaaaccccgucucuacuaaaaauacaaaaauuagccuggugugauggugcgugccuguaaucccugcuacucgggaggcugaggcaggagaauggcuugaacccaggaggaggagguugcagugagccgagaucgcaccacugcacuccagccugggcaacaagagagagacucagucucaaaaaaauaaaaauaaaaauaguaauaauaauaaaacuucaaaagguacacuauucucucuucucauaacaaagacaaaauauuuuaggcuuugggagccauaaggucucuaucccaaagauuuaacucuugcugcagccugaaagcagccaaagacaauauggaaacaaauguuauuucaauaaaacuuuguuuacaagaacagguuacaggccacauuuaccaaacgcugcuuuauuuuuaaaaauuuauauuucuuuuauauauauauguguguauguguguguauauauauauauacacauauauguguauauauauauauauacacacacauacacacacacaaauuuuaauuuuuuuuuuuaagagacaggauuguacuauguugcccaggcuggucuugaacuccuacguucaagcgauccacuugccuuggccucccagaguacugggauuacaggugugaaccgccgcaccuggccuuacacugcuucuugaugaaauauuuagucagugacuaaaauacguaccucaaguuguuucugcaagaauaauguuucucuucagaucacaaaacaaggaaaagcacaaacuuuaaauuccugaacgcggaauuaaauauaauucuuaaucuaauuuauauauauuccacuuuucuucucaaccaaaauauucuaacaucuuuuaccuagucacacaacugcuuuccccaauuccugcuaguuccguggacuuccgaaacauguucuuaucuagugugaguaccuuuaauuaagguuaaaaaaaaaaaaaaagacaucucuccccaagauaaccugccaaaaaaaaaauccauacugagaaaaagcuauucaaaaacacuuaaauuacuuugggaaaucccuguuauaagccacaauuccugguaucaggugcuuccagauuaguaagaaaguccuauauucuaacacugaucauuagaauauauuccauaguaaaaaaugcuaaccagcauaagaauuaaauuggagucaugcaaacacaauauaaugaaauucacaaucuuaauaaagugcaauguacuuugacauaaaaaguguacauauucuuacuccuucuuuuaaguccugcgcucaauucaguguuuuugacugauuugcuugaucgcagagaauggcaaagauaagguuaaaauguuauacacaggaugaaauccucuccuccacugucuacacacuuuuuuuuuuuuuuuuaaagacagagucucgcucugucgcccaggcuggagugcaauggugugaucuaggcucacugccaccuccaccacccggguucaagcaauucuccugccucagccuccuaaauagcugggauuacaggcacgcaccaccauguccggcuaauuuuucacauuuuuaguagagaugggguuucaccacguuggccaaguuggucucaaacucuugaccucaggugaucugccugccucggccucccaaagugcuaggauuacaggcaugagccaccacguccggccucuacccacugacuuucuacgaauuauuacaggacaaaguccuauuuauuuuuaaauccgaagacuaccuacagaagucaaaaauuuauaaacugauugaaaacaaaugcuucuaauacauuuucucuaggaugcccaagucuccgagguucugagugaauuccaacacauaaaaguuuugaaacauuguuacuaaaugauugucaggauuaaaucaguuagcaaucgacaguaacauauacaauucuacuuaaaaaucugaaacucuucccacaaaauauuauuucuagagaugacuuaaaguauugggaggauaugcacagguuaucgaaaauacuacggcauuuuaucagagaccugaguguccuuggauuuucauaucccaaggggaccuaggaacuaaucucccacugaaaccaagagacaacuguguuucuaugcaacaaauuuaaguugguugucugaauuccucacuuaacuuuccuauaaaauaacaguauuaaaaagguguuuaacuucucacuauaagcagcaaaacaugccugaaagucuaucagcaaagaaaauuuacaaaguaaauacuacuuuaauacucauaaagagauaagugaccaugaaauuguuuuacagauucugauuauuaacauuaaaggauaaggaaccaagauuaaaaguaugaaauguugaaauuuuuaaaaaaucccaaauacuuuuaaagaugucagagguugauggcaguguuuuggcuuuuuggggggaggcaaugaggggggauagaugucuaauuucacuuugaaaucaaguuuucauuccuagagguguguacuuuguagcauccucccacugaguagccuggaaacacaaauagaagcaaagcaagcuuuuccaauguuaaccaggcagaauauagagacugaggaacgaauaaaggauuaaagaacuauugaaugugauaaagaaaccaaucagcaauuaacugagcuguggaugaaaaaggaagaaaggauaaaaagaugggaaggaggcugcuagcaaggccugcuacaauaagcacaguaguagguacaaaguuuccauuggacaggaggaauaaguguuacugaucuguuacacagcauguugaugaucgcaguuaacaauaauauacuguguauuucaaaacugcuaaagauucuaaauguucucaccacaaaaaaaauaaguacaugaggugacagauguaaauagccugauuuaaucauuccucaauguguacauagauugaaacaucacauuguagcccacaaauacauacaauuauuugccaacuaaaaauaaaauaaauuauauaguaggaaugaaggaaugauaggucucccuccaggaggggcagugcggcuauaaaucauucaccuguaggaagcacauucaaauuguacauuacuaacuuagggagugcugcaucucccaaugcuacaaaugucaauagagaagauuaaaaauuuuuguuggaaaagauccaaggcguucuccauggaggucaaccguugaaaaauaauugaguacaaacccaaacuacuuggguuaaagccccaguucugcaacuuaauagcuguguggcccuuuuuaaguuauuuauucucuaugccucaguuugcucaucuauaaaauguaguuaaaaguacaacucucuucucaaugaauuguucuaggauuacauuucauacuugguucaguaccugacacacagcacuacacagauauucgaaauuauuuuuauuaacccacccacuggugaagcuuuugcagcacuuucccaacuccuggauuccacaccuucaccagguccgaagauuccaauuucaaggucucagcacuccaaauacaguucucuuuuuucauucugucuaaaugguauuuuacauaagagaaauccaauguuuucagagaauauugggacuuuuuugcaaacauuugacacuugaaaucugaauucaguguucuaaaauauuaagauaauuuuuccuuuuuuuuuccuuuucucacauauuuugaugguacaaauaaugaaacaaacuagugcuuaaaagacgaccaaucuugaggaggcugaugucaguguaaaaaacuaaaugagaguccagaaaggcaccagucauaaaacaagccuuucuuuauuucaaugagauaguuuucuccuuaggaaggacaagagaugggugcuagaaacaguuugcuuucaaguuaucaaaacaaccacgacaguugagaaugucuggaaaagaccauuuguuuuuuagauugucaacugcuacacaaacagaauuuucuggaguugugacaggcaucaauuaaaaaacaaaccaaaaaaaaacaaaaaaaccaaaaaaacaaacaccuggccuuuugaagaaucuaucaaguuuuaaaaauuucagcauacuugcagugagccgagaucgcaucacugcacuccagccugggcgacacagcgagacuccgucccaaaaaaaaaaaaaaaaaaauuucagcauagcuuccucugcucuagucacauucagagcuuaggucuguucucucuuuccaaccauacugauagaugacauggcuccaucagguuaauuacgcucagcacccuaaguaaauucaggucacaaguacaagcuguacuauauuaugauuaacaaguuaucucaguuuuaaaaaauuaaacaagaacauaaaggcaaugccaccugcgauacaauaaucauaugaguauacuauguccuuuuauuuuggguaucacuuuuccuuuuuccucucaccucugcgcagugacuuaagaaagcuggggaaaaguggccaggcgcaauggcucacaccaguaaaucccagcacuuugggaggccgaggcgggcagaucaccaggucaggagaucgagaccauccuggcuaacacggugaaaccccaucucuacuaaaaauacaaaaauuagcccagcgugggcuacucaggaagcugaggcaggagaauggcgugaacccgggaggcggagcuugcagugagccaagaucgcgccaccgcacuccagccugggcgacacagcgagacuccgucucuuaaaaaaaaaaaaaaaauuacuugagaucggccgucugcgguagcucacgccuguaaucccagcacuuuggaaggccgaggugaggggaucacgaggucaggagcucgagaccagccugaccaacauggugaacccucaucucuacuaaaaauacaaaaauuagccaggccugguggggcgcgccuguaaucccagcuacucaggaggcugaagcaggagaaucacuugaacccugaaggcggagguugcagugagccgagaucgugacacugcacaccagccugagugacaagagacucugucucaaaaaaaaauuacuugagaucaaccugucauuucuaauacugaguuauuuaaguaucaguuggucuauucaaacucuacaaaacugaaaagauuaagcuaacaaaggacuuugaaauuuucacucauauuuuaugacaccaggaucaauccuuuuuccuggccuuacuugucuuaggaaugugggcaaagagaagaggggaagggggacucuuuucuaaauguguaacauuuuuggaaaaaccaauguuaucauuuggcuuuuaagacugcauucaaguuucuaggaauucaccuugcacauucaauguucaauguuuaggaaugaaaagcucaacauuucuaccaaccagaagaaaaucuauggaggagcauggacauauguacugauaccucuauuccuucccaucuccuuacaugcccugugaauaacauaaguuaacauuuuauaaugcuucuuaugagagcaaaaaggggaguagaguuacagcacucauaaagucuuccuacaaaacugugcaaagaaaacaccacuauguggaaacguguggacuacagagcaugcucaacagaaaggccacagcacucccgaguuacugacagaaaacaaccucuugaggauuccaggccccaaccuaaaagggcuucaauaagcacuaagccaacagaagaucaaagugaagaaguaagcuuaacauuaguuaucagccagauggaaagaauagcaaaauuccacaucaucgagauuagaaaacaaccgacuggcuuuucaauuuacuuuagaucagaaaaaaaagucggggaaaaaaguccuuaucaaagguuaaccaaacuaagucauucacaauuacaagagaucuaagacccauacuacucaaauucggcaaaaauguacaacucagagggaagagggggaagaucccuguuaauuaguugccucgauaaaagaaaauaucauuuuggucagugcacagcguugauaggguuucguuucucaaugccuaaaugcugugagcccgacguacagauucaaguauaaacaacacgugaccaguccuguugccuacgucuucauaaggcuaauugacacagaagauaguucacacacacacccuuuuaaaguucauuuuguauuuugaauucuuuuccuauuuucacuggaaggggucaccgugguagcccgugggauggacgcuccucuaccuuuugaggcagguagaguucuuagauagcuaagcccaagggaaaaaaagauguuaacucaaaauaaccgccccacaccaaacuaagcgauuuuucuauuccccgguuguucaauccguagggagaaggagguggucgaauucaaggaaguuaaagauuucacaaaguaaacacguacacaauuuuccguuucaaagggcaguuucugcuuucuuuuuuaagucgauauagaccauaacaggagcucuguucgucuagaccucucuugguuaguucagauguacgcggggggaauacagaaggaaggggguguccuccuucggcccaccaugucgcgaacacgucgcgagucuuuaagggaaacagcuuuacuucgguaagggcgggcgcgagccgaggccaaggcgccgcccgggagccccgcgggcgccgaggcgcccggugccggggccggaaacgcccagcuagcggcguaccgggccgccccuuccccgcggaccugcccggagcuccgccgcccuggggccgccgcggggugcggagggcggcgccggccgcccgcgccccucccccgcccgcggcggaagcgucucggguuugaaagaugccgcggccgccgccucccacccgccgagccacaaagggccgagcccccucccgccacagcccuccuccccggccccuccacaggucgccgcgggcucccagccugcccggcgcuacugucgccugcucacccgcgucccucgguccggaggugugggauccgcuccagccgguggccccguccacacugggccccuccggcgcggcggcgggggcguggcccucccgccgcggccucgccuggggucucgccuccgccuccggccgaggaaggcuggcgccgccgccucuuccuuccgguuuccccucgcacccucccucgcuugguccguccagcgcggaaagcagcguccucugcgggcgccgccgcacgcuccucagggcccgaccaccgccagacuccucccccgggagccgcgccgcccgcccgcccgcgccgccuugucaguccg

SEQ ID NO: 191617 - RNA, 68295 nt, Homo sapiens
gggcuggcgcagcaggggccggugaaaugcaggcugacgacggcgcgccaggggcugagcucgccccggucggcgacgcgcacacaccuugagugacagcgaccucuucucuacagguuuuccccgcgggagcguggcccuagcgggcguucgguuuucuuuggaaaucgcggagggggcuggccgggcgcagcgauccccaccccgggacuccagccccggccgugcgcgucgccgcggacgggcucugcgggccacggggaaggugcgaggaggcgcgagcaggcugugagccgcugggcgcucccgcgagcccgcuccucuccgucgggagcagggcaaaggcgccaggaacagggcagaggcacagcgcccaccgccucugcggccgccugaugugcgagcagcccgcgacgaggcagugcacgcucagacgccccgcuccucccgccagcgcgcggccucgcuccuccuagaggacgcucucugcgcgggcccucggaggaggcggcggcggggcgagcugcagcgccgggacaggagguuuguccccgcccgcgcgccguaccgcggcggagaugggcgagaccaugucaaagaggcugaagcuccaccugggaggggaggcagaaauggaggaacgggcguucgucaaccccuucccggacuacgaggccgccgccggggcgcugcucgccuccggagcggccgaagagacaggcuguguucgucccccggcgaccacggaugagcccggccucccuuuucaucaggacgggaaggugagucggcggccuggccgcagaggcgccggagggggagcgcggcggugguagcguccaccuuccgccaggcgugacgucacaggcgcgcgccgggcuugggagggcgcgggaugauagcgccuagcaccugucuccgggccuucccgaugagccgcgcuuaggguccgugggcuucagcugcaugaaccacguuccagcaguucggcccuccuggccccaacgcgccuuugaaauacgcggacagugcgcuuuccuucuuggcccgagcggcgcuucgcaaugcgggcuugugcacucgugaggcccgcggacaccucccgccccugcgcggcggagcgcuccgccggcuaccugcuccucagaaguggccuggaggcuggauuuccuuggccauaucuggucccugggcucucgccgacaaagaagcauuguccguacugucugugugcccagaaaugggaagcggguguaaggggaggccaaacuugacuuucuuagugucgcgaggugggucagagcguuacauugacauaaaacagauuaacaacagaaaaacauacaucucuugaauauguuuuacgugaaaaagacacaaagaaauggcaaaacccaaauacuuuugugcuaggcagaaccaagagcggcagcugugggagaguaaagugugcggggaggcuaauggaagauggaacugcuugaaccacgucuagguagaaaucuccgccuugcucggcucuggugccgaguguuucuuuguuccugguguagggaggccauguuuuacaggaguuuucucuuguuucaugaagaaaagggggcaguuuagagcacucuucuguuuuucaagugcuuuuagcuuaaaauaauccuuaugccagagacauauuuuugggauggcauacccugucacccuucacgggcuaucugaacagaaucuaacgugggaggcaaaaagugggaauaaaacagaagauugaauaucagcacaacuguuuucaugcuugguaaaaccguaccuuuaccagguuuucuuuuuccacugagguacguguuccaauggccacuucaccuccuuggaucuccauguauuucauauuuggcuaaaacuaagaagguaauuuugaaagagccauuggucugaauauggaaucuaaggcaagugacuucuguaaaccucucucuucuugaaugugguuaaaaacucgaaacaggccgggcgcgguggcucacgccaguaaucccagcacuuugggaggccgaagcgggcugauugcuugagcccagcaguucgagaccagccuggccaacauggcaaaacaccgucucuacaaaagaaaaauacaaaaauuagccgagcguggugguggacgccuguucagcuacucaggaggccgagguaugagaaucgcuugagccucggaggucgagguugcagugaguggagauugcgccauugcacuccagccugggcgacagagcuagacgcagucucaaaaaccaaaagcaagcaaaccugugggaacaaguccuaacugauggggaugugucugaauuagaugaagcauauaaauugccuagcaaacugccugaugugguaccuuaagaaaggccucaauaaauguuaaucucuuccccuugaugauuuaaguuacacgguuuagauucauauucaauauugguuuuucucuagauuucuucuauuuuuacauacaaauauguguuucauuugugacuuaguguuucauuuuuuaauaacaaaaauaaaaaucuggcaagcauugaaaaaacugcaucauucauucuuauuaccaguggccaucucaguacuauccuuggaguagguagguuacagcaaugcuuagugaaagaugaaugaaaugaacucuugacaugagaauaacaaaaauaauguuagagacaugggaagcaggugaguuucauuugcagccucacaggagauaaacacuaauucaacucaaaguuuugaaauuggguauuuuucuuuuuagccuuuguaucuggauaaaugugauuuuugaccucaguuauauaccugauuuauguugaaaagaaaauuagacuacaaguaacuaauggggcuugugauaucucugcaaugaaauguaaguugggguggggaccuaugccagugguugugaguauaugcuaaagaaagaaauggacaucauauuauucuugaauaugaaaaugagagcacguugaagggagagauggauagugauuuuaaaagguggaaagauugcuucuugguuauuggaaagucaucagauaaaaugaauaugaguugaacacugucuucccuauuaauauuuuuuaugauugacauuaaauuuuugguuuuaaaaaucuguuaagaaugcaauuugaggauaucacacuaugcacuguuuuugauagacaugaaauuucaugaaaaugaggguguuauggguugaauugugucccccaccagaaaaaaagguauugaagguugaaguccuaacccauuggaaccucagaaugugacauuuggaaauaaggucauggcagauguaauuaagaugauguaauacuggaauaugaugggccccuaauccaauaugacugguguucuuauaugaagaaaagagaagcagguaugauggcucaugccuguaauaccagcacuuugggagguugaggcaggaggaucacuugagggcaggaguucaagacuagccugggcaacauagugagacccugucucuuuuuuaaaaagaauuguaaaagagaagaaagagacauagggagaaagaagauggccaugugaugauggaggcagagauuggaauugccagccaacaccagaaacuaggagaggcaaggaaggauucuccucuguaaguuugacagagagcauggcccuguugauacguugauuuuggggcuguaggcuccagaacuaugagaaaauaaauuuaugugguuuuaagccacccaguuuguugaacuuugugguaucccuaggguaacuuguuaauuuguaaguuaagcauugaauaauuuucucuccaugauguuaccgaguaaugauuacaaaaaucuaccaacacaauaacauuuuauuacuaaguauucuuuaagucauucacucuaucucauuuuaguuuggcugccuagguauguggugugaucagucaauaaaauuauccucugauucuaaaaccacucaagucggcuucucugggccauauuuccauaaauugguauuuauaacauuuuuuacaauauugggccaauauuaugaaaagcagugaaccaguguaguagcaguuguuuuuaauuauggaaagccugugacgcagacacucuuaguuacucaucuaacagccauuuccuccuuuuuacuugauuuuguuguggccguggacuuaaggggaauugagcccagcucuaggagcugaaucaugauuaaugucuuugaccagcagcagcagcagcuucaacugauguucaaguccaaccaggagauggguaccaugcagaguuuaauagggaaaguuuaacuuaaagaauuguuaugaacugugagacuggaguaacaagagauugucucaugagaaggaaagagaacucugaagaguguaggaauagcagacagaaggagcagccccaccccuagggcugagagggcacucgaguaaaggccccugugauuagcucuguugcuguguaauaauuaucccaacacuuagcaucuuuauaaacacuuacgaucucaugcagugucugagagucaggaauccagcugcagguuagcugggugguucuggcucacggucucuggagaagcugcacucaagcucugaaccagggcuucugucauuuugaggcuuaacugggagagagaaucugcuccaggcucauucacauggugguuagucggccuugcuauguguuuucuggaggcuucagugucuaaccacaugggcugcuccuuagggcugccucaugacauaguggcugucuucccugagacugagugaucaaagagaaaaguaugcaagagcacccaagauggaagcugcagucauuguauuuauuauguaaucucagaagugacauaccaucacaccugccauauuguauucuauuagaagcaagacaguaaauccagcccacgcucaaguggagggguuauacaggagcauaaauaccaugaacuguagaguccucagccagggcugaaaucuugaacuugucagagaggucauugccauaccucauugguugggagagaaauugcugugauacugcaccauugcuagguguagccuccagaacccugcaaugaguauuacaguaagugacaauauguaaagaauaucuugggggcacaagagaagaaagaagacguguuaauucugcccauucgcaucagggaaggcuuuuuagacuaaaaugauacuuucaugguccuugaaagauuaaguggggguuuucuaggcucaguuagggaacuccaugagcaaggacuuaagggauaccacauuaugagaauaucaaggaguacggcaugacuggagaagagggagcgugaauggcacuggggaguauugaggccgaagacagugauuggaguugaugcugaaggacuugauggauuggaaggauucuuuuaaaaugaaauuuaaaauuguauauuuaagguauaccacaugguguuaugugauacauauagguaguaaaaugguuucuauagagaggcaaauuaauauauucccaaugucacauaauuacccauuguuuuuucuguggccagagcugcugaaaucuauucacuuagcgugaaucccacauccagugcauuuuuauuaccuguaguuuucauguugugccuuagagcucuagacuuguuuguccugcauaucuuccauuuuguauccucugaccauuuccucuccuuccuucaacccacugccuccgguaauaacuguuuuguucucuaucucuguauaguuuuggguuuuguuuuguuuuuuuucgagacagggucucacucuguuguaggcuggaaugcaguggcaugauuguggcucccucccgagcucaaauuauccucccaccacagcugccugaguagcugggaccacagacagguaccaccaugcccaacuaguuuuuguauuuuuuguagagacaggguuuuaccauguugcccaggcuggucucaaacuucugggcucaaggaauuuuucccagcucauaugcugcuguuucauuuuaagaauuguuuccuuugcugugcagaagcuuuuuaauuugauauaguaauauuuguuuauuucugcuuuugugccaugagcuuuuggugucauaccaaaaaauuauugcuauggccgguguccaggagcuuuuccccauguucucuuguaggaguuuuauaguuucuggucaauccaaaggacuuuacaacuuuuuccacagaaaaaaaucaggaaaacuugucuguaauuugauacaaucuuaagcuauuggaaaugcuucaguuuauaauuauuuaauuuuccauauuuuuguuuugaagcuuuaaaauuuguuuaaccucauaauauaucauggaagcauaaggaaaucaguacuacccuaauacccagagaaauguaauuuuuuucucuuuauucaaaaugaacuaaauugugugugugugugugugucagguggaaggugggguaauauacucuacaacuucucagagugagguuuguggaccuaaaucauaagcaguuccucaaagauuguuagaaaugcagaucccacuccaaacccaaggaaccacagucugcauuuuaacaagauccucaugccagaguacucauaaauuugagaagcauugaggaaaacuguucuacauguagcuuuauuaaauuuucuuuuaauaugaacuuaauuaaccuccagccaguuuucaguuccugauguggaaagauauugacguggaaggguaaugguaagauuauggagagggaacuaagaagauauuauacaugagcauuuuccaucuuuuggaaauaaauuguagcauagagcagguaacaguuuuaauagucuuguguuugacuccuacuuuucugccauuuaugacuuguagacuuugagcaaguuauuuaaccacacacugaaccuugguuuucuuaccucaucaacuugauguaaaugguuaaauugaaaggcuaacugagguucuuaauauaacauaguuguaauauaacguauuugcuaaagcuuuuaauaauguagauguaauauaaccacccccuccucacuggauuguuauaauggcuaauuagguuaauacauuuaaaacauucagaacggugcugaguacaguuaguaccuagguacacauaguuacugauacauaggugaauaguaagaguugaguuaaugauagcuauuagcauuauuauagacauagcuuauuuguauuagaguauaaaaugugauaaugaaaaauuuguuuacauuuuauauuuucaguggaauacagaaaaaaaaccuacuuuuuuugcucuuuaaagaaaugcuuauugucuccuuuuuuuccuaaggaaaauaugguuagauguacaauauuuauauggcuauauccucagauugccaauaguuuccagauuucugaauuccauacacauacauucuuccucucaucaucucugaaagggcauggaacuccuguugaugguggugagaugauaaggaauaaccaaaccacuuggaaauauggagguugggaauucuacccacaguagaaccuaccagcucaugcugugcaccuuugggccucagcaagauugaaaauugucaucuaucauagccugggucuccagauucguaaguuuaugcuugaaacuucaaacaggagcucugaacacuuaauucaugauuaccaagggcuuacuauaauucauuucuauuucuuuuucccacuuaacuuuacugcuuucugagaacaggaauuuuuucuugaacauacuugaguuauuauuuuuuaauuuuuuaaauauuuauuuauuuauuuauuuauuuauuuauuugagacagggucucauucuguuucccagacuggaccacacuggcacaaucauagcucacugcagccuugaccucccaggcucaagagauccucccaccucagccucccaaguagcugggacugcagguguacuccaccacacccagcuaauuuuuaaauuuuuuguguguggagaugggguccugccauguugcccaggcuaguccugaauuccugggcccaagcaauucuccuguccugccucagcuucccaaaguguugggauuacaggugcaagccauugcacccagggaguuauuuuuaaacauccucacugcuugauacugaaauaagaacgcaguagguaguaaauguuuguugacugaauaaaucuauggaaauuaaaaaaauuuuuuuaugagaggcauuuuuugcauuuuauuuaaugauacaauuuuguauuuuaaaagcuauucuguaucuagaauguuacaucuuggacucuuagaugacauuccaggcuacuguaagucaagaacuauguaauaugcuuugggaguucugggugaggagugugcuuuguaaggacaacuagcaguuggcuagggccagacuagguuuugagcaaauuuugcuugaauagaauugcauauaacaaaccgaguuucuuuuucagaaaauguuccugucuuuuauagauuuuaguuaguaccaugcagcaauuguuuaaucaaaaugaaaccuaacuuuucacugagagcuuuccauaauuaaagauaauuugaccacaaaauccugcuaucuccauggguuccuugucucuugaacuguaauuacauauguuuugagcccuuguuugcaguuuauuaauacauugucacuuaacaguuuguccuugguucuuuauugcaauuguaaacuuccuugugguuaugccauauauccccuacgaagcauacauagcagaugaauuuuuaugauacacaucaaaauuggauugaggugugugugcuuaggauauguaaucuagaauauuuucuguuauauuacugaguuugaaauaagaaaacagaagcagaccagauuauguaaaucuaugacuauuuuuagcagaaugaacuauuuucaaacaccucugcaaaauagcguuaucuugauagagucaguuuagguaaggaccuguuuauugaaaauaccacuagugaagguagauguuuucacuaccaucuaauucuuuacugucagaagauauagcuuccccaccccugccugcuuuucccauguaguaauuagcuuugagguaaggauugggggacuuuuguuuuauucauuuuguuugcaaaauggaacaaagcaagcccacacucuugcuagguauguaacaucacaucacaucuucaugugucuaacauuacaagugaauuagccuaggagagcugaauuaggaaaugcacuuccccaacccauaccccucagcagaaggguuuguuaaaaucuuuccuaagaaaagaauuacuuuaugguauacaguuugcaaaguuugcacaucaucacauauguaaaaugugagucaaaaagcuauuuuuaucaucuuuaaaauguaggcaaguuauuuucucuuagcuucaguuucugcauguguaccaugaugauaaugcugcuuuaggauuaucaagaggauuaaguuagauuaagugucucaaauaccccauuuauuaggaguguaguagaugauuuuauuaagcucuccugaugcauuucaaguauuauucauaccuaaauguucaauuuaugcauaacuauucaaaacguaccuuuuucuucuuaggagcuauuuauuaugugcauguugaacacuuguuuuuagacuuuucacucuccucuauuuguaguuaagaucaucauaauuuuuuacaaguuaauugucaaaucuuuaaaguuuucuguauuuuuauguauagcaguuguauuuccucaaacuagcacuaaauuuaucauaaaaaauacagaagaacacaaguauuuuagaaagagaaugauugcauauuccguaguuuucagauggaaugacuuguuuccucaggaaugcccauggcauucuccuaaaugcauuuuaaauaccaucucuguccuucagcacagaaugccccccugcuuuucacacagcgagcuccugucuuucucugagacgccugugagaggcuucuuccuccagggucuuccucagaguugcccaggcagacucuguugcuuggccauuccaaagccacuugaaggauuagcuaagaaaguuguauuuuuccguuguugccauaaauaccaccaauuuugcaguuuaaagcagcaccuauuuauuuaucaucuuuaaaaugaagucagaaguccagguacagucuggcucugcuggcuccucugcuuagaauuucauaaggccaaagucaaagcaucuucaaggcugccuucucuccuggaggcccugagggugaaucuguuucccagcucauugaagcuguuggccaaauccaguucacuguggcugcuggaguguuccccacuucccugcuggcuggccuuagcuccucaaugccaccugagcccugcccaugcuuuccacaugguccuuacagcagccgcagaucaagucacucucacacuucacaucucucugauuucaccuucugcccuauauuucugacuuaaauaggagaaguuucucuccuuuuaugggcucaugggauuagaugggccccgcuuggauaauccagcauccucucccuauuuuguggucugugaccuguuucagguuccaggacaucuuugggggccauucugccuaccauaaagguuucuagugcuuguagucuggaguggcugccuggguuuaaacuccagucugccccuuacuguugauaucacuuuugguaaguuacuuuaccucucuccugugcuucauaguucucauuuguaaaauggggguaauaguuguagcuuuacuguagaguuuuuaugauaguagugaagggcagcaacagucuuagacagagucagugcauuccuuucauggggcucaggauccaccagacuccgcauggacagcccugcaaagcaagcuccucagcuuuuagcccauugaggagcaagcuuucagggccuucuaguccacacauugccccacugacgguacucccucaucaaagaaagggucuccuagguccaccaggaagcccccugacgggcucacaguggucaucgaugccuuuccauccccucuccacccuucugaauuccccagcuacacacuugccugccucugugagugggcaucugauaacaaucccaguaaacuccugaaugccuuccacaagggugaaguaagauugucuucggauaucagucuacauacauuuauauauuuucuugaguauaccauauuugauauugcuagucaggcauuuauuauaugcaaucauaauuauuuuuacguuugucucauuagaccaggaacauuuuggggaguacccagucuuauucagcuuugugucccaauaacagugccuggcacauggaaagcauuauuuguuuuucaaaagaauaacuaauauuauacucaaaauuugcuaaucaucuacauuuuauuucuuucuuccucaccuauuucaaagguaucugaaaguuagaaaaauauauauagugcuggguauuuuaucauauaugaaguuguuaauaugccaauuauauuauguuugcuacgcuucaugccaagauaaagaaauuucauccuuuaucuucaguaacaguuguuagaguguugauuauaucaucuaaaauauuuguaaaauuguaaaaauuuauaaaaucuacccuuuauuuuuuccauaugcaauaugaaauguagcuuaugaacauacugaacccauaccuucucuaaaaucuagaguugaggcagagagguacagaauauguguauauguucuagcaaaugacaaauuaggaaauaaauuauaccccucaauuauuccugugauguacauggaaaaaauaucaugaauaaaaaggaauuuaauuucuugaaacguuuuucaagaauauaacugguguaauuuguaugcuucaguaucacccagugucugucugccaucuguuuaucuuuuucuucuucuuucugucuccuuccccuauucccccuucccccuccucuucugucucgucuucccaaccucccguccccaggaaaaaagcuuuuuuauuugauucuaagauuuauuaccaugaaaacauugugaggaagagaaauaaaucuugccauaaaugugccuuguguaucauuuggaauaauagaugcagugacaccucacaagggguuuuacaaccagugauuaauaucuacuccaauauauuucugcuuuauaauacacuugggcauucuuguuugggaaaauugccuacucaccauguaggaaaagaacauuuucuucccgauugcaauguaauugcuaaaaaucaaucucagaaucaagagauaaaaccuccaaaauucuuuaacugcuccugcuguuucugggcuauguggcagguacauauuucuauucauaugguaugacugagugaaggcuguaaguccugaacauccaaagguaaaauguaaauauagaaucaagcaaaaaauuuugcaguaagcagagaaugcacagcccaggaacuuuagaaguagacagucuagucagaguuucaagagcuuuaucucucaauugucauaagaccucaaguaagccuugguuuucuuaccuaaaaaacugaaugaugugacgauuaauugaaauacguaaagcacuuagugccagguacauaguaagugcucaguaauuguuaguuaucuuuauaauaccauuauugccaggugcaguggcucaugccuauaauccuagcacuuuaggaggcugagguggguggaucacuugaggccaggaguucaagaccauucuggccaacauggggaaacccugucucuacuaaaaauacaaaaauuagccggacaugguggcgcaugccuauaauccuagcuacccgggaggcugaggcauaagaaucacuugaacccaggagguaggagguugcagugagcugagaucacaccacugcacucuagucugggcgacagagugagacucagucucaaaaaaaaggaaaaagugugugugcguauauauauguacauguauauauguauauguguauauauauguauacguguguguguguguguguguguauguaaauaaaauaccauuauuuagugagacaaaccaguuaaaauuucuccugguacaguaaucuccaucaaauguaaauagaauuacagcauaauaaauuuucuuuguacaugagaauuugguuccaguauaaacaaauuagaauccucuuuuaugagaaauaggaaaaggggaaccauaaaaaguaccuuauggcaaagggcagagaaaugaaagguuuuugcaauuaaauucuggcaaauauuaaagggaacuggaggaagcaaucacaagucuuaaaaauauacuccaguaggcugggcgcgguggcucacgccuguaaucccaggacuuugggaggccgaggcaggcggaucacgaggucaggagaucgagaccauccuggcuaacacggugaaacccugucucuacuaaaaauacaaaaaauuagccagccugguugcaggcgccuguagucccagcuacucgggaagcugaggcaggagaauggugugaaggcaggagaauggugugaagccaggagguggagcuugcagugaaccaagaucacgccacugcacuccagccugggugacagagcgagacuacgucucaaaaaacacaaaacaaaacaaaacuccaguaucauuuaugaggaaugaaggguuaguagcauaugcuuuggaauuagguuaccaugauagagcuaagacggcaugugagugugcauuaggccuggaaaacucaacuuaaacguacuuuaaucagcaggcagaaggggagaaaaauuagggaaguucugucuuuuuuaucaugaaaaauaagaaccucccagaaccuccuagaagacuuucauuuaggucucaugggucagaacugugucauguggccacccuugugcauaacggggccuggaaaaucaagugucucuucuggggcuggaugcccuacuauucuggauauaaucagauuucuguuaacaagcaggaaggguguggggacuagauacgggcuaggaacuaccuuauggguucugccacugcagguauuaaagagguauccccuauuuauuccuucucaugcaaaugauucugcaucucuuugauuacaguagaaaccaaaggucaagacacaggaggccuaaguuacuaacauggagucaaaaaguuuuuaagaaguuggauggagaaccagacaguuacucuuuuuggugcauucaguaacagaagcaaaguuaaauacauuuacaagcacaucaccaaaacaauagggaauggcaaauccagaaagcauugcuaguaaguaaagauuguuaagugaauguguuuguccaguuaacucauaauaucaccuuuaaggugggugaaauauugauacuguguuuuuuggugugccaucuuuaucauuuaagugagcauaauuaugaagauuuucaugaagcucuccuuggccuuagauuucuaacucagcuuucgcuauaagggaagguauuuuaccaccaugguugaguaggaauuaucguaauuuacuuauuaccuugaauaacauuuaaugaaaagauacaauuuugaaagcuaaugguauguuuuagucacuuaauagaauucauugucuugccuaccuauuuuagucuugggcaacuaauaaauauaaugucaaaggggaaagucguauucaguacuuuuagcaaaaauauaugccuguaaauaugcacguugaaauccucuuuggcacaauugguuggucucaaaauagauuugcccaucucugaaugcuuagcuauuacuuucaaugacuuaaaaauguagacaaggauggagguuuuaugguauauaauaugcagcuggagugcaacaaaagaagguacauauacugcauuguuuuuuuuuuuuuuaacuuaaaagguguuuuaggggauuuauacuuuaaugaugggcuaagacccugguggaggacucccuguauaaaacaacuauaaaacuuguauauaauauaaaaagcaacuacucaaaggcacuggagacuaagcagacugcaguguaauugguuuuuuguauuauguccagauucuaucgaauauguuacagugcgugauuggaggaggagggagguucuauagagugcguuacagugaguaauuggaggaggagggagguucuguagagugcauuacagugugugauuggaggaagagggagguucuguagagcguguuacagugcgugauuggagaaggagggagguucuguagagcguguuacaguguaugauuggaggaggagggagguucuauagaguauguuacagugcaugaucagaggaggagugaauuucuuuuuuuuuuuuuuuuuugagaugguguuuugcucuuuuucgcccaggcuggauugcaguggugccaucucagcucacugcaagcucugccuccuggguucaagcgauucuccugccucagccuccccaguggcugggauuacacgcgugugccaccacgccuggcuaauuuuguguuuuuaguggagaugggguuucaccauguuggccaggcugguccugaacuccugaccucagguguucuacccacccugguuucccaaagugcugggauuacaggcaugagccaccauaucugggcggaggagugaauuucuguaggguauguuauagugcauucccugugaaggaaguuucuguguccacgucuuuuauccuggagcuaaguuucauuuacauggugcacucaguggcggcagggguugccuauggcaaaaucacauuuuccgggaaccagaaaucuaagaugggauaacaggcugaugagauaaugaggaaaagggaugagccagaggagggauccaaaaaucuugucuguguacguauccaaucaaauucugaacaaugcgugucuggaacagacccaaagaagcuuagcuaaagacgaaagauagaaauugagaggagagcugcugccccagaaacagaauuugcaauucaauacaagcaagaaaacaguguacaaauuaacauuccagaugcagggcaaaguuaccugcuaucuguagaaccaggaacauagugugagagagaaaaauagguuuuccucuuaccccucggaguuuuuagcugggacagaccccuguaacaaaagacaaauuaacaagagaaaaacaaauaaguguuuuaauguguguauuucauauauacaugggacguacccagggaaugaguguaucucacacagauggcuuaacaaacccagcuuauaucucaucuucagcaaagagcaaugcguuuuuagagcagugacaagacaaaggacagggacuuugagugucugggaugcaaaucauagaauggcaaacaaaugagguuugugauguagauuucucuggugccuucuccaggcugaugccuuccagagauuucuucgcugguugggagggaaggagggacaccguuuuuaaguccugcuuuuagguaggugcgggaggggagagagcuauucuggcaucuacuucucaguucaaauucauccuuaugucaaaaugaaugauuuugaggaggcauauucugcuuuucuacauaaaagacacauuuucaaaagaaaagaacauuaacuggguccaauccugaaaagaaccagauagugaaacuaguaugcaaggauuuuaaacugacugcuauaacccuccuccaugaaauaaaacaaaauaugcuuucaauucaugaaaaaugaggaaaucucaguagggaaguaaaaaccauuaaaaaaagagucucauggauauuuuagaacugauaaauacaauauauggcauuuaaaaguuacugcauggccuuagcaggggaguggagaagacugucaguguccugugaguucugcuugcccgcugcccacacagagcugccuuaucaagacgggaaucacaauuuguauucacacaaagccagcugaacuggagaccggaguuuuuuuacucaaaucagugucucugaaaacuuggaaugagguuuuuaaaggauaauuuggugggaggggacaagggagugggagugcugauuggucggauccuagaugaaaucuuaggggucacaguggguucuucuugcugucuucuguuccugggugggaucacagaacugguugagcccuguuaccaggcuggauggcaccagcuggugcaucagaaggcagggucugaaaauauaucucaagcaccauucuuagguuuuacaguagugauguuauccugaagagcaauuggggagguuuggaaucuuguggccugugguugcaugacuccuacaccauaauuucuaaucuuguggcuaauuuguuagucuuaaaaggcauucugguccccaggcaagaagggaguuuguuuugggaaagggcuguuaucuuuguuucaaaguuaaaccguaaauuaaauuccucuuggccagcaugguggcucacgccuguaaucccagcacuuugggaggccaagguggguggaucacuugaggucaggaguuccagaccagccuggccaacauggcaaaaccccgucucuacuaaaaauacaaaaaauuagugggacgugguggugauacagcucugaugacuggaggaacaccaggguccuuugucucacgcugauauagauaacaugacacagacauauguggagugguuuuaaggagcagagaguuuaauaggcaagaaggaaggaagaagcuccuccuuacagaggcagagggagggaggcuccaagcagagagagaaaaccccaugugugguggaugaggaggaauggucaguuauauugggaggcuggaggaggcaguaucugauuuacauagggcccaggggauugguuugaccauguaugucauucacauagcccucaaaguaauuggcccucccacccuagccuuuuaauaugcaaaugugggccacuaugauguccugcacagguggagauaucuggggguggccauguugggcagaucuaguuuuuaauccacauuagcauaucaguacuugcuagccuagcccuucaagccguuuuucugcuagaaaauaaacauuucuggagcugcuuuuauuacaagaaaaaaacagcuugccaaagaccccuuauccuaucgccuaaaauaauuucugaauaacuccuauaauaggggcaugcaccuguaaucccagcuacuggggaagcugaggcaggagaaucgcuugaaccugggaggcagagugugcaguaagcccagauaaugccacugcacuccauacugggcaagagagugagacuucgucucucucuauauauauauguguaauaaaauaaauuccucucaaaguuaauucagccaacacccaggaauaaacaaggacagcuuggagguuagaagcaagauagagucccuuaggucagaucucuuucacugucaugauuuuuucacuguuauaauuuuugcaggagugguuucaagacagagggaagagaauuaguaauuagugaacuugaaaauagaucaauagaaauuauccagugugcaaaacagaaaaaaaaaaugaagggaaaaagaaaggcagggauuuagggaccuguuaaauuacaucaaaccauccagcuguugguaauuggaaucauagaagggaagcagaggaagagugggacagaaaaaguauuugaacaaauaauaguugagaauuuugcacauugaaugaaagauagaaauuuauagaugcagggccgggugcaguggcucacgccuguaaucccagcacuuugggaggccgaggcggguggaucacgaggucaggagaucgagaucauccuggcuaacacggugaaaccccgucucuacuaaacauacaaaaauuagccgggugugguggcgggcaccuguagucccagcuacuuggggggcugaggcaggagaauggcgugaaccugggaggcggagcuugcagugagucaagaucacgccacugcacuccagccuggacgacagagcaagacucugucucuaaaaaaauaauuaauuaaaaaaaaagaaauuuauagaugcagaaugccccucaaaacaccaagaggaauaaacacaaagaagcccaaaucaagacaaagguaaagagcacaucuugguaggagcagaggaaaacaacacauuauauauagggaauuuuacugacggcugauuuuucguuagaaaucauggagacagaggagaaugaaauaacauguaaguccugaaagaaacuaguauccagaauucuuuuuucagugaaaauauccuucaagaaugaaggcaaauaaagacauuuuaagauuaaaacacuaccaucaucaccaccaccauguaaaauaauuuguuacagcagacugggcaugauggcucaugcuuguaaucccagcacuuuguggggcagaggugggaggauugcuugagcccaggaguuugagaccagccugggcaacauagcaaaacccugucucuacacaaaauacaaaaauuagccaguugugguggugcacaccuguagucccaguuacuugggacgcuaaggcaggagaaucgcuugacucugugaggcagacguugcagugagccaagaucaugccauugcacuccagccugggugacaggagugaaaccccgucugaaaaaaaaaguaacagaggugauaccugaugaaaacugucgugggugaguggcgacuuucugggcugguggugugggggugcaagaauuuaccaagacaguuguugaguacagaaaggcagauuuauuagagaaagaaggaaaagauguugcaaggaggugacaggccaguggaagagaagcugacuguaucaggggaccugccccgauaaucauguagguucuuuucuauuuuccuaagcgucgacuggcuuuagaaauaaaaggacagaguacaaaagaaauuuuaaagcugggcguccgggggagacaucacacauugguaggauccgugaugccccacaagccacaaaaaccagcaaguuuuuauuagggaguuucaaaaggggaggggguauacgaauaggugugggugacagacaucaaguacuuaacaagguaauagaauaucacaaggcaaguggaggcagggcgagaucacaggaccacaggauggaggcgaaauuaaaauugcuaaugaaguuucgggcaccauugucauugauaacaucuuaucaggagacaggguuuugagaucaaccggucugaccaaaguuuauuaggugggaauuuccucuuccuaauaagccugggagcgcuaugggagacuggaguuuauuucaccucugcaaucucgaccauaagagacagguacgccuugugggggccaguucagagaccuaccccuaggugcgcauucucuuucucagggacauuccaugcugagaaaaagaauucagcgauauuucucccauuugcuuuugaaagaagagaaauguggcucuguucugcccggcucacuggcggucagaguuuaagguuaucucucuuauucccugaacaauugcuguuauccuguucuuuuuucagggugcccgcauuucauauugcccaaacacacaugcuguacaauuuguguaguuaacacaauuauuacaggguccugagaugauauacauccuucucggcugacaggauuaagagauuaaagcaaagacaggcauaggaaaucacaaggauauugauuggggaagugauaaguguccaugaagucuuuacaauuuauguuuagagguugcaguaaagacaggcauaagaaauuagaaaaguauuaauuuggggaacuaauaaauguccauuaaaucuucacaauccacauucuucucucauggcuucagccggucccucuguuugggggucccugacuucccgcaacaugacuguauggaaacaaaggcuugcugggauugguuuuacagaauggugguguggggugugcuggagagcuuugugcaguaccaguaaugccaaggcugcugugagcuaaguuguaggugucuggucguaaguugggcacaggagggcuacauguucuggacccugaagaaagacggacuuuagcuuauccggcuuuuuuuugcuucccacugcuccuaccagcaugacuucuuuuccccaauuaggacuccacauuucccccaugacagagcaacagugacagaucuuuggcaugugggugaagguaucaucuuccagcugcuuccugcugacuaggucauagagcuggcccuacuaggauuguuaguugguugagaaguuacguggguuacuguuuuggauuguggaauguaggauauuggaccuugcuggagaaagggacuuguuagagauggggauuauguuagggugaaacugguguucagcugaaucccagggaaauucguaaagguagcaggcauuacuggggagagauuguuaugcaauuugcagcaucauuugaaggugaaacugaugaacucuagaagauaaaaguuuggguuuuuuuuaaagccaguuaccaaaaacgcaaagaaaaaccuuuugcagugugacuuuuuuuggagggguguccauuuaguuaaccuggaaguuaaacuugaugaaaaaguguuugaauuuaauuagacacaggaagaguguguuuaggguuaggagguuaugaguauagcaggggaacacaugacucauaggaacagugugagacguuuuugauuacauugagaauuuagauaaaugucaagaaaauccaggaguacagauuuaaguuauguuagaggaaaacauugguuaauguugaccuucaaaaagaaacguuuuagcacuaggccacaauaacagaacugguggaaaaaguuacaggaacugacaaagacugcagaagagaguuacuauccuaggccuccuccaggggagaaaaagcugaacgcagugggacacagcaaacugggacacagcaaacguugaacuucugauauaugcuucugaguuuuuuuugguuuuuuuuuuuuuuagaaacuuuuauaaaauucugaguaaaacuuuuugcaguuuuauuaagagcagauuaauaccuuaagaaaaccuuguuuuaacauagaggauuaauguuacaaagacuauccuaaauaauuuuuuaaaauuauaaccaacuuaauuacauacaaaauuccuuuuauaaauucuccuucaugaaccuuuucaugacuuacacagaccguuuaugacauacuuggacuuugacuuguucuaaauauccuuuuuaaaaaacaaccuuacuuuaagauaauaauuuaccauagaagauuuuuuucuguaaaauuucuuauuauacccuuccuuacuaaaaauaccucuuuuccuuuucuucuuuaacuuuaaaugaguuuucaacguuuacauauuaguugcaccauaaauaaugagucuuagcaccagcaacuugguaacaacagauuuaaagcaguuaggaagaaagaggggaagagagcuuuagaaaauucuacauaacucuacauuguagguuaaccauuugagcucugaauuucucuuguagcuugucuaucaguuuaaaaugugcacaaaaacgggccauaauauguaaccagcuggaguuuuaaagaaaaugacaaaaucagggguuaggauguuagagacuuuuucucuuuuaaggcucgaccccuggauugaacagaaaaagaagaaaauagaagaaaggaaugggccgggcacuguggcucacaucuguaaucccagcccuuugggaggcggaggcagguggaucacuugaggccaugaguuugagaccaggcuggccaacaggguaaaacucugucucuacuaaaaauacaaaaauuagccaggugugguggugcaugccuguaaucccagcuacuugggaggcugaggcacgagaauggcuugaaccugggaggcagaggcugcagugagccaagauggugccacugcauuccagccugggcaacagagagacucuguuaaagaaaggaauggagaggaaagaguuaagcuuuacaggaggacuugugaaccauccagccauugcaaggugcagggccagucccuuuacuacuuuccuuuauccuuuaucuccaucagucagggagagccuugacaucucagaccuacaugguauaggacgaauuuuucccaucucuucaagucaccacuuaaggugagcuguuuucaacuggagcagagagccccuucagcucaaggcuuucagggguugggauucuguccugggagcccuuugguccucaggccucauuuacaguggcugagcuuguggcagagggcacaagucaaguggggcuuuucccguuuaucucauugagggccguuugccuuugaguggccugacccucuccacugguagcagucauuuggaggaguauccuuagggaaaccuggagggggcugggggcuuuagaacagccaacaguugagccugccugugcuucuuguuuguauguuuuucuuuuucuuccuuuuucuuuucuuugcccuguccuccuuaugcugcuuuugguuauaaaagacuaaggaagcgaauuugauguuuuucugcauaggagccaugcuguguuacacaagaaaguuagacauuuguuuuugaggaucuggggguugaauucauuccaguuuuuaaaaaauacagccuagaggugagucugcaggaauaaauggggucugucccacagugggacuggaaaaggugucacucgggguugacugaacugcaguuucucuuaggucauccugccaaugaagaggguuccgcuuauguccacugagggacucuaagacuaucagaauaaauuaacaaagaccuaacuguauguuacacaagagauggacuuuaaauauaaagaaaaagguugaaagugaauggauggccaaguaagcaagcagugggcaucugaaaacuuagugacugugugaaaugucccauaaaauagcucuuagggcgagcagguaaagaggguguucaguuuugauacuuauguuaauuaauuuuguccagaguguagcaaaagguuuuugaaucaggaauuucuuccuauuuaccugacaacaaauaaccagugggcaguucccgggucccaguucuuaucugugguacaaugcagugcagguaggguaugauggccuucaucagcaaagccaguauuguagauaaggaaagaaggaaaguaaauugucugugcuuuuuuauaaaaggggaaaaggcaguugucuccccuucccuuucugagagagucucauuagcaucaucuuuguuuaaucuuuucagaauguacauaaauaucuguauggaaaagaugagcccauugucuucaguuuuacaagucagaaaugucuccugguucuggggccucauggcacuuugaaauguaaacaugcacauccaggauugaggaaacuucucuggaguucacacgcugcaagccuuaguuccuaagguuuacuuuuaguccagaaucccaaauuucaguagaauuugcccucaaagcccuaauugugcagaaaccuaaaaguauuuucuuuacaaucucacggaagaacauuucauuaugaaacugagucgguuugucaggaagacguacuagccauuaauuugccuaugcuuaauaacagaacuuccaaauauaugaaagcaaaaagagagagagaguuaaagggagaaauaauuccauagucauaaggggaaaccucccaauuaauagagcaaguagauuuauaaaaaucagcaaaggugggccaggugcaguggcucaugccuauaaucccagcacuuugagaggccgagguggguggaucacuugaggucagguguucaagaccagccuggccaacauggugaaaccccaucucuacuaaaaauacaaaaauuagucgggugugguggcgggugcuuguaaucccaguuacucaggaggcugaggcaggagaaucgcuugaagccaggaggcagagguugcagugagccaagaucgcaccauugcacuccagccugggugacgagcgaaacucugucucaccccaucucuacuaaaaauacaaaaauuagcugggcgugguggcaagcgccuguagucccagcuacucgggaggcugaggcagaagaaucucuugaacccaggagguggagguugcagugaacugagaucacaccacagcacuccagccugagcgacagagcaaaacugucucaaaaaaaaaaaaucagcaaagguaggaaagaucuuaacaacacuguuaagcuacauuauuuaagaauauugcguauuucucuuuggagagacugccaacaaugaauaagaauaccuauuuuguuugcucuuagucuugggacuuaauucuuuuuauauauauauauuuuuuaaucugguaagaaauccaugguacuuguuuuuauuugcauuucauuaguuacugagugauugaacuuuuuuuuuuuuuuuuuuuugagauggagucucgcucugucgcccaggcuggagugcaguggugcgaucucggcucacuguaagcuccgccucccggguucacgccauucuccugccucagccucccgcguagcugggacuacaggcgcccgccaccacgcccggcuaauuuuuuuguguuuuuuaguagagacgggguuucacuguguuagccaggauggucucgaucuccugaccucgugauccgcccgccucggccucccaaagugcugggauuacaggcgugagccaccgcgcccggccugaacuuuuuuuguguaugcuuaucauuuguuuuuucuuuuguaugaagauguuaauaauuuggggucuaguuauguauuauguuuauuguugauuuauaucuuauauucuauguauuuccccuuugucauuaacuuuuaaaccaucuuucugauguucuugaucuuacagaaguugaaauguuuauauaguuaaauccauccauuuuuccuuuuuuuuuuaauucuuugauuucugcaaguuguuuguuguuuuuugugauucuacuuaugaguuauagucuaaauaggguauuaucucauuaaaaaaaguaaccuuauaaaaaccaagauagacuccaaccaaugaugcacugagaugguccaaggaaaguaacuucugucuguuauguuuguacaacuuagacuuuaaaguauuuauugcaacauugucccauucuugugaaguuaaaguuaucucuucuuuuggaucucagaucauucauaauuucauaagacggauccagaccaaaauuaaagaucuucugcagcaaauggaagaagggcugaagacagcugauccccaugacugcucugcuuauacuggcuggacaggugaggcuguggggucuaaaucacugauacauuuuauucuuagauuaugagauguaagacuugacugaaauuuucuucucuuuuaaaaugguaaagauuuggccaggcacgguggcugacgccuguaaucccagcacauuuggaggccgaggcagguggaucaccugagcuuaggaauucgagaccagcuuggccaacauggugaaaccccguuucuacuaaaaauauaaaaauuagccagguguggugucgggcaccuguaaucccagcuacuugggaggcugaggcaggagaauugcuugaaccugggaagcggagguugcagugagccgagauugugccacugcacuccagccugagccacagagugagacuccaucugaaaaaaauaaaaugguaaagauuuuauaucuuuuuuuuuucuuuuuuuuuuuuugagacggagucucuguugccugggcuagaguacagugucuguugccugggcuagaguacaguggugcaaucacagcucucuacagccuugaccuccugggcucaaaccauccucuugccucagccuccuguguagcugggaccacaggcacaugccaccacaccuggcuaauuuuuugauuuuuuguaaagacggagucucacuguugcugagguuggucucaaauuccugggcucaagcgauccuccugcuucagccucccaaagugcugggauuacaggcgugagccacuagccuggcugauuuuauaccuuuuaauugaggucuugcucuaugucuucaaugaugagaugauuuggaauuuuauuucuaaagaaaugcuuucuuccugaaguuuaaacuuuaauaucuagugugucuuuuuuuuauaacauuauuuauuuaaccuaauauauagcugucuaugaaaauguguaacuauuaagagcaaacuuucccuagggucaguuuuaaaggauucuuugcugcucuggucauugugacaggcuguggugaguggucucucuguucugugauauaaacuaacuacccuacugccuguacucauuugacucauuugugcacauaaauguuuuuauuuuuauuuuaaugauaacaaccaauaauacacuucacaucaaaaaauguaauugaaaaauuaacuugccuuaacuaaucuuugcauucuuauuauuuuacccaguauucagaacauucuaauaauuauucggggaauauaaaggauauaaaagauaaccuuguucucagggauuagacugaaguccaaauugcuaaugacaauuuauauacagauuuagagugauuucuugcugaauucuuguagcuuaauuaauaaacagcauaggccaggugcgguggcucaagccuguaauccaaagcacuuugggaggccaaagacggcagaucacuugagcucaggaguucaagaccagccugggcaacauggcaaaaccugucucuacuaaaaauacgaaaauuagcugggcauaguggcaugggccuauagucccagcuacugggaacgcugaagcaggagaaucaauugagcccagaggcggagguuguagugagcugagaucacaucauuacacuccagucugggcaacaggagugagacccugucucaaaaagaaaaaaacaagcaaaccaaaaaccaaaaaaaaacagcauagacagagauauacauguuagagccaccaugaaccaaacaugggcccuugauaauauuguauuuguauuuauauuuacauucauuuuugugaauauuguauuuauauuuacauucguuuuugugaugcuuauuauuugccuauuaugcaugcaacauuuacauagugacauuacauauuucaaacuuauaaacuuacuucaaacuucacacuuauaaacccagacagacauggagccaguucacuuacaggaccaaagauaucuuaaauguaauaaaauuagauaauuguggcuaaccugaaguaaaauacaaagaauaaggauauuuuggaaggaaaauaacauagcuauuagucucaacggguuuccccuaacaagccuuuuauuuacagcuuuuucgcuuguugagaaaggguuucuaaaccccugaucguuagguuccaaacuggcuaugcaucacaauuaccaagagagcuuuguaagaaaccacaguucucagccuccagcccagaagaguuacauuaggaacucuagagguggguuccagaaaucaguauugcuuaaaaaucccuagccauugcugucuuuaggaaucaucauggaaguauuugguuucagugauuuaaaauaauaggguuuagggguucagguagauguauggaauccaccuagauccauaccuccccuaaacuguguauacgauauaggaagaaggcugggcacaguggcucauaccuguaaucccagcacuuugggagauggaggugggaggaugguuugaggccaggaguuugagaccagccugggcaacauaacaagaccccaucucuaaaauuagcugggcacagugguaaacaccuguagugccaacuacucaggaggcugaggcaggaggauggcucaagcccaggaggucgaggcugcagugagccaugauuacacugcugcacuccagccugggugacagagugagacccugucucaacaaaagaagaagaagaaugaaugaagcacccacaacuuaucccuuuagcaaaacuuugagacagaaaacacacaagucauguuggguaaaaaacaagcagcauccagaacaaguguggagagccauggugugcaaagaggaagcccaggguccaggcauggcugaaucacuccgaccccacccacccucccagaaucagcaaauagcuauuccaggcagagugggccacagccucagugggaacuucugugggcacaucugagugcagagcgggcaggcggugugccaggagaagcugggaauaaaggcauggaaagugcacagggaaugggguuggagagcuguagaacaggcauggcuugcggagaagcagguuuagcuugcaagguggagcggcauccuugcuggcccccgcugacaguguagggaaggaaggaagcaguagcagugggcacuccugauacaaggaagggucugagagucaggaaaucuggccaccagacucccuguauguaacauacacuguucuucacuuagcaagaggacacuguugggauaaaaguugggaaagcuacauuaaccauuuuccccuuccagggauuuguccuauuaauaguugauauagaaaaauucaauuuuaagaaaaaauauaauuauuuuauccauaauauaaagaagaaaaauaaaaauuucucaguggagggagaaaaacgcaccaggaaaaugucacuacaaaguggagaaaaauuggcaguacuuucaacauucauuuuguaacuuaguuaagcagugaguucacaaagcggagguaaagacauucagagcagagauggcuagacaguaagagcaugugaaauaagaauugacagacuaagaaaagaaauuuaaagaaaagauaaaaaaucauuucagaaaugaaaccaaagcgcaaggagccaaagaaagagcugaucccacagagagcaccggggcagaguguccuugugucuaggaagggugucauaaauguuugcuuaauaaauaagugacuaaaugaaacuaucaaggaaaaaaaucaaagagaaagaaagauaaagagagacuucaguuuuccagucuagcauauaaagaguuuacaagucaccauugcauccuagcaacuaaaaagcugaacaaagugaaaacuaaacagcucuucuuagcuccaucagagaagugaggucacaggggcaaacugcuccaccaaaaacuggcgaaacagguggaugccgagaauuacagucaugcaucgcuucacaucauggaugaguucugagaaacgcaucauugagcaguuucauugugcagauauagaggugcucacacacaccuagauuguguagccaacuacaccccugugcucugugagauagccuguugcuccuaggcugcaaagcuguacagcauuacugcacugaauacuguagcaauuguaacacaaugguguuuuuguaucuaaacauagauauagaaaagguacaguaaaaauaugguauuaugauuacgaucuuaugggacuaugccuaugcaguuuguuguugaccuaaacuuuaaauaugaauugugggggcucagugugggcaagccagagagacuaaaaacucaauggggacccagucauagggggcucucacacuuuugugaacuuuaccucuaggagcuccaccaggucuucauggugaguaucagagacaacuccccucaugcuucucauagguucgggggaaggaaccauacugaauuccaucagagccuucaguucuugacaagcccugcccucuggagaaauugcuucaccggagccucuccugcaaaggguuuaucgcagccccgccuacccggagcaagggagaugccuagcuccagcugguucuagcuuucagcauuggggaagggagaugaucagcugcagcuucugcuggccauccuggccaacugagggcguggggaugggaggcacuggugcaguucacaguccaaaggcacaggcuggccagaagguugagccugcucacaggcgcgugcuccccagcaccucccaccacaucccuaagggccuguucauuccagcuccuuuuaccuagugcaacguguccgccugccaacaaaaaacgacaaagcaugaugaccuuuuuuuuuuuacuuuaccuuuuaccauuugcuuuaaaauacugaagcauuaaguauauauaacuguaaguuuuuagguucauagguuaaucagaucaacauccuauuuuuagagauuucugaguaaaucagggaauacucauuuguaagccuuuauagugauuauuauguuugaaauuuguaaguauuuaacuuuuacugucuguuuccuguaugcuuauauuuuuugaauacagaaaacaugcucucagggagaugauaagcaacucaugcugaagaauuuuuuuuucagagcuuccaaauauucuacuuucauauccguuugacucaacaucuuuaaagaaauggauaaugaugaaagacuucaaaaaguguuaaggauuaauuugaaagagaaguuauauacccugaauagaaaaauugaagaaagaagaagcuagauauuuggagaaauuuaaaaagcaaaaugaggcugggugcagugguucacgccuguuaaucccagcacuuugggaggccaaggugggcggaucacgaagucaggaguucaagaccagccugaccaacauggugaaaacccgucucuacugaaaauacaaaaaauagccaggcaugguggcaugugccuguaaucccagcuacucaggaggcugaggcaggagaaucacuugaacccgggaggcagagguugcagugagccgagaucgugcugcugcacuccagccugggcaacagagcaagacucugucucaaaaaaaaaaaaaaaaaaaagcaaaaugaaaaauaguaaaagcagaguaggauauuauuagacaaagacuagaauauugaagaaccucaacuuaaacaugaaagaaauauuucauuugcccuuuucaccagcaugucaucucugucaauguugguuccuauaaaagacuucaguaaauacauauuuauacugauucuuuuuuuuuuuuuuuuuuuuuacuuagcugucauauugucuucucgaacccagauguaaggacaugcuucuuuaagaagccauauaggcccuucuuuggagauucucagauucauuugaagaccugagucuguucuuuaucuagaauggaaagguugguggguggugaaccacacacgcccuuuguacugaucaccuuacucuguacuguguggcugcuccagaaauggcgaguucacucaccaguucauuggucaguuguaggguuguucacuaaagaacauugaaaaauugggaaaaauagaaaaaaaaauaggaagaagggaguauaaaguucagaaaagcaaucauuugggauaacauaggagaaaugauuuuacaauaaguaaaaagaagaagauccaaguuaggaucuacaagggagaaugaauacaaccuuggaaugaaugaaaauuaacugaggaugaguaggaagugauguaucuucuguugucugugaauaagagguauuaaaucacugugccaggacaagcaccaagauaacauguacaaacaugguuucuguucuuuccucccugauuucucugucuugguuuuauuuuguuuauucauuuuuaagaaauauaugaaauguauuguuuugguguuacccguuuggaaacauagauuuauguagaagaagguauuucauguaauuauaaauaauguccugaagauaaaaggaaaagauaauaaugcuuuucuuuuggggugggaaauuauuccaggcauagcccuuuuguaccugcaguuguaccgggucacaugugaccaaaccuaccugcuccgaucccuggauuacguaaaaagaacacuucggaaucugaauggccgcagggucaccuuccucuguggggaugcuggcccccuggcuguuggagcugugauuuaucacaaacucagaagugacugugagucccaggaaugugucacaaagugaguuuuagaacuggaaacauuuucucccaauucccaguggaagcucuugcuguagaaagauauucagaaaggaaacuauuuuuccauucauccauuguuguaaacagaucacuccaaaauguuaaucuugagcauaguggugggaucauaugcccucuuuuuauccaagcaugugugugccuuaauuuugggaagaauaaauauauuuccuuauuuuaaccauguuuccuaagcaauuuuuuguuuucuucaaugcaugaaaauuagcuuaccugcuuuagauucaccauaauaacuaaacugauguuagguucaacccuuaaguaacugauuagauaugcuaaugauggaacaauuagggaauguaagcuuuuauugcaccuauugguuuacguucuuccuugaagaagcagaaaucacgguucauuccuagggucugguagaguaucuggcacgugcuagucaguuaauguuuguugaaagauaggaugacgcuggguauaguggcaugugcuuguaguuccauuaacuugggaggcugaggcaggaggaucacuugagcucaggaguucaaggcugcggugagccaucauccugucacugcacaccagccagggcaacagagcaagacccugucucuaaagaaaaagaaagaaaaaaaaaaagacagaaugacagucuaauucccaagcauuggugacauugcaguccuuuuuuuuuuuuuucugagauggaauuucgcucuuguugcccaggcuggagugcaauggcgcgaucucagcucacugcaacguccgccuccuggguucaagggauucuccugccucagccuccaaaguagcugggauuacaagcaugugccaccacacccagcuaguuuugcauuuuuaguagagacgggguuucaccauguuggucaggcuggucuugaacuccugaccucaggugauccaccuaccucggccucccaaagugcugggauuauaggcgugagccaccgugcccggccugcaguaccauuuuuauuuaaauuuuaaaucacuuucuuuuacuucuggauuucaaaauaaaauuuuaugguuuaaaauagauguaaagguagaaauuaacagaaagauguuuuguuuuuaauuuugacauucaaaaggggacuaguaaacuggagacguuuuuguuguguucuggauuugggaguauuuuuaaaaauaauuguuuuaaauguaaaauaaauaauagguaauuccuaaagcaacaggguuaguguuucaggaagaaguacuuuagacuuccacugggaaaaaauuaauuuuucuuauugguuagacuuuugcagcuccagagaucgguugucugccaagaaucagaccuuccugaugagcugcuuuauggacgggcagguuaucuguaugccuuacuguaccugaacacagagauagguccaggcaccgugugugagucagcuauuaaagagguacuaugggguauggguaacuaugggcgucucuaccauucaaaccuauuugcuagcauugaguuguauuaacagcuggacuuuacuucuagguagcauuacuuuuuuaaagcaacucaucaaaaguaagaaauagucccugcuuuuuucuaggaacauuaacaaaaaaaaucuguacucucuuucaucuuguauuaauuuaucaguuuuuacuggagcuaaacagcagcagcuucagaaaguuagaauguuuauuuaucuuucgugagaugucucagcugguaagcauuucaggcugguaugaguggggaccagcuucuucugucucauucugccuuauccuaggggcauacccuuauuugcaggaccaaggcuaguuuagccccucagccuaugaagggaaaagaggagguggaggcaacgcagcuuccuuguuagggacucagucuccaaguugcccucuuuacuucugcucccaucccagugccagaacuucaucaagugucuguguucagcugucucuaacuagggagccagaugcccagcuaaaacuuggaauacuuucccaaaaaggaugagaggagauagacgugaggaaacagucaucccagacaugauauucuguugaucuaacugaaauccuucaugccacagcagaccucauaucauuagccuuuuauaaauaaagccaguuccuccagccuuuccugauagguguaugugcugcucuuuugggaaaaauacugcagcuacgaagcaacuaagaaauccaaaacaguuuuauaagaaguuuuucuagauuuuucguugacuuuuuaugcaaagaauuuuuuauuucuuagacaguaucuuuuccuacucugacauuggcuccugauuucuuuuugccugcauuuauuaauuuauaaaauaaauauaacuauauuagcugcuaacugcuuaaagacuuuuagauuaaggcuucugccucucucucuauauaugucauauauauaugacauacuguuaauuagacuacaacaggguacauauacaguuuuagauuuaugcugucuuguuaucucuguagguagucaaugcuauuauugaaucggguaagacuuugucaagggaagaaagaaaaacggagcgcugcccgcuguuguaccaguggcaccggaagcaguacguuggagcagcccauggcauggcuggaauuuacuauauguuaaugcagguagguaagaauacucuuacacacuacaguauauuugaucaaacaugaaaugggaaaugaauccugcauauaaacaaagcagucuggauugaaauacccuacuuugaaucgcugaugcguaacucugccacauaaaccacaggcaguggauuucuaagaguccagugaguuccugaguacauuugguauggagucuuuuuuuuuuuuuuuuuuuuuuuuuuccaauuuucuuuuuuuuuuuuuuuugaucauucuuggguguuucucgcagagggggauuuggcagggucacaggacaguaguggagggaaggucagcagauaagugaacaaaggucucugguuuuccuaggcagaggacccugcggcccucugcaguguuugugucccuggguacuugagauuagggaguggugaugacucuuaacgagcaugcugccuucaagcaucuuguuuaacaaagcacaucuugcaccacccuuaauccauuuaacccugaguggacacagcacauguuucagagagcacaggguuggggguaaggucacagaucaacaggaucccaaggcagaagaauuuuucuuaguacagaacaaaaugaaaagucucccaugucuaccucuuucuacacagacauggcaaccauccgauuucucaaucuuuuccccaccuuuccccccuuucuauuccacaaaaccgccauugucaucauggcccguucucaaugagcuguugaguacaccucccagacggggugguggccgggcagaggggcuccucacuucccaguaggggcggccgggcagaggcgccccucaccucccggacggggcggcuggccgggcagaggggcuccucacuucccaguaggggcggccaggcagaggcgccccucaccucccggacggggcggcuggccgggcggggggcugacccccccgccucccucccggacggggcggcuggccgggcggggggcugaccuccccgccucccuccccggacggggcggcuggccgggcagaggggcuccuuacuucccaguaggggcggccaggcagaggcgccccucaccucccggacggggcggcuggccgggcggggggcugaccccaccaccucccucccggacggggcggcuggccgggcagaggggcuccucuccucccaguaggggcggccgggcagaggcgccccccaccucccggauggggcggcuugccgggcggggggcugacccccccacauccuucccggacggggcggcuggccaggcgggggaugacccccccaccucccucccggauggggcggcuggcugggcggggggcuaacccccccaccucccuuccggacggggcggcuggccgggcggggggcugacccccaccucccucccagacgggguggcugccgggcggagacgcuccucacuucucagacggggcgguugccgggcggagggucuccucacuucucagacggggcggccgggcagagacgcuccucacaucccagacggggcggcagggcagaggcgcuccccacaucucagacgaugggcggccuggcagagacgcuccucacuuccuagaugggauggcggcugggcagagaugcuccucacuuuccagacugggcagccaggcagagaggcuccucacaucccagacgaugggcggccaggcagagacgcuccucacuucccagacgggguggcggccgggcagaggcugcaaucucggcacuuuggggggccaaggcaggcagcugggagguggagguuguagcgagccgagaucacgccacugcacuccagccugggcaccauugaacacugagugagugaacgcgacuccgucugccaucccggcaccucgggaggccgaggcuggcggaucacucgcgguuaggagcuggagaccagccuggccaacacagcgaaaccccgucuccaccaaaaaaauacgaaaaccagucaggcauggcggcgcgcgccugcaaucgcaggcacucggcaggcugaggcaggagaaucaggcagggagguugcagugagccgagauggcagcaguacaguccagcuuuggcucggcaucagggggagaccguggaaagagagggagagggagagggagaggagggagagggagaggaggagccuuuccaauuuucuuucgguauggagucuuaaagcagauuaguuaucuguuccccacacuuuucuggguuuuuuuuguuuguuuguuguuuuuuuuuuuuuuuuuuuugagacagagucucacucugucgcccaggcuggagugcaguggugugaucucggcucacugcaaccuccaccucccagguuccggugauucuccugccucagccacccgagcagcugggacuacaggcgcgcacuaccaccuccagcuaauuuuuguauuuuuaguagagacgggguuucaccauaucggccaggcuggucucaaacuccugaccucaugauccgcccacgucagccucccaaaaugcuaggauuauaggcaugagccaccgugccuggcuugcccacccuuuucuucugugcuugucuuccuguuaauugcaguaggaacucuuaauggggaaaaaucuucagggagcaacagggccugcagaacccaacugaggcagagacuuugucauguccugauaacuuugcuugcugucaguugucuucugugcuuuugaugaguuuauugcugugguuaugaucuugucucucaaacaucccugacaacgauagaguacugacucuucuaucaggccaguagagaccccauaacuaaacauugcuucaggcugugcuuggcuugagcauaagccuagggcuucagccuagccuguggccuaaguucucuucccugccaagcgcacagccgccucugccaccgccuccuccuccuucuucuccuccuccucccuccucuaccuuucuuccugcccacuguucuccuccuccuccuucuuucuucuucuuuuaaauuuaagcuuucuuuauucugcaaaacuacaaaacuaguaagucaaaggauauggauuagaauuuagauaucuuagacuggaaaaccuauauauuacuuuuuaaaauuuuacuucagauucuuuuuaugucuaaccuacugccucauguucucacucacuaaaggaaaccaggaaauucauaccuacacaggauuaaaacuuuuucuaguuauugucuuuguuuauuguuguugaaaguaaaacaugcauauaugcauauaguucauuuugugaauuuucuuucuuuuuuuuucuuuuuuuuuugagauggaaucuugcuuugucgcccaggcuggagugcaguggcgccaucucagcccacugcaaccuccgccuccuggguucaagccauucuucugccuuagccuccugaguagcugggauuacaggcaugcaccgccacaccuggcuaauuuuuguauuuuuaguagagauggaguuucgccauguuggccagguuggucucgaacuccugaccucuggugauccacccaccucagccucccaaaguacugggauuacaggcuugugaauuuucuucaugaugcagguacaugcuuucaaaguaaccagaauuccauaccucauuuaaaaauggcacuguuauuuugaacaguuagauuuuguguauguguuaggguucuccagagaaacaaccaauaggagauaaauauuauauaugagaugggauuucuuaaaggaauuggcucacgcaaccauggagucccagaagccccaucaucugucaucuacaguccuaagaccugggaaugccagggcuguaacuccacuccgagucagaagacugagacccaggggagccaaaucccaguccaagggcaggaggagacuguugcccugguugaagccggcaggcaggaaggaacagauguuuucuuucucugccuuugguucuguucaggccuuggagggacuggaugaggugcacccacuuuggggagggccaucugccugacugaguccacaccguucaaugcuaaucucaacuggaaacaccuuuagagacacacccagacaccauguuuaauuugacacauaaaauuaucuaucauaguguauucuguauuuucccgggaaaauguuuuaacagugguucaggaacuuuuuuuuuuuuuuuuuuuugggacagggucucacuuuugcccaagcuagagugcagugacacaaucucugccuacugcaaacuccaucucccggguuuaagugauucuccugcagccccacgagugugcugggauuacaggcguccaccaccaugccuggccggaacuuuuuuuuuuuaaugcuaauucccuuaggggaacauaguaauguaagaaccaugccagugucuuucauguguuuaggcugauuuugcuguauauuauggacuuccuugggaggaauacaaaucauaaaauacuccauugaucugcuuuuaaagugaggaacuuggaacacuauguaguaaguacuugacuuagagauugagccagguuuucuuucaagauucuuaggcaguggcgugguagagccagcauggggagcugcccgcaucucuucccugcugcacgguucguggcuguugucagugcagaacuacgauucagaaauguggaaaggagggcuuuguuucucauacaggguuacagccugcagcuaaucauacguagccuugggcuagaagccagaaauauucugagggaguggaaagggagcaggaacguaugccaagccagguggccgaauguaugugucggugagcugcaggaggaguggaguaguugcuagagaagugugugccugcagacuuggacuucgugcuccuucuugagauccauguucagaaaaugguggcacaagcgggauccaaggguagcauuuuccacccucugagucaaaaggugaagcagaggaacaaaaccccucccugcauguccuucauaggcuggccagagcgucccuggugccuucucaggaacaagugcuggcugcuuggguuguugaagccacagaagaugggggagcagucaggugguugucgcuggcagugcagagucggcugaaagaucugguucccgcuuagcccuuagggcagaaagccucauggggucagcaggggacgggcagagcagggugagccccaccucuuagccugucaugacugggagcuuagcuucaagguugccucaggcuuccuuggccaagaaagggucugcucagugaguugggggcuuagaauuugguucuuauuucucauugucuaguaguuuagucauguaaaagugguaguuucaacuggagggugucguuggaaggcuaucagaacaauauaugcaaaaacucuuaaaauaucacuuaaaaagaacuccacuuucaugauagcagaauaaaaacaguucgccucuugaaaauaaucucagaacaaccagaaaaacaacaaaacagaaaccgaaguucuuugaugaagcuaggggacaucuggagcuccagcugcaaaccugugaacugaagcaggcaaaagaaugacagcugaccugcugggaugaaagauggcgucagugcccgagggggacggugcccacgagaagcaagucaguuuguucuacagaaccccagaacucaggaggggaaagugccauguccccaguaggcauugccauacgugggcuugggggacucucuggcacaggaggcuucuuugagcaugugcagugguuggaccucugugagcaccugcacccagcacagggagggaacugccuauccuucaacucgugcuggagacaaaaggaguuaggucuggaaaaacugacuaggcucuuuucaauucaggaaagccagauguagaagagaguuggagugaagcacagaacuaaaaauagggggcgagagugaguguccaugguccagggugagacugccucucugucaccgccagccucaggcaccgucaccucucccucaccccaaggggcagcaccaccuccaccccacucggggcuugaagucacuuuuccgaagaaacaaguagcucagauaaaaguuucauaaguacagguauuugaaagcccccauuaaaaaguuagucugccauccaugaugguuaauuuuaugugucaacuugacugagcccuggugcccagacauguggucagacauucuggauguuucuuugagggcguuuuugaaugagauuuacauuuaaguugguggacuuugagugaagccagcugccccauaggaugugagugggccuugucaaucaguugaaggucugacuagaacaaaaugcuggacccccaggcaagagaggauucuccagcacucugcuuucagacuccagcugcagcuccuuccugagucuccagcuugcuggccaccccaggcaguuuguggacucaugaagccucugcagccaguuccuuggagugaaucucuuucucuacuuuuacacaucccguuggucuacuucuuuggagaccccuggcaaucccccauccagccacuccacagugauucccaccguuccgcagccccuccggugcacugaggacagcgaggagcugugccuuaugcgugagcacagaccaguagccgaugagcggacauggcagaaaagccccagcuugaaagauggagaccugaacaaguagaaauaaaaacaaagagaaagcaggaaguggaagaaagcuucgaauaaauaauaauucauaauuaauauccucagggaaauaagagaagcuguugcauccaagaaacaaacauuugagggaaaaagagagcucuugaaaauaaaauauauaauagcugaauuuuuaauaaguucaugaaaaugggaagcaaagucacauaucuuagaaagcaggcagaaauagacaaugggagaggaaaacguaagaaagaggauuaauccaggagguucagcaugugacuagugggagaccuagugagggagaacacacaauaggagggaggaaaauaacacaaaaauaugcucuagaaaugagggacauaggcugggcgcaguggcucaugccuguaaucccagcacuuugggaggccgaggugggcggaucacugaggucaggaguuugagaccagccuggccaacacagugaaaccccgucucuacuaaaaaaauacaaaaaauuaccugggccucauagcgggcaccugcaaucccagcugcuugggaggcugaggcaggagaaucgcucgaacccgggagggagagauugcagugagucgagaucacgccacugcacuccagccuggguaacaguaugagacccugucucaaaaaaaaagaaaaaaaaagaaaugagggacauaguugcauauuggaaagaccuaccaguuuccuacacaaugagugcagacagacaaauccacaucaugcccguuauugugaaagcuuaagauaaagggauaaagagacaaugcuuaaaacauuagacgggaaauagcuggguguaguggcaugcgccuguagucccagcuacucgggaggcugaggcaggagaauugcuugaacccaggagguggagguugcagugagccgagaucgugccacugcacuccagccugggcgacagugaaacucugucucaaaaaaaaaaaaaaagaaaagaaaaaaacagguuauguacaaaguccaaaaaugacauuggacuuugcaacaguuucauugaagcuaaaagauaaauggaaaugauuuccaaguuuuuuuuuuuuuugagacggagucuugcucuguugcccaggcuggagugcacuggcgcgaacucggcucacugcaagcucugccucccggguucaugccauucuccugccucaacuccugaguagcugggacuacaggcaccugccaccaugcccggcuaauuuuuuuuuuguauuuuuuaguggagaugggguuucaccguauuagccaggacggucucgaucugaccucaugauccacccgccucggccucccaaagugcugggauuacaggcgugagccaccgugcccggccaacuuccaaguuuugaguaaaaaugauuucuaacguugcauucugcccagaaaguuaccaauuaaauguggaguagagcaaagacuguuuaaaacauccugucccccaaauuuaauuucccuguacuucaucucaggaagcuacuggaguguggugucuaccacaacaagggaguacucuaagaaggaggaucagauccagggaagaggggcucccauacaagacaggggagcagaauccccaggaaguugacaggugcaagucccaggacagcagugucacagaagaccuggaaagcagccaauuauggagagucgccuccagggaaagcaaagucauaguagauuugaccauguggaaaaucuuaucgagagacuuuuuacagagcuguugguggguaugaaaaagcuuagguacugguuuaaagaaaacuaagcaaauaaaaugugagaaaguuacuccaggaaaaacuaaaagguguaaaagaauaucuguaauucaguguauuuccuguuucaggagcaaacaauauuugcauaguauagucuguaaagaacacaggauuauggauggugaccagagugaaacuaaaaauggugaccagagugaaauucucuugggaagaucagaggaaggaaagugucccucaucugccacaaggggaaaccuagaaucaguaacucagggcacagccaugcauggauuguuuagaaauacugugguaauaugaauaagcagcuaacaaccaccacaacaaaaaggaacucaguuguguccuaggaacgacauggucuguuggucuuugagauaagcuccucaacauuuuuugacauuuuaaagugguucuguauugauuaccuguaagaaaguaauuuuaaaaguaccauguagccuuuuggaaauaaacuuaaugaccuauaguuuuuaaaaagcuaauauauucucuaaguguguaucaggaaaaacaccuaaagauuuucuacuaaguauaguuuuauuucaaugaaauuuagaaguauugauauuccuuaaauuagcuuuccuucauuuuuaauaaaauuaacuuuuuguugaagaaaugagguuuuuauuucauucuguaggagaugucauguuguaaacuuuggugcuuauggaaugaugagaauuuaaagcaaugcaauauuuuauuucaguuuugagaguacuuuacgucaccccugacaugugcaauuaaagccaagugaaaaaucaguggccagaggcggguucucuaucucagacuuuagcaauaugcggauuuauguggugcuaacaugucacuuuaaagacauugugugguguuaacaugucacccugagacguucuguggugcuaauaugucacccuaagacguuuguguggugcuaaccugucacucuaaagaugucguguguugugaaugugucacccuaaagacauuguguggcauuaacaugucacucuaaggaugucaugugcuaaugugucacccuaaagaugugagguguuaacaugucacccuaagauguucuguggcacugucauucuaaggaugucauguggugacaugucacccugagauguugugugauguuaacaugucacucugaaggcauuguguggcauuaacaugucacccuaaagucauuuuguggcauuaacaugucaccccaaagacauuguguggcauuaacaugucacccuaagauggcgugugggcuggcaugccacccuaagaugcucacuuagcccagcuuugccaucugacucuucucaccagguuuuuucaugggaagcuguacaguaacuugagacucuuugaauguuuuuauuuaaguccuuuuaaaaaaacagugccucaaaauuagcaaauauuuuccaacuauguuuuuagucuuagucccuguaguaaaacuuuaacacacaaacucaguaauaaauucuaguagguaacauuuaaugagugcuuucaguucguaaaaggcaguauugccacaaauuguuggaugaaggggugaggcaugcauuuuuuucuuacaaacaccuuaggaguugagugcuaugauuauucuauuuuagagauaaagaaacugagguuaaauaauuuggccaaguaacaaagccaguauauagauuugggagaagagggguaccuggcuuuuuaggaggugugagccccauggaaggaaaucaaguauugguauuuuaacaaagcaaagcaacaaaacaaaaccuaucuacuccuagguucacuugccauuuaaucauuuccuuuacuacucucuuaggaguguaguccuaauccaccaaagaagagacaaaauacacuauaacacuaagauuucaaacaguugaaacaaguuuugccuaagucuuaaauaaccagauaguugaaugaauucuaauuuuaugugcuuuuuuuguuuuccagguaauugauguuuuguuagccaugauacaauguaaaagaaauaacuucagagaaaauaauuuguguuucauuuuuguuuguuuaaagccggcagcaaaaguggaccaagaaaccuugacagaaauggugaaacccaguauugauuaugugcgccacaaaaaauuccgaucugggaauuacccaucaucauuaagcaaugaaacagaccggcuggugcacuggugccacggcgccccgggggucauccacaugcucaugcaggcguacaaggucagugcuuccgccgucacggccguccccuguguggggagccagguuucccugucagguuuugggucuugcuuugguaaggccauuugacuguacacuaaaaaccuuuuagaaugauuguuuuuacaaaauaaagucucuguauuuuaccacucaucaccacugucauuagugcugcaagucuguguguguguaugugugugauuguguguguuaacaggguuuauauucauguguaaaagaaaaccuagaugacagagcaguggugagaugauuuucauucuaaugaguauggauauccaguaagguaguggacaggauuauaaccaaagugcuuuuuuguucauuuucacauaauuuuauuuucuugcuugaauaagccuuuauugcuggauuaugauuguccaagaacuuuugaguuuaaaauuguuauguuauucucaagacauagugguacucaaauuuguauacgucugggguacuauaggaaaauuggcuaaaccuucacugauuaauucucguaggcuuuaaauauauuugggcauaauauuaagagcgcuauugauuucuguccuggacuaagauuuaucauuuaagauuuaucauuuaaguugaagugaugcuucuuuuauaauuuuauuuuguauuuaacacaucuguguuuguaauaauugauguuggagauuguugcucauacaucagaguauauagcuguaacacaaugauugcucuguucaacacaguauuuuggcaaguucucuuuguuuaggauagauagguggaauuaauggaguggaacucauauuucuaccuggaaauaauaagaacugauaccugagucaauuuuauuuuuucuuuacagcuaccguaauaaauuacuuaggaaaauuguggggaauuaucucucaugauuuaggcuaauuucucagaaauuuuuaguccuccuacaacaauaccaaaauauucaaaucauauauaagauaugaucauucaagaaaacaacucagaaaguuacgacguuuggucagugaaacacaaugaaauguauuuuuugaaaauaagaugcaucuuccuaacaguacccucacuuuuacauuaaaacauaauucuguucaaaucacugccucccuuuuuuagaguuuuggagcaguuauaacuucaguguccuagagggacaucugugauacaaauguccaacaauaacgugugagcacaauauugacuguacagacaggggcccucugauacuuuuaaaacaaauauauaauugcuaaaauguggaagcuccuuuuugucaaacuccuuuucccuucacuuuaaagaggcucagccaacacagcuggguguucccgguggcugaucucugcugccaggugugcuuuuccacuguguuucaacugagcccuguggagagcaagcaggugccaggaaccaggcuguccuguggggacccuuccuccugggcaguuccauuuucaugaguucugcagacaguggccaccaucuguuuucaccacugcuggccacuugggagcaagccagcacggcucugccacugacgggcugcagguggcugcggccagcuccuccuggcagggcuucugcauagaauaccauucagacaccuugcuuugcccugcugguuccaaaacaaauuucucuccuccagaaagcauagagccaaagaugucaagaucccauacuuagucuuuaaaacuuaauucuguccucuacauuaagauucuugaacaugaggaacgaggaggaauaucagaaucuucuggggguaggaaggcaucagugguaauuugaaaaagcauauauauuuuguauuucaaaauagcuagaagagaagauuugaaauguucccagcauaaauaaaugauaaauguucaagguaauggacauccugaauacaucauuacacauuguaugcauguauaucacaugcacccauaaauauguacaauuauuauauaucaaugaaaaauuuaaaaaggaaaaagcauauguaauauggucuuagaauuggggguaaaaauacaucuucuucauaguauaaacuacagaaaauaaguguagacuaaagcucucugccagcggagaaacagacccugcgccguggagucugcacaucuguuugcgucucugagcagagggcgagguuuguguuugaccaaggcaggggguucagugggggaggcaaaacuagggaaguacagcucuacacuguuuucucucaaguuacaguuaaguugagagggccuccauuuauuaaagcugucucuuaaaauuagguaggaaauguucaaguuuuauguaauaacaagcucuaacauuuucuucuccuggcauaugaaguccuaaguuguucaggcaugcuuaugaagguguaaaguguucaaguacuugaaaaaauauuauuaauuauccuuuacaaagaaaacuguaaguucaguccagacucacaaaauuuauuuucccucccuguagaugcucaucauguguuaguauuuaguaggguauauacucuucuguguaggaacguguauuacuuguuaauuuaaaguuaugugguauuuuagauggccuuaaaauguaaagguuuggccagacacuguggcucacaccuguaaucccagcacuuugggaggccaaggcaggaggguugcuugagcccaggaguuggagaucagccugggcaacauggcaaaaccaugucucuacuaaaaaaaaauacaaaaauuaucugggugugguggcacgcaccuguagucccagguaccuaggaggcugagguggaaggaugguuugagccugggaggcggagguugcagugagcuaugaucaugccacugcacuccagccugggugacacagcaagacccuaccucaaaaaaaaaaaaaaaaaagaaaagaaaagaaaaaggcaagguuuuaacaauauucuacauuguauuaggaauuuuauuaauugugaaugauuuucuaacaaauuacaucugacaaaaaaucauggguaaugguggcaaauucuuccuucuauucacguuuugaguucuagggcauuaggaauuuguguggguuuagccacuguaaacaaauacauuuguuaaaugagauuguauuuggaaagguaaaugcaauguccaaaaaaagcauauaauacccccaccagggugacacgagugcaguccuuagaugcugaacugaaucuggcagcagccacagcaucacugcuugugcccacacgccugcccugggaagccccagagagaacugcauugggagugcccccugguggccaacuauuguauauaugucagaaaaugcuuucauacaaauucuguucccgaagcuuguuugcaaguugauuauuugaaacauggaauguuuuucuagggguaucagaauuacuugaaaaguuuuuuuaagcuauacuuuuuuuccuccuuacucaagauucugauaccuucuuaauuuuaagcaucacuuaaauaaauguaccauaguuuaucauuguuuuucuuucuuuuuuuugagacacagugucgcucugucucccaggcuggagugugcaguggcgcaguuuuggcucacuacaaccuuugccuccuggguucaggugguucuuguguguuagccucccaaguagcugggauuacaggcacacgucaccaugccuggcuaauuuuuuguauuuuuaguagagacgggguuucaccauguugcccaggcuagucuugaacuccugaccuuaggugaucugccugccuuggccuccaaaacugcugggauuacgggcaugagccacuguguccggccaguuuaucauuguuuuucaucgguuuccagguuuuggcuauuaggaacaagcugcuaugaacauucuugcacaggucugucuagagacacaugucuucauuucuuuuggguuaauaucuaggaguagaauuacuggaucggaggguagguguauguuuaguuuuagaaauugccacuuuuuccacaaguucugguuguucugcaucugccaacacuugauguugaaagucuuuuuaauuuuaauuauuuugguggguauuucauugugguuuuauuuguaucuuccugauugaccaggguugauuaauguugcaugugcucaugggccaauuguguaucuuccuuuguugacugucucuucauaucuucuucuuauuauuauuauuuuuugagacagggucuugcacugucacccaggcuggagugcagugguggaucuuggcucacuguagccucgaccuucagggcucaggugauccucccacuucaaccuuccaaguagcuggggacuacaggcacgugccaccacaccuggcuaaaucuuuuuauuuuuguaggggucuuguuuuuugcccaggcugguuucgaacucguggacucaagcaaucuuccugucuuggucucccaaagugcuggaauuauaggugugagccacugugcccagccugucucuucguguguuuuaccuacauuguuuuauuuuauuuuauuuuugucuuuuugcuauuuuugaaagaauucuuuauauguucugguuaaagucccucugucagauauauaucguacaaauaauuucucccugucuguaguuugccuaaucauauucuuuaugguaucuuuugacuaauagaguuuuaaauuuugauaaaaucuauuuuucaauguuuucuuuuuaugauaauuacugucuguguuuugucuaagaaaccuuaucuacccucagguuauauagauaauacucuccuuuaaucuuuauuguuuuagauuuuaccuuuaggccugugauuuaucucaaauuaaguuuuguauauuacaugagguaacaaacgaggugguuuuuuuuuuuuuuuuuuuuuuuuuuuggagacagagucucacucugucgcccaggcuggagugcaguggcacgaucucugcucacuacaagcuccgccucccagguucacaccauuguccugcuucagccucccgaguagcugggacuacaggcgcccgucaccacgccuggcuaauuuuuuguauuuuuaguagagaugggguuucaccguguuagccgggauggucucuaucuccuaaccucaugaucugcccgccucggccucccaaagugcugggauuacaggcgugagccaccgugcccagccugagguguuuuuuuuuaaccauagggauaucugauuguucccauaccuuuuguggaaaagacauuuauuuuucccauuugauugauuuugguuccucuaucaaaaaucaaaugaccuaauaagccugggucuguuucuggacucuauucaguuacuuuggccuguuuaccuacaugauauuaccacguuguuuuucuuauucugcauuuauuguaaguuuugagaucagguaacuuaagaccucacuuuguucuuuuucagaaucacuuugaauauuccaaguccuuuguauuuucauauaaguuuuagaguccauuugucagcuucuaaaaauggagccuauuggaguuaugagucagagugcauugaaucauugaaucucuagauccacuuggguagaacuaacugacaucuuuuuuuuugagauggagucuugcuuggucgcccaggcuggaguaggugugaucuuggcucacugcaaccuccgccucccagguucaagcaauucuccugccucagccuccugaguagcugggauuacaggugcccaccaccauacccggcuaguuuuuguauuuuuaguagagacggggguuucaccauguucgccaggcuggucucaaacuccugagcucaagugaucugcccgccuuggccucccaaagugcuaggauuacaggcaugagccacugugccuggccagaacugacaucuuaauaauguugaguccuucugcucgcaaaugugguauaucucuccauuuauauuuucuuuaauuucugucaauagugcuuuauaguuuuugcucuacaggucuuaacacaucuucuguuaaauuuauuccuagauauguuauuuauuuacauuuuccaauuauguauugccaguauauagaaauacaauugcguuuuuuuuuuuggagacauagagucucacucuguuacccaggcugaagugcaguggugugaucacggcucacugcagccucuaccuccccaggcucaagauauccuccugacuuagcugaguagcugggauuacaggugugcaccaccaugccuggcuaauuuuuguauuuuuuuguagagaugggguuucgccauauugaccaggcuggucucaaacucccaaguucaaggguucuacccaccucggccucccaaagugcugggauuacaggcuugagccacuguaacuggccacagcugcuuuuuguauauugacuuuauauucugugcuaaauucacguaucaguucugguagcuuuuuauacauuacuuaggauuuucuguguacacauauuguaucugugaguuuucuucuuccuuuccaaccucugugccuuuuauuuccuuuaccucuuuuauuacauugguuaggagcuauaguauaauauugaauagaaguggucagaguggacaucuuugcuuuauucacaaucauagaaaaaaauauuaaauauuuccccaucaaauauacuuuuaacuguuuuucuuagauggcuuuuaucagauugaagaaguuuccuuuuauuacugguuaucaugaagggauguugaauuuugucauuuuuuuuuccuggauuuauucaaacgcuccuaugguuuuccucuuuuguuuuauuaauauggugauuuuacauugauugguuuuuaaaaguugagucaaccuugcauuccuaguauaaaccucacuugggcaugauuuuuauccuuuucuuuuuauuaauauugcuacauuuggucugcuaauauuuuguuaaagauuuuuauguuucuuaguacauauuuucuuuuucuauaaaaucuuuguuuuuauuaggaaucagguaucaggauuaugcuggucacguacaugaguuggaaaguguuuucucuuauuuucagaaagauuuuguguacaauugguguuauuacuugcuuaaauguuugugggaaaauuuuuuauuaugaauucaauuucauuaauagaaucauuuugcaucaguuuuguuaauuguguuuuucaauauguuuucucauuuuaucuaaguugucaaauuuauuggcauaauguuauucauaccucuuuuuuuuaauguuuaguaaggucugaagugauaguuucucuuuuguucuuuuccuuuuuuuuuuuuuuuuuuggagauagaaucuugcuguuucucccaggcuggagugcaguggcacgaucuuggcucacugcaaccuccgccucccggguucaggcaauucuccugcugcagccuuccauguagucgcgauuacagacacgagguaccacgccugacuaauuuuuguguuuuuaguagagacaggauuucaccauguaggccaggcuggucucgaacuccugaccucaggugauccgccugcuucggccucccaaagugcugggauuacaggugugagccaccacucuggccucucuuuuauucuugauauuaguaauuuauguuuucucucucucaucagucuagauagcagcugugucaaaguuguauugcucuuucaaagaaauaaacauaaauuguagcuuuaucuauuuucuauuucauugauuuuucuucuuuucuuuuuaaaacuuccuucuaugguucugggcccaguggcucacuucuauaauuccagcacuuuuggaggccaagguggaggauagcuugaggccacaaguucaagaccaaccugggcaacauagugagaccucaucucuacaaaaaauccaaaauuaucugggcaugguggugccacugcacucuagccuaggugacagagucagacccugucucaaaaaaaacauaaaaaauaaaaaauaaauaaaauuucuuucuauggacuuuagauuuacuuugcucuuuucuaacuuuuuaaaguggaaucuuagguuuuguaccuuucuuuuuuucuaauacaggcauuuaaagcuuuacauuuuccucuaagcacuauuuuagcucuguucccaaauauuuuaugucuuguuuucauuuucauuuaguuuuagauauucccuaauuacccuuaugauuucucuuuugauucauggguuauuuagaaguggguuguguguuuuucagauauuugagaauuguguggauauuuucaucgauuucugauuuaauuccauuguuguuacagaacauauuauguacgauuuaacauuuuaaaauuuacuuagauguauuuuauggcccaguauuuagucugucuugacgaaugucccacgugcguuugaauggucuaguugucaggcauagugugcuagaaaugucaguuaggccaaugguuggauguauuguucagaucuucaauuacagaggucagcgaacuuccuguaaugacccagauaguaaauauuuuaggcuugugguccaugcaguuucugcaaccacucaguucuaucauuguagcacaaaagcagccacagccagugugugaaugaaccaucaugaccucacuccagggaacuucguuuacagaucagacugugugggcuuguagugugcugacccucacagauuugccuuacauauuuguuucggcuguuuguuuacucagucaugggaggaggaguuuuacagucucccaacuguuuauuuucuucucuuuaauuuucuuaguguuugcuucauguauuuugaggcucuguucuaauacauguuuaugaugguuauguuuuccuaaugaauugacucuuuuaucaucauggaauguuccuuuuaucucugguaauauucuuuaucuugaagucuacuuugucugauauuaaugcagcugcuccagcauuuuguaauuacuguuugcaugacacaucuuuuugcuuucaaccuguaugggacuuguguuauagcuagucuaauaaucucaguguuuuaauuggaauuaguucauauauauuuaauguaauuauugaugugguuggauucagcucugccauuuuaaauuuuuuaaaauuacauuuuguguguuuccucccucuacuuuuucuuuccugccuuuuuuuuuuuuagggagguagagagauuaguuggaaauuuuuuaggauucucuuuuuucuguugacucuuuuuuuuuuuuuuuuugagauggagugucgcuuugucacccaggcuggagugcaguggugcaaucucagcucacugcaaccuccgccuccuggguucaagcaauucuccugccucagccuccugaguagcugggacuacaggcacgugccaccaugcccagcuggcuaauuuuuguauuuuuaguagagacaggguuucaccguguuggccaggcuggucucaaacuccugaccucagguaauccgccagccucggccucccuaagugcugggauuacaggugugagcgccaccgugccugggccuguguuaacucuuuaacuguaucuauuugcguauuuuuuuuacuaaugcuauagggguugcaauauauaugcuuagcuuuucauaaucuccuuagaguuaacacugagccacuucgcauaaacuguaagaaacucauaggcaggugguucugcuuccuccagagcuuugcacucuaucugccauauuuauaaaaucuaugaauguuguaaaccacuaauacaauguuagaauuuuugcuuuauuuuuaauuuaaaaaauuguuuuugaagagacaggguccucacuauguugcccaggcuagucucgaacuccugggcucaagugauccuucugcuucagccuccuaaagugcugggauuacaggugugaacuaccauaggggcuggccagaaauuuugcuuuaaauagaccugcauauuuuauuugaauugauacaagcaaaaaagauaguuuugauauuuauuuauguauuucccauuuuuaguggucuuuguuucuuccugaagauccugauuucuaucugguauuauuucuuucauccuguagaauuuuacuuaguauagguuuagugacaacaaauugauuuucauuugucuuaaauuuguuuuuauuucaccuuuauucuuaaauacaguuuugcuggguguggaauucuggguugacuuuuuuuucuuuucggugcuuuaaaggcaguguuccgucguuguccaccucuguucuuucaaggucauucuuugcacuauucucuuguauggaacaugugcuuuuucucuagaggcuuucacaguuuccucuuaauuuuggguuuucaauaguuuaacuguuacaugccuagauguauuuguauuuaucgugcuuaagauccuuugaacuugaauuuguaaguguguaucuuuuaguacacuggggugacuggccacucuuuuccuacagguuccugaggcuuuuguuuuccagauuucucguucuucucuguaauucggaucagaugauugcuauuucccugguuuuguauucauucaugauuucuucuguuauguccagccugcucuuaaacccacccagugaguuuuguaauuuuaccuauugauguuuucuagguccagaauaucccuuuguuucugucuuauucucccuuucucuucugaggguucacugaugaugaguauaguucccuuuucaucuuugaagauauuucuaguaacugccuaaaacccuugucccuauuucugacguuugggucaucuugggauccaucuguuuuguagcaugggcgcacaggcccaggucgggugcgguggaacagggacucuagcccugccucugacuccagagcccucggguuuuccuuugcauugugcugucuuuucacacuuucuguccuguacugcccagggaaacuuaccauuugggggagguaauguggauaaguacauggauuuuguagcccauguaugauugcuguaauacaauguggagaagauguaucugugauuaaguccaggagcuuuuuucuauaguucugaauucuuggaugucucgcuguuagaaguagcuguuugcuuagagcaugaguguaugugguggcaggagugggcaugguaggcugcuggugcugagaagcagcagugcaggcugcauugugggcauggcucuagcagccucagccucgcaggcgcagggacggcaugaaggaacccuguucaguuucccuguggaccaucacucacccaggcuccaccagcaggggcagcuccagcucacuuuagggcuggccucacugugugauuucagaacacagccucucaaacaauaucuucucacccauuagcuuugaccaaauauuuccuuaggaugggaaaacauguuuuccuuuacaguucauuuucagaggcuuaagaugcaagugacaggaugaagugugugugccggcacaauaccguagaaagaguaaugguuaaucauagccaggaaauagcuagcacuucccaugugccaggcacuguuccaggagcuccauggaugugaucacauuuuaaucuucauagcaagccacugaggugaaggaaugucaucccuuuauaguugagaaaacuaagacauagacuuucagugacuuauccaaggucacacaguuaaaaggugacaguagggacucagcucaggcugucugaccccagagcccacaucuuagcagccuuugugacugauagaggguguccugcgucugauucccuaacagccuaacuuugggaacauuuaaucucccuggugauuugcugugccucuguuucccgcugugcccucuguagacacuggucgcaguucucaugcccugccccccaaccuccgccuuuuuccugaggccucagagcccuucucggcugaguguccagcucaucagucacaaguagagggaccugaccugccacccaaguagugaugaccuuugugccucugauucauuguccaaaacccauuugcacuggaaugugaugaguuuagcagguagggauaacuaagaacagacucugagaaaaggaucaggaaaacaguacauggccugugaggagaaagaagaaaauguacaagggaaucucaggaagugaaaacccacagcugcuucuugccgucucuugccuucacugagccugccugucucugcagcugaccauauaaacaacucagggagguggugcuugcuccuggaccccagaaagcuuugugccagcuuccuugggaugggugaagauggaucuuccuagccugguggugcaggguccucagguccuguugauguguacugaucaguguauuggauacucuugcccugcuaacagggccucacucucucgauugccuucuacaagagcagaaguuuuagagcuaugggauguaugugccaagaaacaaggaaaacaucuuaccaaaaagauauggcagcuuuaauuuuaauuuuaaaaacuaaauuuuagcauuacuuuaguaaaaccgugaaacagaaggaggacaaggggaauaggcuaaugcagggguccccagcccccaggcugugaauugguacugguccguggccuguuagggacugggcugcacagcaggaggugagcagcagcgagcaagcgaagcuucaacuguauuuacagucgcuccccaucacuugcauuacugucugagcucugccaccugucagaucagcggccacauuagauucucgcaggagagcgaaccguaucgugaacugcuuaugcgagggaucuagguugcgcgcuccuuaugagaaucuaacuaaugccugaugaucugagcuggaacaguuucaucccgaaaccaucccccacucaccuuccuggccauugaaaaaugguuccacaaaaccagucacuggugccaaaaagguuggagaccgcugggcuaauggauugagauugcgagauucuauguacuguguugcugguguuuuuuuguuuguuugucuguuuuucacccccagugccauuucaguuuuccuaauaucaugccauauucuaaccagaaagggaaaguauuuugccaacucaucguugaaacugucuuuuuaacacugcuuuguuuuuaauuugcccaggucuuuaaggaggagaaguacuugaaagaggccauggaguguagcgaugugauuuggcagcgagguuugcugcggaagggcuacgggauaugccaugggacugcuggcaacggcuauuccuuccugucccuuuaccgucucacgcaggauaagaaguaccucuaccgagcuugcaaggugaggguggcucuguuggaacugcuucugaacaaccccgagugugcacagaauccagaguccagaaguacaacuccuguuccuucuuuuaaccuguuucucccaguucuguagcuuccucuuuuucuucuggcacagccuuaucugugguuucucugggccacagugucccugucuguagaauggagaggacaaaugucaauggcuucugaagaauauguguccuggagucacuacgugaugagaauuaccaccugugccauuuauuggcuuuaugaguuuggauaugucucuucuucaagccucaguuuccucauuuguacagacagaaaaaaaauacuacccaccuccuaaggauguuccaagcagaacugagcuaaugugcagauuguuuguaaucguccugccaaaacccuccacggcuucccauugacugcagauggagccuaugcuccuccgcugaguugacagagcccugcgcaccuuggccccucucugugucucugccugaucuccuugccuuacccugcccucuagcccgccauaauacagccauguugcccucucuaagaacggagugugucacucuuguuuccgcuggaccugucguuaacuguucccuucaggagcacucuuccuucagcuccuugccaugcugaucugaauugugacauucuuggagggaucuuugagaccccccaaguggaugaucacucaguugcucauuguauguuuuggcuuguuucuugaguguguaggcugguagaacauaagcuucuugaucuugucugucugggucacuauucuacacuaguacuuggagcagugcauagcaccgaguagaaacucaguaaacaugcacuggacaugugaagaugaauggcauagagcaagacucaguaaauguuugcuaguauuuuuauuauguacacauuucacaaaauguaguugugugcacacagaaaaaagauuggaagaaaauacacuaaaguguguacagugacccuuguuagauggaggcauugcggcugauauguucuuuauacuuuuugaacaucuauuacuuucugaagacuucucaaccccaguggaaugggcccuaccucguuggugcacuggaaaaugcacacacaucuguggcucccccacugauggaagcaugaaggaggcuguggaagcaaagagggcagggcccaacuuggcauagcaggucagcaagggaugucucagccaagaccugagggacagcucgaaauuaagcaaagggggaugaggaaagaugugaaaaggagaagaaacugcuguuccaaaggcccggaggugugagcacccagggccugugugaacuacacuguggcuggagcacgggggauggggcaaaacaggagccagcgagcggggagcagccagauuccgcaggccugggccagccuugaugaugugaugaugguagaugacuaugcaaauaugggcaaugcgagaagaccgcaggaggggugagacgcagccgguucuuuaaagaugagggguuuuucaggugggccaggcagggguggccugcagagguggaaugcaguucugauaaggagaauagcuugggcagagcugcagagcacgaaccagcucuguguguuccugacuccguaagcacuucagccuuugggaugcaaagggaaggaaauguguggccaaagguaaaagucagacagguggguagaggccagagaaaguuaguucuucccuguagccaguaguucucaaccuuguaccacugggaagcuuucaaaucaugccuggaccucacucuagaccaguuaaaugaggaagccucagcacuaauauuuuucaagcucccccaguaaguuuaauaaucagcuagcacuggauacugauauggaagaugggggcucauggaaggguuuggaauccauauucagacuccucuuuuggaaagauugcuguagucccaguaggaagaaugaggcgggcuuggguuuccccaaauagugguuuaguaauuaaugcaagaaauguugagucauaaaccaaagcauagguugggauaaaaaaugagacauuuagaaacaccuaugauguaaagcccacagaauuuaacgcauguuuuuaaauguggagaagauggaaauaucugaaggucuuucuguugucugacucggaaaacuggguagaugggccaucaaacaagcuaagagugagcagauugggaggggaaaagcagagugaguuucuuuuuacgugugcugaacuugauacuccucauguuuauuacuuaugauucuuaguguacaaaugacccuucaaauuaugauagcuuaggcacaaaagggaaguuuauuaaaacgauauggaaacacccauugaagaggucuaagaagaaagggucaaggagcucagaggagagcacagggagggcugagggccgggggcugggaagguggagaggcugccaagcagcagcagcagcuguggaggggcugcagugagaggcggcgccccaggcagggcugaagcuguuucccagcuggggccaggggagccagcagcugcugcugagagccauuuuagagccaggguuuuuuguucaggauagagcaggcguuucgaguugcuucuggaaucaucagcugaagcggcaggaggaaggugccagggagaacagagugucguugagccguucgguuuucaccucggacuucccagcagcuguaaggcagaccccacucuacagcugaggcagccgcaagcagagccuugcugggccucaccccuggaagagggggugcaguagcccauggagcccacgcugaaugcccuacagcuggggguccacuucccugaugccugugaagacauugcauucucauuuauugccuuuucaccagguagaaacuccagucuuaaaaagaaaucccuuucuuuucaguuugcagaguggugucuagauuacggagcacacgggugccgcauuccugacagacccuauucgcucuuugaagguaagagugagaaaaaugcuauagauuaaauguuugggugaaauugguucuccugcccuuguggacuggcacuguucauauuugaccuggcucaaguaauacuuccaaacuguaaaauaaucagcagaguagcuuauugcugaaaauuauguugaaucucuucaccuuaccuauuguuuugugcuccugugaaugucuuccaaguguucuuagguuuuuugugaggugucuaugcagacagaacguagaaggcuugcuguuagcaauggaagaaauaguuuacuccucugcauuucaucuguaauguugcauauuuaauauugguguauucaugggaagcuugaauaauuacuuaaauauauuuaauaucauauaaagaaguaugaauaauuaauauuagcaauuagaaauauuaguaaguagaaaaaauagcaagagugaauauugaagaaaguucugaaaagaggagcacugauaggcaggcagugaaagcaacaaggauuccagaguccaccacgggcgcagggaagggaagacaggagcacaaacagaagccccacaaacaggcccggauauucguuagauuuguauguggguaugggcgugcuuucuguuugcuaacauuuugguaaagguuuuugcaucucuauucaugaaggauauuggccuacaguuuuccugucuugugcugucuuucucugguuuugguaucagggucauacugaccuaauaaaccauguugagaaguaucuucuucucuucuguuuucugggacagacuguguuaauugguggaagaauugguauuaguguaacuuaaauguuugguagaauucuccaguacaaacuucuaggucuggagauuuauuuuucuagacuuuuaaaauaaauuccguuuuuaaaauaguuauagggcuguucaaguuaucuauuucauauugggugagcugucauaguuuguaauuuuugggaaauugguuaauuacguacauguggugaaaugcaaauauguaagcuauugguauuccuuaucauccucugucugcaucgucuguagugguauguccuguuuuaguuuucauacugguaauauuuuuaaaucauauuuuagaaauacgagcagaaaacagagcaugugucacauguuuugcagaagaugaucuuuuuuaauauucagagaacucauaaggaaaaaguacuuacuagaauaaaaguuguaguccucuaugucauaaaaaugcaaugcauuugcaucagauauaacagaguuaaugccugaacucuaaauggaguuuaucaacuugauaauagcaccuucagagccccagugggucaaaagcuuuggauguacagcucccuaaaggcgggaaguuaauaggucaccuccuuccccugugccucgccagugccuggcagacagaacugugggggacucucaccaaauucccgucaggggacggagggauuauuaagccgugugccuagcaaugcaggccauuguggcaaacuggccggcuggaggagccacugggagggcucacuggcaccuggcaccccuucuggaggagcucacuccugcuggagugcaccgcccaguggauccgcugcccacacaccugagcaggaaagccaggcucauccccgcagggccugcuguagggccuccuaggcuuguuaugggucccuguuuacuucucaugggcacuccuaggucagugguuuucuaauuuuuuaaacaaguuucuggaaccuuucuuuaaacaaaaacuuacagagaaggcugggaacaccccagaugaccgucaguaggaaaaauggguaaacaaucugcaguguacuguucagcaguaagaaggggccaacuaugaacaggcacagaacgugaaugaauugcaggaacccugacgaaggagccagauacaagggcuguacacuguggccaugcucauaagagugccagagcaggcagaacuaauccaugguggaccaagaccaggcugcugguuaccucuggggggaccacagggaugggagggacuggagaggggcacuuggaacuuccuggggugauggaaauauuccaggucuuaaucggguuuuguuugcacauguauaugcauuuuacaaaccucagagaaguacauuuuggauuuauguguuuuauuguacgugaauuuuacaucaaaagaaaaacuguaaacaaaaacccuguaagggaggauuguucugauuugaguggggacaggagaccuggaggccuuggugggcuacuagcaccuucuccaccccacacccuuccuaagcugcugugagucuaguugaaaacccacugcucaauuacugcaaugauuugggguggggauuuugaccaaauugagguuuguuaaaaauaacauucuucaaauaucaagaagauauaaaaugcaacuuugagcauauacaggcucugaggggaagcuccguguauaggaauaucguaauuagcagcauccauaacuuccauagcgauucugugaugccaccuuaaaguuucaagauauaagauuaaagcccaguaaccaguuuuuuaaauauaagauagugaggaaaacugguguuauuauauuaccugccaggugcuaaauauaaggauaucuuugguuuuuaaugaagucaucuuuagaguccucagcaccuuucccacaugcuugcagccccugguaagggaaaugauuaaaagucacuguuauagacacuacccuuaugccauuccuaagaggcuccucauuuuacauugcaggcauggcuggcgcuauucacuuucucucugauguccugggaccagagacaucacgguuuccagcauuugaacuugacucuucgaagagggauuaaaaggugcaaaaagacaacuaaaauacccauuuggaccaaaagccaccagauugcuuagugccugacacagaaacaacugggaauccugaaagagaagcagacaccgucacaggccccucugguuagacuagcaugagugaccgaagccauccaucaacauuuucuaacagcacccucaucaauauaaaauaugacuucuucacauacagauucucuguaguguuugcauguuucuugguguuuguugucuccagguguaagcuguuuuaaauggaaggcccuucuauuccugagggcucagagcugaccaugcaugaauguauggcaguguccacuuuucuguauaaaauguauaaagugggguuucuuccauauugacaaaugagggaacagguggugucuaucuuguauaucagaaagauuaucuagggucuauccuagugauaauacauugucagccuuuucuguggcaccuuccagaugagaaugagggagcgaccacuccaaggacggacaggaccagcaguucugcaggggcgugcuggggugguuugggagugcacagcugaacgcuucccguuuggauuuuacacucaccuucguguuuuaaagaagccucagagugcauugcagcucugucagggccccauucccagcagaggcuucaggugcuuuguguagaguccagggcagcuggagcuuuguuggggagacuucuggacccaaagggagcuuucccaagaagccuuugauggccacacuguaggcagcagugacuaagcacuggcaguuccagaacauuuacccagguauauguuacuaaaacaggcuccaccucaguuuaucaacauuauaaguuacuguucuaagaaaaguaaauacaguuccagauggguuauugcagauuaacagaaagacacucaacuggacucaugucccugcaauuaaacuuacuucaaccuuuuggaaaguuaucaaaaucuaaauuuggaaugaaugcauuuccuauuuuuugucuacuuuugggugauaaaaaguacuagcccuuauuuauagauaugagaaacauaauguucuaaccaacaacauuaugguauuugugugacuuuuauuugaaaaaaugugagcaguaauuuggguuagccuaccuucauuaauucuaucacauagauuucaguuuuuagaaggguuucugucaucauggaagagguggucugggacuagguacuucucgucuugugagcuaaggcuugugucaugaaagacaagaggccucucuuaacagcccaguccuugucugcagggggaggccugagcauuucccagccccaguguccacaccucucagaaaagagaaaaaagaaugucaguuuaggagaaaagcuuccuuuuuacuugugugguuauguguggggcuggcacccgaaaugugugacauucagcuucuaaacgaugccuggagagucuguuugcugcagacacccuugcuccugagucauuauuuucuuucauguuagauugaugacuucugugaauagaaaucauccugauccuauuuuaccuggccuccagggccuguugaugggcuuugcaggcaguccagcagcccacaccugcaggcaggaugcugucgucaaugagcugaggguagcugcuuugcugaagaccucacacgauguccaaucucauccaaauaacauuguucccauccuccccacccaccacaucaaaacauaacacaucacagcacucaguagagguccugccuccccauuucucaagggaagccaguaggcaacacagccagcacggugcucuccagggcagccccucucagacgaggaggcagcgggugcagccaggugucugcagagcagccacaaagguggccuaggaugcgggugucuccccaggugaguccauccacacacguuugaaaaacacuauuagucuuucuaacacacugagggaaagauuaaaaucuguggaauaaaggaggagauuuuauuuacagauuuuuuuaaaagccaccuggguugacaccuuccuacuuauccacuagaugucaucagaggugcuguuccgugguucugcauuaaccccugccucaugucuguaacaugugacaguaauuccagcucggucccuccaggcaaaggagaaacgggacuuacuucacaggacagaggauugacagaagucaguuuaagauaaguguuugaaucagauuucaguacaucucauucauuucuuagauuuguauucacaauuguguucucuaaaaugugucuaaauuuuaaaaauauguacaugcauaaugucauuuuaaaaucugaaggaaagaauuugaaguccacaaaaaguguuugagguucuuugguuuuguuaguaaaagccaguucuguggugaugaccuauggaa

SEQ ID NO: 191618 - RNA, 1468100 nt, Homo sapiens
ucauauggaggugccucggucuggaucauuacccagauugagccccaggguaggaguugguugauaaggaauagaugacauuguuuuuauaggacuccugaaaaagcccccauuaggugcccugugccuaaaagggccaguucggugcucaggcacguugccaaaagugaaaccagaagcagcuuuagcugacagugugcggcuaagagucuggaucugcucugggauaaagguuguugugguaauaugaguguuccugaaaucacugauuugcuccagugcuugucguguuggcaaagugucaauguccagaggggucaaaucaauugacgagguggaaaacuguuuaugggggcugucgucaucugugcacaagcuauuuacacgucuauggaggugcuccaggucaauuuccuugucauccuggagaugaagaaaaagaaaauaagguucucaucaguacuagcuuugaugguuaaaaaaaaaaaaguaguucagcaaacauguaauuaacugaacuuugggguuuauucauuuaacaaauauuuauugagcaccuaguaugagccaggcacugugcuaaguucugggggauuccaauucugagauaagauuaucuacaauaaauauuuuucuugcaguaaagguuuuaaagugaucauaugccacaugcaacuacaaagauauguaagcaguugaugggugauugccauucuauaaaagacagacccaggcaaaauuguaacaauagaaaguaugguuuuggcaacucuaccccccaccucuucuuuauacaugcuuccucccuuuucagggcgucucauuccaaguuaaauuuuuguuccuuucaaccacuuacuccuaaacuuaaguuuccauucuugaaaaaaaugauauaguaagcuauuucauacugaaguguuagugacuguuaaaguguuauuccuuguaagccaaggauaugugcgauuguuuagagagagcaauacucaacacaaaauaauuucuaauugagggauuuaugcacucaagguaucuagcaccugaaucagucaauacugugaggucagugagauauuuagggaccccuucaagucagggcacgugagugauagcuuuaguuuagggccagcuuuaugcuaacugaccucaaaaccaaagacguuuuaagcuaugcuaauggcgucuugguaagaaggcaguuaauaaacaaaaauauaaguaaaaucucagauuuuuggaauugaaacccauugauaaguuccuuauauuuuucacuaaaagugaguauuaacgcccaauauuugagaaauaaaacuggaaggaaauaaaauuauccuuguuauuagucuuauuuacagccaaacucaauaaauuaaauuuaugagaauuuaagauaucuauuaaucauaagaggagaaaauauuuuuucauaggaucuggauuagcugucacaaguuagaauggagcauguauuuuuuucauugugcuauuauaguguuccucagugaaaaauauuuugaugugcaucacuguuuuuccuucucccuucuuauuucaaaauucaauaaaaaauauccauuaaugcaauauuaucacugagacuuuagaggauugagacauauaauuuuaugguucccacagcaacuguaauguagucauccaucaacagauauaauaaugcaaaauuuuaauaucauauagaguaauucaaaauauaaggagcuuggggaguccuuacuuuccagauuuuuaaaaauaugagucucagcuauaauguugcauuaauguggucuuuugcauugaaucaaugucaacggagauaccagaagcuuauuccacaaagaaaacacuacaaugugacuugauuaauuuauaauucauucuucacauauuuagaauguaugcucauucacacagguaggaagcuaaaauucaucuuugcuaaagccaagcuuuuccuuauaaaugcugcugaucaauuuugcauauaaggugauaagaaggaauccuuacacuacuuuugaaaucacccuguuugaaaaaaacacauuaaugugcaacaauucauaugcaaaugagaagccguauuuauugugcauuaaaguagauccuuucaggaguugccucaggcaucaguuagucagccaaguucuaguuauagaaacuuuaaaaguuucuuugaagcuauccaucacauaaaauuguuuagcaaauucagauugguuuuuguuucaauuugugaagcuuuagugaauaugacuucaucaguuaaaacauuuucaccccuuuaguccaauggaaauaagauaaauuaaucaagauuuagcuucagauuuucuuuaauuuauaagucucauacuucuugaugaaaacaaugcucaggccacuauaaaagagauauguguaauucuguaauuauucuuucagauauugagauaaaauuuaauauggcccugaagugaagcugacuccacaguaaaggagaaacauugaaauuuggauguuuucaugauguggauuuuggauuugauaagcuuggggccaucgaagagcuucuauaggucuacaugaguagagaaggaggcagucacuaguggugaagagaaaauucugaucauuuuuauuacaguauuguauuuuuggggggcuagucuuagagauacgaggaauuuacuuacaaguuaaacaacuaagugaaacaaaaugguaaguaucucugugaacuggucaaaggaaucauggccuuuaaaaaucacugaauuaaaaucuauucugagauuugagagaauuucaaagcccauuaugguauaugaauuucuaagucuuucaaacacuauagucuccucuucacugaucuggggauauccuaaaauggaaauugauauugaucuuaccaauuuuuauauuucacaacuuuauuuuuaaucuucaagaaacgaaaaaacaaggaccacccccaacccauuauccucccugggaugguccucccuggaaauacagccugcuuguugauucaauuuagagccaaaucucucaaucaaguaccucuuuugauggaacccgggagccuuuccucuuguuccaccacgucuccagcauggcuaugaagcaggagaggacaauuccagcagccaggauacaaaagaccccugcaaagcucuuuauguccagggcgccuccuuucugcuuuguguccacugacgaguacaggucacacuggccauucuuaggccaccauuugugcuucaggauguccaugucaccauucugcugaagcuccaggauccuugggauaaagaacauaagcauguguuauuacagacauaguuaucgcccugguucacaacacauccauuuauaaucccaccucuguaggaugguggcugucaaagggaaaugaauauauagaucugcuuguuuuagauggaaugcuaggaaacagaaagucaucauugcuuugauucuacagacagcauugcaccacacugcuuuccucucucucuucacccaucccacccucccaucuuccucucuccuuuucuuccuauucuucuucuucugguuucauucuauaauucuaaauauuuuccuccugguuugcuucaguguguuuuuacaaucacaauucagaggcacuguuuuuauaugcuuucaaguuguuguaguucugugucccuuuccuacauccagaaugauacucaggaucuuaaugcuuuuaugaagaacguuuugcugcuuagagcaagaugcuggcguaaugucacccagcauaugcuacacacaaagaaauucaauuaagaagaccuauuauuuaacacagugugagaggaagccuugggauaaguuucaaguugauaaaauacaucuuuuuugguuuuucgcacaacugaucuaguuucccuuuuaaugccaaaggggaaguaaucuuaccuuggaaaacaagaagaaaaccugaccagaggcuuucagaaguaguuaaauucaaauaggaaaaacccucuucuuuuucuucugcugcuucuuuuuccccuccccagagucugaggguagcugcacacugcagcuuuuuaaaguguguuuuucauagaggaauuauucucaauucccagugcuucuuaggcucuaccugaggccagccuagauguggcccuccuccagcuaugcccuuuuucacagggcaaggaagaucagaccaaggcugugugccuguacagagugugcaucguccucuggguucccuggaauuuccuggccaaacagcuuagugcucuuccagggccugccaggccuauucccaggguuguccuccuggcagaagaucuuacagccacgggugcaccauagcucuauaggguggaguuuguagaguguggacagagcucagaugagugagcucggguguauacagccuugcguaggagacacuucagcgugcaaguuggagcugcagguggaaagaaagggccccagagcccugugcuccugggucaguucagaccuccuggcuagucacauagaaacuuaaaccuggccucccaggggucaugaagguauauuuguccagauaagaacauagaauauauuauaucaaacagguuuuaguuuaaugcauaauuuuuacauaauuagacuugggguaugugaaccuauauuuguacucuugcccaaggucuuggauuauuuggggugagacugcuuacaauuuaagaguucagagaauggaguuguagugaccuuuuuaccuguuucaugucauccacauggcuagaagaacaagcaacaugauaaagggaagaagauuuugugcauuggaaguugggucaguguuuaaucugaguuaaacuagagugagaccagcccuuaaggcucugguagaggguuggucucaggucccugucaucucucccagacguucccacagccucagcucuggugccccgugcuggcaguccaggacugagacuguucugaaaccucccccacaaccuggaccuuuucuccuugcuuccugugaaauguaucugucuagaguguugcucuagaagaguaauuaauuugauuaauugaauuuacuaaaaugauuaugaauauuaauggguuauaugucacccuuauuccagcuuccauuccagaaaaagccauuugcauuuccagaauuuccaaaagugcauuucacagcaaaccaguaccuacaagaccucuguaagaaaagggccuugugguuauuaauucugagaaacacacucuugggaauuuacaaagaugucagccuauuaaagacucucagaagaccagcagaaaagaaaacggcaugauuuuguuuaacucagcauuucccaaacuuaugaccuucauuccccuucucucauuuugcuuuccaaguaacagguuuaagaaauacacaugggaaauaaucucuugauccaaagaagcaacuacuuguagaaauuuccagcacuguguuaggcaacacacaaagauguaaucaugguaucaaaauuacuuuccuggccuauucaugaauaucauuuaaaugauguugguauugcucgucgauagguguaaagcuucaguuaugcaagagggaaaaguucuugaaaacuacuguacaacauuguaacuauaguuagcaauacuguauuguacauuaaaaauuuucauagaauagcacccauguuaagaauucuuaccauaauaauaaaaaauaauggcacaucccuuauguauuugcccaccuaaaggcucuagguagucagagcaccauugauuaccuuggaggaaaaauguagucaucuuugaacaaauaauucuuuuuaaauuugaguuuauaaguacuuguagauauaaaaggcaacuacagcaacauuugcuuaaugagaauacaucugggcacaaaaugagauccuguuauccugcucuccuauuugcaucacaccauauuggucaguagccuugugauacgguuuggcuccguguccccacacaaaucucaccuuguaauaaucuccacgugucaagugcaggacagguggagauaauugaaucaugggggugguuucccucaugccguucuugugauagugagucucacgagaucugaugguuuuauaaggggcuuccccuuugcucagcacucauucucucucccgcugccuugugaagaggugccuuccaccaugauuguaaguuuccugaggccuccccagccauggggaacugugagucaauuaaacuucuuucuuuauaaacuacccagucuuggguauuucuucauagcagugagagaacgaacuaauacacugugaaaguguaagaauuuuccuucauagcacuuaucaucauuuauaauuacuugaucagucuguuccauuuucgagaguguguacucauccuccauauugccuccuacagagcaggugcauauuuauugauggaauauacucaacacaguuuugguaaaugaauccuaaacucugauaucagauccuauucuuuuuucuuacgauugaugcuguuuucuaauuuauuccauuccuguuuuauucaucuauccauuuaauaaacaguugaagaaugacuucauuccagacauuuccuuggguacaaaauuuauucuaaaccacgacugcacauuccaccggagaggcuugagugacacugugaagccauuuuuuuaaugcccucaauucauguucauuuauuccuuccuucauucaggaacuuaauuacugccuacacuuucuucucagugguauuuggggcccuugcauuucauuuuauuuaauuuugucuccuuauucuuucuaaacuuggaaaauauuuugacuuuagaaaucauuauugaaauauauauauaugccucauauauauauauauauauauauauaauaccucaccuauuuaaauucuaauaggaauuaaaagccuuaaacccaaaaaaaaucauuuaauugcagaauuuuuagguucagccagcugagcgauaggagaucaucgaggggaaagaaggaagcacccucucuaggugcuucaaguacgaauaugccacaaaaaucucuuuguauuguuuauuuuaugcucacggcagcacaaguggcuggggcauugcagggagauuucaucuuuggggauguacagagaaauuggaccaucugaccccucagucaccccugacaacagauuccaggaauacaggcuggcaugggcuacaaguguuggaagggaaugaaaguguucucuaaguccagaguucugucauaacauuuugcuacaaaaucuaguguuccuggaaauuccaucagaauggucucacuauggccuccuuuuuaugauuuaacaaaaacccaauuuaaagauuauguaaagcaagugugguaaaauauaaugcacugccuggaagaugaauaggaugaauucuuauaauaagcaaagagauauguucccuucaaucuucccaaagcacuggcccuuuuaaauugaacuugaaaaucuaaagaauuguaccuuguaauuauaagcaacaauaauguguauguaugugugcgagugugugugugugcgcguauguaugacaaugcaaaaauugaguugcaaaauucuuaauaaacacaagaaaaacuuuugaguuuauggaacaauaauguucuguuuggcgugcaauuuccacaagauggcaguauuugcucauagagagcaaagaguuacugugguuauuguuaaucuaugggauugaagugcugaaguauagacuuuguggggcuguaaauacuuaaacuauuagaaauaaguuuagcuauuagacugugaugaacuaacggcuaaaaucucuuuuuggaguauagucagaaaaauuccugcuauuuuuacaccauggugaugcauaacaacacuuacuuuugagggucauuguggugugaauuaauaagaccacacgugacgaucucagugagcaagaugcaugaaaagcucauuaccuggcacgcggaaggcuauugcaacucuaaagcuagacuuauuauugucacauguaucacuauuguucuuucuuuggaccuguuccgguacauacuucuuaauggagaauuacaugcccauaugaucaaugaaugauugauucacugacacggacaucucauuuccuuuuuuucauccaaaauauuaaaacauuugugaucccauugaacagaaaaauuuuagaaguccauaaaacuuaauugcaauuugaaaauugcacugauuucuuuauugguauaaaugaggaaauuucaggggaagggaguagaggaaucaaaagauccuucuuucauauuaaaauuaaagaaauccaacagguuuaggcauucaucuugaagagccuuuuuagccucauuuguguuugagacucacacuaauuuuugaucccuuaccauuuuuagucacuacucuaggaaaugauuuucaaauuaauuuauuuguuacaaaacagguugcugaaaguuggacgcaaauuucuaaucccacauaggucacucugauuuuguccuuaaauaccaucgcugucaauaaguuccucucaaacuuuucuggaaucauggcccauaggugaauuccuacugaaccaaacuaaaaaaguuacugguuacugguuaccuaagaaaaaugacaccugccuuuuuagucauuucuacuaggaaauuagaaugggaaagguugcagacauuauugcuuccccgucuguuucuccucccccauuuuauggaugaagacgcuaaguaauccggcauaaugauucccuagauuuuucacauggaacacacaaucucacugcuguagaguuuaaaugacuuuuuaaguugcucacacagauaauaaauaguugaauugggcuuagaacucaggucugccuuccagcacauuucucuccauuaucucacacagcuucuaauauguaaguaugcagagaaaagcuaucuucuuuaguuucagagauuucuuaaacccugaguaaacgucucaucaauauguuuccucuaaaccaaacaauauaauuauagugugauagcaaauguauucaugcuacaauuuggguaugcagagaaaauguagcuuuucucuauaacuuaauugaucuuaggaggacugugccuacugagcaguggggaaaaaacuaaauuuagcccaauaugauuuaaaauuuaaucucaucuaauaauuuaacaugucucuagcuuuagcucaaucuacuugagagaauuacucaauucuucccauuucuucucuuuucccuuacucuuuuucaaaaugguaucaggauuuauggaggacagcauuauaucccugaaauuagggauuuaggggaaaggugguggcuggucucuugcagguccuugaauucgcuuuggcagcucuccuuugaggugggaugggcuuggguucaguuuuagagauuaauaggugacugcugcuaaagucugcaaaggcuauaggugcuaaaaguuggcuaauguagggcuuaugggcuccucccugcugacucagccuccuuugguuuguuggggugcucuacauccuucugagccucugccauuuucuuuauccagccccugaugauucuguagcccuccagaugguaugaugaccucaccuuguuauucacuguggaggggcccaaggcagguccauaugcucuaaccccgcaugcgaggcacaggaaagaaagggaggccugggaaugauuauugaaccugugcuuuuuccugacccugcugcucugcauucuuaaugaucugaggucuucucuguuguuaaagagccuggugugcccugggaacucccccagagacccuaaagggaagagaagcauuaggucuucuacccuuguugugccuuucaaucuaucuaaugucuucuugccuuucucuucuccugaccucuguuagaauccucuggucagaagaaguaaggcuuccuuuccucuccugaauauccuucuuacacccuaggucuucaagcuucuuguccugucauagugaaagauaauuauagcuauguaacgccagaaacucuaugauacaagaccuuuugguacuucuucaauuuggaaguauugaggcaauuuggggguagaaauucgugaggauaaaauaaccauuuuaauauuucaaaaauauuuuaucaguaccuacuuaugaguuuuauguaaccaaaauuaaaaagauauuuaggagagagucccauuacucaauacuguuuaaugucaguuaucacugagaaagaaauuuugaaauuucugaaaaaaaguuauuuuuuucacacacugaauaaaucuauuuuggcucauaauauccacauuauuaaauucauuuucuggguuuucacaaaauuuuccucuccaugguuacugagaaaguauuaauaauagcaugcagaugauuuucagaaaaaacuuuagcucaauagguuuuucauucauucaucaauuuuuucauccuagcuuuggaaaacguagguaaucuugcaucgaagcagaagcacuucucaaagauuaagauuuaaacaauuaagcauaguggcacuuugauuggcauaucuaauauuacaauuugcauaucagaguuguaaaaaucaauucuaucaacuuccugugaaucaaucaucaaucgauuauuuuucuuaagcaaaaucucuuagugaucaguugguaacauuaagugcaacaaauauuuauugauagcaucuaauaccucaguaauaucaaauaguguaagggaaacuauuaggagcuauuuccuuuguuuaaauugaacuuuuaacuauuucuucuagcuaguugagccaaauggcaguugcuuaauuucaauccaccaagaguuucuaucauauagguuaauaguacuucaugguauuucaaauaaauucauaacuaucaucuuuuagacuagaggucagcaagcuuuucuuguuaagggucagauagccaauauuuuagacuuuguggcccauaugguguccaucacaacuacucaacucugccuuuguagugugaaagcagccguagaaaguaaguaaacaagugggcuuuauuuguaaaaacaggcaagcugccagaaugaccuucuggcuauaguuucugacuuauuuuggaaaccucagagaaaauaacucuauaagccaauaaguucucauuucacugaugaagauauugaaguugagguggcuuaagugauauagcaaguccaaucauuggaaaguaugaguccguuuuagaaccagagauggugacuccuauuccagugcucuuucaauaguguauuaauauguauuaacauguaguaauaucuguuaugacaugugcaucuuuaaaugaguacagagugaucauguguugaguccacauuucaccacgcugagagagaauuucacauaugcacuguauaugaacaauggccacauaauccuucaagugaauuuugaauuucuuugguuuucugauuauauuguaaaauauaucugagcauuuauucugagauuggaagugcccauguuccaaaagaugacugccucacuuauucaagaugagguaguauuugucuucugaggguuguauuuccugaaucauuuucuaggcaaugggagcuugagccugaagucaaggcgauaugagcagauauuacacuccuaaaaaaagaaauuccagggaagugauuaugauuuacuaagaacggguaagacaaugaacugaggcagaaaagguugugucucuuuuaaucaaagauaugaaaaugguuuuuaauuaugugugaccagaaguacuguaaauuaauuaguaguuuuuuagaauugguaaagaauuacuacacaugcuuaaugagaaugacaguguguuaguacuggaccugggagaugggaucacauuuaacuccugccggugaggugaaguggucugcccagcuccccacugcagggcugaauacacaggcuggauuuaauuauaaacucaguuauugcugaaggcugcugcagagcagagaccuguuuaaaaagagaaguuuccuguguugcuucaaaccugauauguuacuuucaaauuugaaaaagguaauuugauaaaguacuuaaucggucagaucugguuuauucacaaaacaaugucuauguccuuauguaguuacuagugucuuccuaaggcauccauucuguguauggggaaaaagaaacaacugugaacuuuauucagaguaccuauuuuccaaaagaauagcaaaaauaaacacaugcaugaugcugcaguuuauaaaggccuuuucaaaacagugcauauuauuugauuuacuucuuaaccuugugagggaggaaugauauugauugacugauugaucacuucaaaccccuccucccuucgacccuguaccucuuacucuuguaacagccuuuaggaagucugauauuacuaauucuccuuuuacaggugaggagauugaggcucagaggugaagaaaaguuucccaaggccacauggcuggaaagugauacauucugcuuucaaacucaggucuucuggcuucugugcuuuuuuugaauacaccaucaagaucuuuauuaucucuaaagaaaaucuguauaaauggaagcaccucuuuauuuccugcuucuuuauaaacugagagucugcuacucaagucccuuggcuaacacguguuccacuguauccauuuacaaacauuacacuuuguaugacacaucuuuauguccccagagagccacaugaguaucucaugaguucauuaaucgcuuugugauuaaaggucagaugaauucauuaucauggggcacuuagggugcuuugccaauguuaucagaacaaggaaguguguucaaaauaaggaagugguguucuggaaccuuguccuuacuuaauguaagucaacacauugugaaguuuccaaucuguguuguguaggcuccuguaguuauuccaauuaacuuuuuucuuagaguuuaaacaauucuccauaaaagcuacacaauuaaauaacauuuaacuguuuugaaaagcacauuguuuaaucuuuaacauuuagaacaacauuuauguucaaauuuugaugaaauuuuuguuggcucuaagacccaucauaauuuauagacauguuauuugguagaaaaugaaccuuaaauuugaaauauauggugcccauucaaauugaucucucuagguuagagucaucuccuucaaccauaagucuugcacugccuaagggggcaaaaucagcccuguucgcggagaagcaauugcuuaaaaaaucaaauuagcaacaugacggaucucaagacuuuggugacuagugaacuuuaauuauuauauauuuuauguguuuaugcuggcaguaaaagucaagcacucauuacagaaauggcagacaugaucuuucauaaaaugaguacugggcggcaaaugaauagauaaucaggguaaugaaagcaagccagaaagaugcuagagagcugagaagacccagacaauggcucccacugagauagagggcauaauugcaauuggaaagagaacgcuuuuggugaucuuuuaaaaugucagcuucauccuuaagcucagugugauauuuggguuauaggguaaaggagaaaaaauauuucauucugcagugagaaacuggcaacgaucaucucuguuuagagucacucuucauuuuucuuaugcaaaacuuucaaaugcauguuuaugaaaaggugucauaaagucaaacuuauuuugcuuuguguauaguauauauguuaugcauuuauguauauuuucauauccuugagucugacaauuaaccuuuaaaauaagugagauccugaguuguaugcuauuuguaaaauggauaaagauugugauaugcagcuuugacauacucuuaggaaagagaagauuaagaaggauacuuuuugaagagacaaacauuuuccuuagcauuugcacaaauucuaaacuucuaaaaaguugaauaauaauuuaaauauaaggaaggaauucauuauucugagaacuacucuaguaggcuuuaauagcgggagaauuauuuuaugaugcaaacaacaucuaaguuagagguuguacacugauacauauuuuaaaaaacucagagcauauuuguauuacaguuuguggauaaauucagugcacauaauaaaaacucucagccaggagugaguuagaucaucaacaauaguacaacugugggaaaauaacauuacuguuuuacccacauuuucauagaugggaagucuaaacuauuuuuuuaaauuauauuuuaauuuuuagauguauuguauuuagcauuauuacagcucugaaaugaagugcuucaauuuucuuuuuuuaguagaguguuuagacaguaacauaaccuucucuugagguggccuagaaucacaggagaacaguuucucuucauuuuagacauuuuaaaaagugaauucuaccugcaaacuucuuuccaucaugaauccaaauacgcuaugagguuccuuuuucuuuuucuuucuuuuucuuuuuuuugagacggagucucgcccuguuucccaggcuagaguacaauggugcgaucucggcucacugcaaccucugucucccggauucaagcaauucuccugccucagccuuccaaguagcugggauuacaggcacccacuacuaugcccagauaacuuuugccuuuuuuaguagagaugggguuucaccacauuggccaggauugucuugaacuccugaccucagaugauucacccgccucugccucccaaagugcugggauuauaggcgugagccacugcaacuggcuaagguuuuauaaauggaggaaaaaaucccaaaacuguuccuuggauguuaaccuccaauuccaguacuggauaguuccacugcaggguggucacaugcccggaauggggcagcacaagagaaggcaccgugcaaaggucaccagaccuugguuuuagaaggauggucaguuuaggaacaacauuuuggaguaaguguugucuuagaugagaaauuaggaauuaguagaacaggugauggcauggagauugggaaaagaguacucuagguagaggaagcaguuugugcaaaaguccagcaggaagaaaguacaggcauucugaaaagacgaacggaguucccugagacugagcaugaauauggggagaaccagaaccacgcuggagaagcaaggccuguaaguuauuuaaggaguugagacuugaucuugaauuuagugguguuuuucuuucuuuuuuuuggauguuagccuccuugagggcagauacuaaacuaugcacuauuaauuuuguauuucuaaccucugacacauaauauccuuuaguaaauaugagugaauaagugaaugacaagagggcauucuuuucucaugcuucugugaagaacaucucucaggacucagauuccaucuccucugcaaaaauguuccugagaacugcccauuuaguauugaaccauacacugccuugagacgucucuguuuucacucugaauuauuauuuauauuugaugcauguuuuucuucugaugcacuucuuauauucucaaucaggcuaucaacuccuugaggacaggaaucuuaaaauauguauuucauccuauucauuacaccacaagcauugugacuuuccuucuguauucacucaauaaauauuuguuaacuugauuugucauggacguaaaaaacaaaagcacucaaucucauguuauuauggacugaauguuuaugccccuccaaaguuuauaugaugaagcgcuaagccccauuguaaugauauuuugagauggggccuuugggggguaauuaggguuagaugaagucaggagaauggggaccugauuugaagggaccagugcucuuaucagaagagacaccaucauguuugcucucucuuuacaugaagaagacguccugugagcacacagcaagauggcagcuucccuacaagccaagagaagaggcuucagaaugaaaucuaccuugcugaaaccuugcuugaucuugguccucuagccucaagaacugugagaaauaaauuuccauuguuuaagccacccagucuguggcauuuuguuuggaaagccugggcagacuaagaaacauagauugugaaauacgcagcacagcagcaaugucaugauugcagagugaugggugucacuuaggggccacuuucccuuuuagcacuuuuccaauuuuggaauguuccuucugacuuuccuccuucucccucugaaucauaucuggagugaaacuaaucuuagacccagaagcuuuagaauguaugcuucuucuucuccucguuaauaaguaagauguuuuuaaaaacuaggauacauauaaauguuauauccuucuuuuuaaaaauaucacuucauaauuugcaaagcauuucuauugucauuaugguguuucacuuuuuaccacacagucaauaaauuaaaacagguaaguaccaaauuuuauuauuuacuuuagcaagcaaauucuucauauacaagcuuucauuaacuuaacuccuguguugugaacauaauaaguuaauaaagauuaacuauguagacaaaaagcaagagagauuuaaacuacugaagaaacugaauuguuuucuagcacuucacauaugauaacuugauguggcaaaccugaucaacuacuuaaacugauuaugucauuauuuaacacaagaucuucaaaaacuuuguucuaaauggugauagcuagcuucacuuuaguugguagaagccgaucuucguuaaaauuguaacaucauuaaauguauagcauuuuauuuuuagguuaauauaaaacaucaccucuuugggcauauguuaacacuauuuccuuaguaggaauaaggauuccuuaaguacacauguaaauuuuaaauagacuaccuggauuccuaaguaguuucaggaauaaaucugauuaguaagcuagaaguguuagcuaucuuuuuuuaauaaggcagcaaacugaggugaucugacauaaauaguuauuuauaaaaaauuacauaaugugauacaaaguagcagugaggcucgucuaauuccgugcagaaaggauaauugauguguuacugcucuacuucacaauuuaguuuucccacgcaugggagauaugcugggaauuagucuauuccaucuucuuaaugagacuuaucuauuacuuuagauaauguaucuauuuucuucaaccagcagcaccaacugcuuauaggagugaaguucucagcaguuauucgaaagaaaauuuaccaauagauauaaaaggaauagccuaccuuucuaugugucuauguggcuagacaaaugaaaugguguggauacguugcuguuaugaaagggauguuacuugcaccauuccugugcaaguucaugagaacuacuugcuauuuuccaugauaauggcaagagcuacaugcacaacguuuacuuacuugaugauauuaugggaugcuucaauaacucagagaagaggcuugauaaaaacugaaugccauucaguccugauaacaauugucagagggaccaagaggcuggucucuuuauucagaaauaggucugguaauacuguaaauguguauguacaaaaugcaggcaguugcaaagcccucuauuucuccacuuuaccccaacccuugcauaaucagcuucucaaaucuguuuuaaaccuuuaugaauuagaaaugaaagcaacccagcuaaguaggcaucugaaauacuuauuauaggagcccuaaugaauaauuguagaagugcaauuuacccauguuugaauagccaguuauauuugucagcaacuaaauugcucagaguauugguaaauuguggugaaucuuuaccuuguauauggugguaagcaauacuggauacuacacucugucuauuuguuucuagaugagaacaaaaagguauaccguuugauaaaaguauacugauuuaaaacucaagcuauauagaucacugcaaauaauggcauuccauauauaacaaauggacauacugucauagaaagaagaguaacgugagaacagauccacuuuguagauauuauuacucuuauggucuuucuaugagaggcuacacucuaugagauaauaguugaugcauuuugaaguaauuuuucuguaguugugaugaaaaaagaggacuuguacugugacccaauauucccaguagugccugagcugcaacacacauuacagaaaauuacagucauguaccucauaaugacauuuuggucacugacagaccauauauauaagaguggucccauaagauuauaacaccaucuuuuuacuuuaucuuuuuauguuuaaauauguuuacauacauaaauacuuaccauugugcuacuauuacccacagucuucagugcagguuuguagacuagaagaaauacaccuauaccauauaaccuggguuucauaggcuauaccgucuagauuuguguaaguacacucugcgauguucauaaaacaaugaaaucaccuaacaaugcauuucucagaauguauccccaucacuaagugauccaugacuguauaaaaauugauuccaaauuccuuauggcauuaagcacuaaauuacagcucagugagucuugaugcuggcccaaagggcucucaagauuccccagggacuuucauauauuggcacuauucacgauagcaaagacuuggaaccaacccaaauguccaucaaugauagacuggauuaagaaaauguggcacauguacaccauggaauacuaugcagccauaaaaaggauaaguucauguccuuuguagggacauggaugaagcuggaaaccgucauucugagcaaacuaucgcaaggacagaaaaccaaacaccgcauguucucacucauaggugggaacugaacaaugaaaacacuuggacacaggguggggaacaucacacacuggggccugucaugggguagggggaggagggagggauagcacuagaagauauaccuaauacaaaugacgaguuaaugggugcagcacaccaacauggcacauguauaaauaaguaacaaaccugcacguugggcacaugugcccuagaacuuaaaguauaauaauaauaauaaaaagaauuuuucuaagaugcauaacaagauaagcugguacuggggagaacaucucagaguauggaagaaagagaagaguggacauuacaaccuaauguuacuaauccuagccugagaacuuuggguagaguucuuaagcuucuaaauaaauauuuuuuaaacauuuggauuccacuuucuuuuagcucugggugaaggcugccuguaggcauguagauaggagguguagcaaacagcauucaagaagaucauaucuaacaaucugaugguagggucaguuuagucucggcaucccucugagaaucagugauaacuauuuauuuucucucccuucuuguccuacccccaggccauucuuaucacuuccacuuaugauaagucaggguaugauccauauagaaaacuaacgguuccaaagacuccaaaagcauaacacugauauaccagguguugagugagcacaaaauaaauggacaauauggauuuuaccugcaaaacaaugugcaaguacacagauagauggaaggauacacauaauaaauaauuuaugaccaaagagaagucaaagaaugauaaugagguguggauaagguuuaggaaauuuuaagcagggaaaauaauuaaaggacugagauuuuuggaaaaggagaauguaauaguuaagaguaugaguauuggccaggcgcgguggcucaugccuguaaucccagcacuuugggaggccgaggugggcagaugaugaggucaggagaucgcgaccauccuggcuaacacagugaaacccugucucuacuaaacguacaaaauauuagccgggcgugguggcaggugccuguagucccagcuacucaggaggcugaggcaggagaagggugugaacccgggaggcggagcuugcagugagccaagauugcaccagggcacuccagccuggaugacagagcaagacugugucucaaaauaaauaaauaaauaaauaaauaaaagaacaguaugaguauuaguuaggaaaacgugggugaaauucuguuaucauuacuuccugacuauguacuggcaagauaacaugaucccucugagcuucaguuuuccuaaucccuggaauggaauauuuaucuuaaauuguauuguauaugcaaaguguucaccacauuaugugguauauauuaaguucuccauaccaggcagcuauuguuauaaucauuauaaagacuaaugugguacagccacaguaauacaguggaguccauuugcaauagguuuucaguuuuuccuuuuagaaccaaacauugacaugaacaauguauaaguccaaacacagugcugccuaaggucaagugcccauucugauacucuagccaaaaaaaaaaaaagaauguucaggugugcaauggccugaauguguccuccccaaaaucauagcaugcaguauugggaguauggguaagaaagcaggcaguuguggaaagccuaggaaaauaaggaggcggcaaggaaugacagcaugaagcuuuuaggagggcaagccggguuacaggccuugagaagacaguggggacagccucaauuucaguaucacccuuuagcacauucuuaaccguguuuucgcuaaccucucacugaccuggguuuaguuugagggacagaaugugauuuggggugaggacacuuucauuucaauacagcuagcucacucuccagaucuccugucaaguugagacagaggaugccacggaaggcccugucacuguacagcaaauucacagcugcacaggaagcaacacaguaaaucauuguccuucucaugaaggcugcaaucaauaaugccacaggagcauuuccccccaagaaccagaaacugccuggaacugugggagacccauugcaauacugagaauuugauguggaaaaaugagaggaauaaaagaguucacucaccaagaagaaaaacaggugaaaagcaacaccaauuaacuuuaauuauagagucucauucucacccuaggggaauucauauauucagaugccagcuacagaucaacaaagagcaaauggauagaucuguuguuauuuaugagaaucugacuccuagacuuuucaugagaucaaauuugaaauuuuauacuuggcaaaagaaacaagguuguuaacagacaugaagaauucacaauaguuaaugauccuauugucagugauauuaaaaauucacuuuuauugauaaugucagugcauuuucauuuauauaagcuucugggaauuuaagaagaaugacccuagccuagguauaaacuggccuuggaaauugcagugagagauauuguagcauaauggacccucaguuuaauucaccucuaguuaucccuguaaaacauguuacaacucuuccaacuuucuccacauuucccaaaccuugaacuguauuuucaccuguuugauucuuagcagaagauaauauuucauccuuauugagaagaucacuggcuaggaacuaacucaucucuuuuaagugacaccacucuuucuuccuucuauccuaacucuuauaaaaugugucucgaugccuggucaagaccaccuuuuuguuuuuuuugagacggagucuugugcugucacccagucuggaguguaguggcgcgaucccagcucacugcaagcucugccucccggguucacgccauucuccugccucagccucccgaguagcugagacuacaggggccugccaccaugcccugcuaauuuuuuguauuuuuaguagagaccggguuucacauggucuugaucuccugaccuugugauccacucaccuuggccucccaaagugcugggauuacagacgugagccaccgcgccuggccaagaccaccuuuuaacagaaagccuuuuauuuccaauuguacgugacuauucuagggauuuccuacugggugaucauuggaaucacuugaauuuccuuggcuacaagucagagauucuuauuuacuauuuuuggguuggugucugggaaucuauauuuuuaaacagcacuuucccaaggggauucugauacuaaagcagguuuggagaaaccacuaauugauccaucuuuugaacuuuccuuggaaguuuucuuauaauuuugugcuuuguuccaacacuaaaguaauguguuuuaucucuuugaaaggauuacaagcuccuuaggccagguaauggugucuuauagauuuuguguguucuguagcaccaacuacaguuguuugcacagaggaugcguucgaucaauuugcugaauaaaaagcaaagcucaagaaagggaacuauauaaugugugcucaccaauggcaguaguagucaugauaguuaacaugucucacauuuauugagcaccuaucucuucaccugcauuguucacucuguagcaauucaguuauauaauucucgaaaucacccugugagguaguuacugacuuuaucuccauuuuucuauauuuagaaacucaggcauaagggagugaaguaauuuguguuagcuuaaacaaccaaagacuuuuuuguuuuguuuuguuuuuggcuaagagauggagagcaaaaagcauugugaggguuucuuaaagaaucauuacuuagcucuguagagggggaugacgccacuuuggcaaaaguggucaaagaaagugucauagcggagguggcuauuugacuaaggcuuuauguuuauaacauguagagaguggguguaugagcauuucaggagagggcaugguaugaauagcauggugguagacuaacagccucgguuugccucucugguccuuugucagcuggaggaggcucaaugccacuuucucccuccuguauauguuugaaucaaagagugaaaaaggggcaaugaguggcaggccagcucuaugaagcacagaagcuaugauuguuuuccugucagucacugaacuuucacuuuccccuugaagagucaucccagcaacacuucugucuccuuccucaucaaugccuuauuuuguaaacaaucauuucccuauaucuugcaacuuuuauaaacugucuuuuaauucagucauuccucuaaaagcccuugugucauaaaggaaaugaggacauuuugaacaauaccuaagggcaaauuuaaacuaacaaaauaaaacaaaacuuacauguuuuuaaaaauccccuaaccucugcauauucucucuucuucuuucccgcaccucagccacccaugcaugcauuugcucacacacagugaaggaggaauaaagcagggauccccacccccacccacuuuugcuaacuuacuaaugcaaugaagaaaaucaucaagacaaagucaguaguuugagcugaggccaaaugaugugacuguaguggaagaauaccccuaccuaugcaaugguggcucugguuugcuuaacauuuauuacuugguaggaguucuugccaacuacaaugaauuauaaagauacaaugcauuugucacaaugaucuauguuuuucuuugggcuuguuccuuaacauaaaaaaaaaaagcaagaaaaguaauucaguacuccuccuugcuuuguccccuuauugucccugucaggcuucauaucaugccagaccuggcaagaaguagaauggaucauuuggcacacauuauuuuuuuggggagccuaaauuaaagaaaagaaaaaagauccauagggcauuuugaggagaguacgcaugauauguuacacacaugccuuuaaguaaaaucuugguuucgauuccuguaaucacuuagugccuucaggcguuuuucuuacuagaagaaauagcucuagacgccuguucaaagacaaguuucaacuaauuacaacuggccuuccuaaaacucuccaaggagucgucugagugaugcagagagguucuuguuccaaaauucuauuauuucaguuuguggagucuuaugaaucuuucugaaugaaaaacauucuauugauauuacugucuacugggguaacuuacccuuagaaaaaccaaagaaauuaacuguuggccauauuuauaauuuauuauaauguauauauaauucagauggaucauauauauaauucagauggaucauuugcaagguucuuagaugauggcuuacuugagauaucgacccauacagugucucucuguauaaugucucaacuuuguuagacuuccaaacaaauacucuuuucugugaaauuaugguuaauuuuauagcucauuuuuacuugauaguauauaaacuaugcuuugggucauaacacuuuuuauacuuauuaauuuucuaaauguuuaucgaauuuccuuaaguuguuagauguuauauauccaagggcauuuauuaaucuagaaaccaauauaaccaaauagucuucuuuuuuugaguagaagacauuuccucugcaaguugaaaaauaguacuuaucucauggugacgaugugagaacgaauaagaugucauaauuuuuugaaugucuuuaaaagaaaugauuucaaauaacagguaguauuuaauaaauuuuugacuugaaaaauuucuguccacugggggggaaaacaaaucaacauugauuuuucugucaaaucaacaaugacagaaaaaaaaaaccaaauugacauugauuuuuaguaugugauuuuacugaaugacuaaaaacauuuuacauauuauucccuacuugaacaauagauauguacaacaguuuuuguguauauaugauuagacuuuaugaaaagagugaaacuaagucaaggagugauuacugacuuuucacaaagugucccccauuacauaaaguucauuuaacaaauaaguauugaacaauuuuuacaugcaacuacaggcacugaaauggugcuagagagcaauaacaagcaaugggagauggucuuucucuccacaagcauacagugcagagggaacacuggcauuuguuagauaaucacacgaauguaacauuauggcugagauaagagcuacacaagagaguuaucuguagagucuauuagguauuugguucacucagaaaaauuuuagggaucagcagagauaaauguauuuuggaacggucuuucaacucuuuaaaaauuaauugccuucacaguugaacuaagcaaagcaguauggaagaaaaaagcuauuuauauacaaaggcauguuuuaaaaccuccagauaaauuaugugugguuuuaaauaauugcuuccaacuguguuucgguggaauaagaggacuuuggcuaaauauuucaaaagugucaugaucagaucuaaugacugucauggcacagauuuuuuuuugaaacacuaaaacauaaauuuugcuagauguagcuuuggaauacacccuugucuuauauaaaacacauacauaccaaaaagacaagagugaaaaaaauucucuaauccuucuguaaaaaaucugugacauuugccaaaacacuuauaucuauaaaaaagaguuaauuucuuagggaauuuucaagacaaucagaguggaccaauuagaauacucacaauagacauuaucaccagaaaaguuuauuuuaaucauuauacugagcaaauuaaauagccugacuauguaacaggaaaucucuuaaaagaauaugcuacuuugaaauauuguauugcaauauauuguauuucauugguuuaaauaauguucauaucaaacauaaaaauacgacuaccaaaaugcuuugagguuuucuuuuuuaacauuuuguacuuucuugcauuuugguaguccuacuaagaucaaauccaggaaugaaaacauguugcaaaaugauuguucuugagaaagacuguaauccaaauguaaaaucugaaguucaagaauuuguaggaaaaaacaaucuauauuggccuguauguguuggaagaauugaccauccugcuuugaaacuagugcuuaaccaaguuacuagaguaacccagcuaggguaccaugaaauaagauauaugaaauaaagcauucuuaugucauggcuucaugugacucugauuacaguagaacuacucauuaagagcaguuuuauuguauguauuguauuguauuaugguauuuacuuuuguagcuauuuccuaguacaaugauuagauaaaugguuacacaacacuuauuucuuaaugaauauuuagugacuuagccuuucuaccacaaaauaauuuuuaugacacaugaacuucaggauaccacuuguccuuuuaucuuucucaacuuaaaaauuaacuuuuagaauauaccaaagaccuauacacuuacaaggacaauuuuugguccuuugacacaaaaauaccuguugcucaugguuacacuaucugcaguacuucuauuuaccuugggguuucuuuuagagcucacagaaucagacaaucaagccccugcuaccuaacugggaucacuccaggaaauucacacauaaucauuguuuaauguuuuucuuuuccuuugcugaaagaguuaauuaacucugccugcagcacaaagucaaaauaaaacaaacaaacaaacaaaaaagaaauaaaauaaaauaugccauagcuaaaguaauugcauuuuucaucuuccuguuaauugaaaauauaauuguuuucauuuguaaacaguacauuuaauuggauaguuaaacuuggcuccauauuuagcuucugaguccuuacgaaagagaagcucacacuggcuucaacuauguuuugcauguuucaaaaucaaguacaaauguaaaaagagguucacuuucagagcuucauuaacugugguuuucacucauggaaguaucugcuauuaggauuaaggggccacucacugcccuuugguacucuuaucuccaaaaaaaaaagauuccucauccccacugacauaaacaaaaugucauauauuuuuauaaaugugcaucagccucugcuguguaaucuacuuuguuaaaccgaggaaauaagaauucuguagcuaagggauguauuaaauaaauagaaggcaacauuuuucucucauugaauugauuucuauucucucuuuuuuucuaagucugcugugauucaguaaaggaaauguaguucacauuguuuacaaggucagcaauuaacguucuugagaugaaauuuauuuuuuccccagaaaaccuacacuggaucgagcaguuggucaugaaaaaaauggugaugaugacagcaauaacaauuacagccauacaucagagauauugcagguucaguucaggaccacuguaauaaagcaagucauguuuuuguuuucccaguacauacaaaauuuauguuuacacuauaccacagucuauuaaaaauauaauagcauuauuccuaaaaaaguacauaccuuaauuaaaaauauuuuugcuaaaaaugcuaauaauaaucugagcuuucugugagucacaguuguuuugcuaguggagagucuugcccaagcauugacagcugguaacugaucagcagggugguugcugaaaguuggaguggcuguagccauucuugaaguaagauaacaaugaggguugcuguaucaauucuuauuccuuucacaaaagauuucucuauagcaugcaaagcuguuugauagcauuuuauccacaguagaaugucuuuugaaauggagucagcccucucaaacccugccucugucuuaucaacuaaauuuaugaaauauucaaaauccuuuguuauuucaacaguguucacagcaucuucaccaggaguagcuucuaucucaagaaaccacuuucuuugcucauccguucaaguuuuaucaugagauuucagcaauucagucacaucuucaggcuccgcuuccauucuauuucucuuucuauuuccaccacaucugcaguuacuuccuccaauaaagucuuaaacucccucaaaguuauccaugaggauuggaaucaacuuccucccaacucuuguugauguugauauuuuguccucuuuccaugaauccugaagauuaugguguauagaauggugacuccuuuccagaagguuuuucaauuuaguuugcccagauugucugucuaugguagcuacagccaaaauguauuucuuaaauaauaagacuuggaagucaaaacuacuccuugauucaugggccacagaauaaauguguuagcaggcacgaaaacaacauuaucuccuuguucauuacuauuagaguucgugggugaccaggugcauugccaaugagcaguaauauuuugaaaggaaucuuguuuucugagcagugucuccacauugggcuuaaaauguguuauaaaccaagcuauaaacagaugugcugucacccaggcuuuaucguuccauuuauagaguauaagcagaguagaagauuuggcauaauuauuaaggacuuuuggaaugguaaaugagcauugaaagucaccaaauguauucagccuuaacaagauaggcuguccuuugaagcucugaagucaagcauugacuucuacucucuagcuaugaaagugauagacagcaucuuccuccaauagagggcaauugcuauaguuuggauguuugucccuuccaaaucucaugcugaaacuugauucccauuagguggggccuaaugggaaauauuuguguuaucuugacagauuccucaugaauaaauuaaugcccuuccuuggggaugagugaguuauuacuuuauugauuccacaaaagcugguuauuaaaaagagucuggcacauucccucucucucuugcuuccucucucaccauggaauuucugcacacagcagcuccucuucaccuuccaccaugagaggaagcacccugaggcuuccaccagaugcccaaucuuccagcgagaagaaucaugaaccaaaaaaccuuuauucuuuauaaauuacucagucucagguauuucuuuauagcaaagcaaaacagacuaagacagcuguuucgucuacauugaaaaucuguuguuuaguguagccaccuucaucuauuaucuuggcuagaauuucuagagaacuugcuguagcuuccauguuagcacccguggcuuuacccugcacuuuuauguuauggagauggcuucuuuucuuuaacuuuaugaaccaaucucugauagcuuccacuuuucuucugcagcuuccucuuuucucucagccuccacagaguugaagagcauuaggaucuugcucuggguuaggcuuuggccuaagggaauauuauggcugguaugaucuucuauccagaccaauuaaacuuucuccauuuucaguaauaaggcuguuucacuuucuuaucauucauauguucacuggaguagcacuuuuaauuuccuucaagaacuuuuccuuugcauucacaacugggcuaacuggcacaagacaacuaacuuuuggccuaucucagcuuucaacaugccuuccucauuaauuauuucuaguuuucgauucaagagagagacauguguucaaaugaaagagacucuuuuuguuuuuucauuugaacacuuagaagcuauuguaggguuauuauuuagccaaauuucaauguugugucucagcaaacaggagggccagaggagaaggagagauaugaggggaaugguccgugaguggggcagucagaacccacauaacacuuauugacugagguugccaucuucucuggguucgguuuauugugccccaaaacaauuaugauaguaacaucaagaucacugaucacauaucagccuaacaaauacaauaauaaugaaaaagucugaacuauugcgagaauuauuaaaaugugaugcagagacacagugagcacaugcuuuuggaaaauggcucugauagacuugcaggguugacauaaaccuucaauuuguaaacacaauaaagcaaagugcaguaaaaccacauaugcuuguauuguagcuuacaauaaccgagcacaucuauggugcuauauucuauguuagguacuuuacacacaucguuuaauuucauccucagaauacucuaugagaguaauauaucagucucacagauggaaggacuaaggcucagaaaaguuaggaugcuuaauccaugaggacaaagcuuguagucuggcuuguugcuagugccuggaacagcacuuggcacuuauugggcauaacuacucauauuuauucauaggcuaaaugaaugaagaaauuaguguucaggguauauuugggggcaauuuaaggaagcugcuaagugaugacauugacaauaaaaauguagaugauugugaaucauaacuguaagaaaaaaaguuuaauuguauugauuaaaaaguaaaaucucacauuucccuugcucuauuucccaaaccuauuuccuagauuuggccauaguuagugguucaaugugugucuguuauacacccacacaugaacaaacacaccacaaacacuuuuuuuuuuuuuuuuuugagacagagucucacucuugucacccaggcuggagugcaauggcacuaucuuggcucacugcaagcucugccuccuggguucaagugauucuacugcuucagccucccaaguagcugggauuacaggcgugcaccaccaugcccagcuaauuuuuguauuuuuaguagugaugggguuucaccauguuagccaggcuggucucgaacuccugaccucaggaggcccgccucggccucccaaguuguugggauuacaggcgugagccacugugcucggccaacacuuuuaacauuucaucaaaaagaucauaaaacuguuguuuaauuugcuuguuaaaaauuuaagaauaaugugugccauggacaucuguuaaugccagcauuucauuauuuaacaacugccuaaguuuccacuguauaaaugugccaucauuuauuuagucuccuguugauaaaaaguugucuuuuuaguauaaacaaagcuaugauaaacauauuugcauguauaucuuucugcccuuguugaaguaugcuggcaggaaguaaaauuaucagguuaaaggguaaguauauuuuaaauguuaacacucauugccaucuuccuccaaaaagcuguagcaauuuacaugaggagcauuuaaaaaauacaggcuccugggucuguaucuugguccauugagucaaaaccuugguaaguagagucugagaauauauauauauauacauauauauauauauauauauauauauguauauauauauauaguuucucaggugaaaucaguuaguuaugggaaccacuaaucuugauuauucucuucuuugugggcaaaaugagauugagacaggaacugaaaccagccuuaauauauagaaguauuuuguugaaacuauguagucauuaaauuauuaucaaccagauaugaaaaauacucuuuauugcuuucaaauguauuaucuuaauucagcuccauaauacuccuugcagguaaguaggacagaagaggaaaaaaugaacugaagcucaaaaaaguuaagaucacuaaaaaaaaaaaaauaguagaaccaagacuggaauucaggccauugaaauuuaaauauccuugcccccccaaguagacuauacagagaggugaauuaucacuguauuguacuauccuauuagaaauauaugugugaugacuaugugagaaaugugguuuuagauuuuaagaaguaaguucaagcaucauuuuagguuaugucuuaugguucugaagaugaugagacaaccaguugacugacaggaacguaaguaacgcacauauguaucuauacacuuuaugucucaaaagaucugaggcuggcgcuacagcaacuccagcagccugguuagcacuuccugauuaacaucucuaaaagacuuucuuuaacguaagugauugagacaauagaaaugaccaaagaaaauagcuggucuagauggauuagagagcuaagucuaaccggauuguagaagauggguaagucaguucccaaaaacuacccaggguucugcguagcuuauuggaacgugagguugcugccaugagcucugaaauacagucauggguugcuuggcggagauauguucugagaaaugcaucacuaggcaauuuugucauugugugaacauuagagaguaaacuuaacacaaaccuagaugguauagacuacuacacacauaggcuauacaguguagccuauugcuccuaggcuacacacuuguacagcauguuacuauccugaauacucuaggcaauuauuuguguaucuaaauauauccaaacauagaaaagguucaguaaaaauacagcauuauaaucucaugggaccaccgucuucuauaugguccuuuguugacugaaaugucauuaugucaugcaugacuauuguuucuaaagccucaaucaaggguaacuuaaaauuugucuuucaagaaaauuccugccugaacaagaggcaggguggcauuuuuaugaagaugaauuuuauaggguuauugugacuauuaaauaaaacaguagauaugagacuggccuuuauuguuagcauugauaaagggccuagaauucaggaaaguaaucaggucaaccggaagcugaguucuaagcuugcauuaggcagaaaaugagaaaacuaguauuuguuaagcucuuggaauuuauuaggcaaauuucucuggaggauaaauguacugaaggaaguugguuaccaggugcucucaccuuagccggguggggugagagaaacggcaucauuuuuuggauaguggcaacuuuuccuucaaauuaggagucccuuaaaguaccuaauaucaagucagggacaggugagugauuagaccaaggacaauaugucuaaauaguuaucccuuuaaaaaugggauaaucccauguuuuuucuccccuuuaggaauuuuuauauccagugggccaauuugcagcuauaaguaacaugggcccugcaguuugaggaaggugaaagcaccugaaucuauguggcaugaugagggggugcaaaaacaaugauuuuuacauggaaauggcuucuuguaccacuaggcuauaguugaagaaauuguaccuaguuuguggcgggacccaaauuguuuauacagcuucuagaagacuauaaacacaguuuaaacauacuaguguguuaaaugcaaacauacagagugacaauagugucuuuuuuugaggaaacaccguagaaaauaaagaaaugguuuggccuuaaauaaaacugugaagaagcugaaguuucaccaacgcuuagcaaagaagcugugccccuucccucuucuaucauccccugaggucagucaguagcuccugacugacccagauucagaaucuacugauggcugcucucuuuuaggaaaauauacccauccuauaucuucaagcugaagaaucaauuaagugcuuuccagugggagucgauuuauuaaaacucuguuuuucucagucuuccuaucacauuccucuuccucucuccaguugaauguuagaguuacucagaccuggauagcaggggcuuuuauauucucuucuccuuuucuacucucuuucuaaauaauuccaucauaauaaucauauuauaauaaucuuucuaauaaucuaauaaucuguuaccuguccagauuacuucucuaagcaucaccugcucagugggaucuccauauuauguucucagguuaaauauauuugcucuccuucuccaagugugcacaucugcaaguuuuccuugucaccauaaauggagucuccuuccaccuagucacuuaauuuagagccccaaagucauccuucugacucccuauuauucuauuucuacauucuaucuaucauuaagucuauuaggcauuuauuaagucuuccccuaguuauauuuaaaaucuacccucuuguugcgccuccacagccauugcucugggucaagccacuaucaguuccagccuggauaaucauguuagucuuuuaugugguuaacagauuccacuaucucugucuccaauuuguucuguguacaaaacccugagcucuccuuacaaaacuaaaucggaucaugucacuuccaugcucauaacccuuauauggauuccuacugcacuugcuaaaaaauauaaaguccuugauaugacgaacaaauuuguaccaucuuaccucuuuccuacuacugcaguccaggagucucucuaauuacacuaaccuaaaggcuuggguuugccaaucucuuccagguuuaacacaugcuauuuccucugucuagaauagcuuuucucuucucuuuaccuggcuaauauuuauuaauccuucaggucucagcucuggacuacucugaaaacuuucaccuggaauuaacauauuccaauccguucauaucuuggccaaagcaagucauauggccacaccugaauuuaacaggacugggaaauauaaucuuccaucauggauaugaacuaauuauugaugaauaguuuuacagucuacaacaauuagcuugcaauaagacaauaaagaugagugaauauguuaaguuucuuugcuuuggguuggaauuuuaucaauuaggugugagcacacuagugguuucaugcugauaagaaacuugacuauaucuguauauaggauuucaaugaaaaugggaguuaaauuaaguauuacuacauaaacucaauuuucuugagagauggaaucuuucgauaugagggucaaugugggaaacaagugucuuugcagggggaaauguacuauuuacugaccuaaauaaucugaaauauuuaauuaauguuugaaaugcuaacagacacucauuuuauuuuauuuuuuaauuuuuuauagagacagggucuugcuauguugucuaugcuugucuggaacuccuugccucaagugacccuccugucucauccuccccaaaugcuggaacuacaggugugaguaaugaugccuagcugaaacccaaacauuuaaaauguagccuucuagugauaauguccucuguauuuuguuuaagucaaaucuagugguggagauuugagguguagaagguaggaucaugacaaucuacuuuauccucuuucucucucucaaagauguucaauuucacgaaaucuuugauaucuuaaaguuauuugcagaaauuugcagacagagauaacguguugugaaauacccauuuuacuugaaaauauaauuauagucaugauauugucaauaaaaaggaaaggaacuaacacucuuugagcuuuuacuauggcaucauauguaaauucuccaagcaacuccaagaaacuacauuauuaguuccauuuuacaacuaaaaaucauuagcugcugagagauuaagaaugugccuaaggauacaaagauaguacaugguaaggugagaaugaaaccucaaauuugucugucuccaaagcucaacguguuaccucaaugauggugaucuggagacccuuucaagucccuuaaaucaaaggucauccacaaccucagguuuugggcucauugauggauuuuuuuuuuuuuuuuuuugagcaagucuguaagguaacaaccuguaggauuaccauaaauacaaaaaaaaauuggagccaugccuuuacuucaggcuuuucucuuagauuuaaugccaauauccuaaacuacuaaaaaaaaucaaauauuccuucuaaaauaauaauggaucacuaucgcuucuaaaauaauaauugacuuauuauuaguaauuauuaaugaauagcaaaccauuauuauuuuagaagccccaauagacuaucugaaauauugagugacuaccaauacaacuuaaaagagccgaauauagguacaucaaccugacaauguaagcaggcuuaccuucugcuaaauagcacauugaggcagcaugguuaauggguauuaaggcauagucucagaagccagaaugcuugauuuaaaguuugacuauauuauuguuagcuauguagcuuuggacaaacaacuucuauuugguccaauuucuugucuuguaagauuggauaauaauagaaugcaucuccugggguuguuacaaguaugauaugaauuaaaauuuguaggaugcuuagaggagugccuagcagcagaguaagugcuauagugggucuuaaaauauaaggacauuucuauuaagucauauucacugauuucuucauuauuuauuaucuuugugugcuaaucaucaucaucauguauaacuuuggccaaaauagggaaucucagaaaucucuuaggaagggaauuuuuguguuuaauaaacuuagaauuuuccaguagacagacaaugccuuucaccuuuuuuguuguucguuuugaacagaaauacagucuugguacuuagauuauacuaaauuacaaagugacuuuuccuccuuuccucuuucccaguauccucuuucucauucuuuucugaguuaguucucuccauaguacacugaauuaguuucccugcauaguacacagaaugcuaggcauaugucaguugaugucaucaugaagaacagcaauaacaacaucaacaauaacaaaacagaaaaagaaaaauuuccugcuucucaauacuuaccugagaaaacaauaacacauuucaggauuucacuaagguggucauguaggcuggccaacccugaacuuguuuccacuaaaugaguuaauacagaagaaaacauuauuuuauugacuagccaaugucaacauugcccuaaagaaaacgugcucacauuuucuaagggaaccuaucauuuaaugccugaaauuauaauuugagcugggaacauuuccaucauuuuuguaaagaaccagaguuacauugaucaauguagguaaaauuacacuucuuaaagaggcaauaucaguuuuucuauauaauauggaggcuuagauagaaaaugaaagaacuuaaagaguuggugauuuuuuuuuauuccaauggaagauuuggccuuugaaagaaaaaaauaaaauuacauguggaaaaugaauuguugguuguauacauaaaacuuucuuuagguuguauacaguacagaagguagggguaaugacaaaaaagaaaaaguccuuuuugaauaaccaaggccuaugaccacugggacacauuggaugaacacaguggcuccuuuguguagucaaauguguacuuagagaaauaaugacuuuuuacugauuccauuuguuuaguuauagaacaacauuuuuucucccuuuggucuuuuuuacuuaacaauuucucauucagcaucucacugagccaacagcccuggguuuugauuucacaauguuugcuugcaauuugacgaugcaucuuggucucaagaugacaggcaagaacauuucaugaacucagacuuuauuaguauuaauauuuccaaaaguuacauuuacacaaugcauauugcacuuggaugacuacacuucaaaaugaauuugcagcaaagacuuauuuauuaauguuuaauguugcuuuuguuaccccaugaaauauuuuauuaaaagcuucaaauuuauucugguuccuucuaaaggaugaaaguuugugugccagggcaaaaauuaauggcgugcaauguucccuuuugaaacuuucucuaaaauuugccuuaaaaaauuuuaaauaaacuuuuucuguagaccauccuggcauuuuuauuuguugcuguuguuuuccuaccaaccucauacacucccaccacuaagauaaguaauaucaggccacagucuguugucugggcugucggugauagaauucuccaaguucauucuucugcaugaacuuggugaacuaguucaaaagggaaacaucauuuuuugauaugcuaacagacacucauuuuauuuuuaauuuaauuuuauguugggaaagauggauuuuugugguggugauuuuauguauguuaugaaauuuuguaacuuuugauuucaauaagggaaaccaaacauucacuacugacaaucuugcagucaacaguucaacuuguuuuaucuuaccagauugcaaauaauuuuacgcucuuauaaaaaugacuuauaaaauggaugagcaaaucagaaagaugagccuaaucucaugacuacuuauucuaaggaaaaggagagagugagaauuaggaaugauggggaagaaaaaauggggggaaaauauuccuggagaauuuaguuucuucuaauuacagagcuggguguuuucauauguauuaagccaacuauuguucucagcuauccucugagggagaacuuuuaucauucugguuuuacaaauaaaugcuuugacauuaagugaguuugaguaacuugcccaguuuaccagcagaaagaagcagaguuucaaugcaaaucuaaggaggucuuaacuauaaagccuauccaccaugauuaaaggaccuuuauagagaaaggauacauuuaagaagaguuuuaaaaaagcagguuuugggcaagguaaaaaucaaauuguaauuaagguuaauaaaauagcuuugcugcuugcucuguggccuggggcauuccuacucuuaggucuguccuacauagaccauuuaguucugaaaaccuuagagggagagaauuauuuacauuuaugaaauguaccuaauauuagugucauuagcaucaacagauccugcagauuuggaaaucugacacugaguucuaaucugugguuacuuuuugaucacgauugauauuugaaagcaaauugggggaaaacaaaacaaaacaaaacucaagcacugaaauguuugggauuugaggaagucucuuuccuuggguagguauuuauagacagguagguagguagacagacagagugacauauggauggagauagagaacucuaucugaaugccuauuauuuccauucagacagauacaucauuuuaacaagaaguuaauguggaaaacauccuccuuuguuuuaacaggcaggccauuucagaagcaggcacuuggagaaaauuucuauguuagaaacuaguuuugaucuacuuuguaaauaaggaagccagagcacuuuugagugucuaagagcagagcucagacaggaauuucuguugugaaccugugugaggcaggcugaaaaguccauaugcuaauucuccuaugggguuuuuucaaggauauauaaaagcacaugaaagucucagacagaaaagaagauauaucaguguguacauauagcugcauuucccacaagugaccaauugcucagagacaauucauaugaaaccuaaaauaagcauuuuagaaagccucccuaauuugaugguagggugaaguaacagcaauaaaaauuaucaaauucuuaagaagcaauagcugcauugacuucaguuguaaaaacaauacaaauauguuguuaaugcugcuaagccaucaguaucauuuccuacuuuagugccaugcuuucaaauaaucuuucucuuuuauuauuuguaguuucucuucuuuuuuuuuuuuuauuuuuuaaagugaccccacauaugcacaacaaagcaaauguuugcuugggauguguuguuuucuuagaauuauuauggagagaagguaaggaaaggacauuuguacuaaagcaaugugagaagcugccuuuuucaaaagcauuuuuguaaugugaccauuagcugcugauggaguugccaugguuauaagagguccacugugggagaaaucuucauuuauuaucagauuuugacagcagcggucagaaugcuugaugggggaagaaaacauaagaacaacauaaaagagccucagccauuuuaaccacacaaagaguugaguuauaacauuaaaaaaaauucaacaauaaagucauggaugaguugagugccaagaaaaaucuugcuuuugaaauaaaauauauuccuguaaacagcagaggcagaaaaugauagucuacuaaagaaacaggagagaaauggcagcaggcauaaaccugcugaguuguauaugauuaaauuauuuuauguaauacuuuacauugauugugcaugcauucuaugcuuucuuucaaaugcaaaaaucugggugauuuaagcuacaacuuaaagaguuacugagcuucaugugucucuuguggcauuuuaguacuaggaaaagccuuuguacuagguguaccugaaagcccuggaaauauuauugucacauaaaaaguauaauaaauccucuuacauaggccucacuaugcuauggauucacauccuccauggaaaaucuaugauaugcauguuagcuuucuccuauggucucaguacuguaaugggauucugauggggguuuuauguuuuugccucuuuagaauagcugcugauuuuucuugaugcuucagucuuuacagaggaaccacggucuguccuuaguuucaaaaauauuaauguguaauaaauuauguaaauuuauuucugguugagucaggagaagagauccuauccuugcuggauucugugcgaagacgggucugugauguuucucagucugcugaacagaagcaaaacuuggcuuacagaaacagagagcaacagggaugaggacugucaaggcccaggcuuucuggggauaaaagcugacagauguacagaaagagggcuaguagugguggaaagugucuagucuuuuagagaggagaagagauaagugagggauccugaaggaaagccugcccaucuggaaugagucugcauaccacaagcucuguggugacaucagaguccucugcgugacucagcugucacugacucugcuuagaaggcuucaccccagguccuggggcuuuuucucuucccugccuugcuguagucuccaucuucucuaaaacaauguacucaguuagcuuuuaaaaccauacuaaugauuuuauugugguuuaagggcauucaggggacaaauuccuuacaaaucagaugacagcuguacagucucauguaucuucaucagcugcacacacguucucauugucaccaacaucuucauagacuaguggaugauuccuguccgcucucccuugccuuccauuugcugauaaccuauugcgcucuaauuuucauugucuuugcuccacugaaucuacucucccaaggucacuaacaacucaguugucgacugcaacagaugauuuucagucaugaccuucuuggccucuguucucuuagucucaguggugccccugcgccucaaccugcuccuguggguucucauuuauggagcacugcauauaugccaagaauuuagcaaaguuuuuuuacaaaucacgagguaggcauagaucaggacauugagauuuagagaguucaaguaacuuacugagcagucugcuuccuggccaaaaaccugugagugauuuucagggccaacuauagucagugacgaaagcuuugcccagcaggugucacggggaaacugcccuccccacgccgggcuuggugugcagccagcgcggcacaguuucuaaagggaguugcagucaaggccucaggccucccuggcagaccauaguuuaugcauauuugcauuccuacccccagugccaucauucagagcucucuuuguuuggagccuuuggcaggggccaccuucaggugccucugcugaaaccaccuuacagggaagaaagggaaaaacuugacauuugucccuacucugacucaguacucaguacuuuuccacuccuggcucuuuuccguuguuuucuugucaacccccugcccugcuuaagccuuuuguuuggggcucccucagcaauaagaugaccccaauaucugugcugaucuaccucaucuugaccaaugugaucuuccaugggcaagugcaaugggauuggggggagccaaugcucucuuggcucuccaguucagccuguugauuacacuacugcaggaagagauuaaaggcuugauugucgcuuuuauuuuuuggcuuguuguuuuaaucagcugcucugagaccuggcagcuuagcugucuccagcacagcugagcuccacacuuaccuaguucacaccauaugaccuggagaugggauuaaaagucagugugacuaaaacaaucugaguucuuaacuacuaucuaggcugcacucauauuuucugaggaaguuuucugaauuguuuccaugagaucuacaucccuuguuugucuucagucuucugcaauuuuacucuuccuaagagauuuauucucuccuaugaauuucacuaccacuuguaaccugaugacucuucaaucuuuauugccaucccuaaucucucuuucgcacucagaaugauaauuccaguggucuacuaaauauaucugcuuggaugguccagaggcaacuuauuuauguauucaugcauucauucauucacucauucaucauucauauacuuaauauauuuauugaguauugccuaaugugccaggcucuguauuaggcccuagagacacagggaugaaaagaaagcacagucucucugcuguccuggaaauugcauguccacaauuucagagauagaugcugaagcugaaccauuuaauuauacaugcauugggugccauaaaucaaagugcagaguguuacgcaguaaguacaaaagaagcuccuaacuuagcuuugguguuucagaaaaugauucucugugccgggcaugguggcucaugccuauaaacuccaucucuacuaaaaauauaaaaauuagcugggugugguggugggcaccuguaauccuagcuacucgggaggcugagggaggagaaucgcuugaaccuaggagguggagauugcagugagccaagaucgugccacugcacuccagccugugcaacaaagugagacuccaucucaaaaaaaaaaagaaaaugauuaucuguauuaucugaggaagugguauuagcagaguuagcaagaaaggggaggggaggaagaaagagugucacagguagcagaaauaguauugaagaagacauacgacacuguuggaguauagaggugguguuauuccaguaauaccuggaaauccagagauuuuauuucuuuucuaaacuguaaucugaauuuagagguuuuucagucuugucucauccuggaucuccugucuguagauugaaauuuacuagaacuugauauuuuauucagcggauccauaaguggcuugcugacuaaaugcacucuucuuuagcucccagauauucuuauuaaaaacucuggaacgggccgggcaugguggcucacaugaauaaucccagcacuuugggaggccaaggugggcggaucaugaggucaggaguucaagaucagccugaccaacauaguuaaaccucaucucaggccuggaagaaacugcaucaacuaacgagcaaaauaaccagcugacaucauaauguuaggaucaaauucacacauaaugauauuaacuuugaauguaaaugggcuaaaugcuccaauuaaaagacacagacuggcaaacuggaaaaagagucaauacccaucaguguguuguauucagcaaacccaucucacaugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaagagcuaccuauccuaaauauauaugcacccaauacacgagcacccagauucauaaagcaaguccuuagugaccuacaaagagacuuagacuccaacacaauaauaaugggagacuuuaacaccccacugucaacauuagacagaaaaacaagacagaaaguuaacaaggauacccaggaauugaacucagcucugcaccaagcagaccuaauagacaucuacagaacucuccaccccaaaucaacagaauauacauuuuuuucagcaccacaccacaccuauuccaaaauugaccacauaguuggaaguaaagcacuccucagcaaauauaaaagaacagaaauuauaacaaacugucucucagaccacagagcaaucaaacuagaacucaggauuaagaaacucacucaaaauugcucaaguacauggaaacugaacaaccugcuucugaaugacuacuggguacauaaugaaacgaaggcagaaauaaagauguucuuggaaaccaacgagaacaaagacaccacauaccagaaucucugggacacauuuaaagcaguguguagagggaaauuuauagcacuaaaugcccacaagagaaagcaggaaagaucuaaaauugacacccuaacaucacaauuaaaagaacuagaaaagcaagagaaaacacauucaaaagcuagcagaaggcaagaaauaacuaagaucagagcagaacugaaggacauagagacacaaaaaacccuucaaaaaauuaaugaauccagaagcugguuuuuugaaaggaucaacaaaauugauagacugcuagcaagacuaauaaagaagaaaagagagaagaaucaaauagaugcaauaaaaaaugauaaaggggauaucaucaccgauccccagaaauacaaacuaccaucagagaauacuacaaacaccucuaugugaauaaacuagaaaaucuagaagaaauggauaaauuccucaacacauacacucucccaagacuaaaccaggaagaaguugaaucucugaauagaccaguaacaggaucugaaaucgaggcaauaaucaauagcuuuccaaccaaaaaaaguccaggaccagauggauucacagccgaauucuaccagaaguacaaggaggaacugguaccacuccuucugaaacuauuccaaucaauagaaaaagagggaauccuccguaacucauuuuaugaggccagcaucauccugauaccaaagccuggcagagacacaaccaaaaaagagaauuuuagaccaauauccucgaugaacauugaugcaaaaauccucaauaaaauacuggcaaaccgaauccagcagcacaucaaaaagcuuauccaccaugaucaagugggcuucaucccugggaugcaaggcugguucaacauacgcaaaucaauaaauguaauccagcauauaaacagaaccaaaaacaaaaaccacaugauuaucuuaauagaugcagaaaaggccuuugacaaaauucaacaacccuucaugcuaaaaacucucaauaaauuagguauugaugggacguaucucaaaauaauaagagcuaucuaugacaaacccacagccaauaucauacugaaugggcaaaaacuggaagcguuaccuuugaaaacuggcacaagucagggaugcccucucucgccacuccuauucaacauaguguuggaaguucuggccagggcaaucaggcaggagaaggaaauaagggguauucacuuaggaaaagaggaagucaaauugucccuguuugcagaugacaugauuguauaucuagagaaccccaucgucucagcccaaaaucuccuuaagcugauaagcaauuucagcaaagucucaggauacaaaaucaauguacaaaaaucacaagcauucuuauacaccaauaacagacaaacagagagccaaaucaugagugaacucccauucacaauugcuucaaagagaauaaaauaccuaggaauucaacuuacaagagaugugaaggaccucuucaaggagaacuacaaaccacugcucaaugagauaaaagaggauacaaacaaauggaagaacauuccaugcucauggguaggaagaaucaauaucgugaaaauggccauacugcccaagguaauuuauagauucaaugcuauccccaucaagcuaccaaugacuuucuacacagaauuggaaaaaacuacuuuaagguucacauggaaccaaaaaagagccugcauugccaagucaauccuaagccaaaagaacaaagcuggaggcaucaugcuaccugacuucaaacuauacuacaaggcuacaguaaccaaaacagcaugguacugguaccaaaacagagauauagaccaauggaacagaacagagcccucagaaauaaugccgcauaucuacaacuaucugaucuuugacaaaccugacaaaaacaaccaaugggggaaggaugcccuauuuaauaaauggugcugggaaaacuggcuagccauauguagaaaguuaaaacuguaucccuuccuuacaccuuauacaaaaauuaauucagguuggauuaaagacuuacauguuagaccuaaaaccauaaaaacccuagaagaaaaccuaggcaauaccauucaggacauaggcaugggcaaggacuucauaucuaaaacaccaaaagcaauggcaaccaaagccaaagauugacaaaugggaucuaauuaaacuaaagagcuucugcacagcaaaagaaacuaccaucagagugaacaggcaaccuacagaaugggagaaaauuuuugcaaccuaaucaucugacaaagggcuaauauccagaaucuacaaugaacucaaacaaauuuacaagaaaaaaacaaacaaccccaucaacaagugggcgaaggacaugaacagacacuucucaaaagaagacauuuaugcagucaaaagacacaugaaaaaaugcucaucaucacuggccaucagagaaaugcaaaucaaaaccacaaugagauaccaucucacaccaguuagaauggugaucauuaaaaagucagggaacaaaggugcuggagaggauguggagaaauaggaacacuuuuacacuguuggugggacugucaacuaguucaaccauuguggaagucaguguggcgauuccucagggaucuagaacuagaaauaccauuugacccagccaucccauuacuggguauauacccaaaggauuauaaaucaugcugcuauaaagacacaugcacauguauguuuauugcggcacuguucacaauagcaaagacuuggaaccaacccaaauguccaacaaggauggacuggauuaagaaaauguggcacauauacaccauggaauacuaugcagccauaaaaaaugaugaguucauguucuuugaagggacauggaugaaacuggaaaccaucauucucagcaaacuaucgcaaggacagaaaaccaaacaccgcauguucucacucacaggugggaauugaacaaugagaacacauggacacaggaaggggaacaucacacaccagggacuguuguuugguggggggaggggugagugauagcauuaggagauauaccuaauguaaaugaugaguuaaugggugcagcacaccaacauggcacauguauacauauguaacaaaccugcacauugugcacauguacccuaaaacuuaaaguauaauaauaauaaaauuaaaaauaaaacucaucucuacuaaaaaaaauacaaaaauuagcugggcaugguggugcacaccuauaaucccagcuacucgggaggcugaggcaggagaaucccuugaacccaggagguggagguugcagugagcugagaucaugccgcugcacuccagcuugggcgacagagugagacuuugucucaaaacaacaacaacaaaaauaagcucuggaacauggugcagugaggaccucucucuccccuacuggacaacuaguaggggacaccaucaacugucccuccucuucucuccccacucauuccucucucggucucuuauuuucucccuuuaaucaccuucauaugggcacucauguagcgucucuuuucguaauuacaaggcuuugauuaaaggaucaacagguaacccaaugaaggacauagagaagagaaauuacauguaauuugguaauguuuuuaugacuuccuaauaguauauuccacgaguuagcugcauauuuuuuaaaaaauuaauaaaauauuacauaccuacaaaagaauaugugugacacauauuuaaguuaaaagcauaauaaguaacuaccuaugaagauacgaugcaacauaaaauuauaggccaugaaauuaugaccuuagcucuguaaaggagguuggcugccuagucuaucuuccuucccauugcaaggauugucucuacuccaccucaggaagaugacaaucccgcaugcgcuugaacauuuuaccuagcagucauggcucccuggaaauagcaugguggguuuaaaaucaggaguauuuguccuuuuugaauauuacagaaguuugaggaaaaagugaaucuggaugguagccaaacuucuguaggacucauuucgugucuuuuaaauauguuuaaugucuucaucauucacauuucaacaguaacucauuuuauugccugaaaccacccucgucaaggaggaucauucuaauggaaagaauguuuguauguugacagagagccuuggaaguggugauaguauguucguuagaauggacucucccuuuaaagaaacaaaucaaaucagauauugugaagaauguagucugccuuuaauugguuaccaguuuguuauuuuacuaaauaauagaauaaaaaucgagaagauucuguaauauaugauucccagaagacaggguuuaugucuuacucaacuaagaaggcuugguuaccucaaagugagauugaugcacagagggcagguaauaaauuauuugcuauuacaucgauccauuagucaaacuacugaauuuacucaaauuauacauauugaugguaucuuuauauccccugggggaaauaguaaguucauaaaagccauugaaaaauuaucuuaaauagaauuaaaaguucauaaaagccauugaaaaaauuauauugcauagaauuaagugacaugagcugcaccuggugcaaguauauggucacuauggucaguccaagcugguuguguguagcuaacaucaauucugauugguccauacccuaaucuccuggucugggcccauuuuuauugaucugugcuuucauucugauuugccugugucuguaaaaugcagcuguuuaauauuugcaauauaauucuugguuucaccauuuauguauuuaauauguaauuuauucauuuauuucucaaaaauuauuaaguauuucccaugugauauuuugguaauacuaauauucuuaaaugauggccccugcucaagaguuacucacaugguaaugacugaccguaauagcauaggaugaaugaaguucuaucagcaacagguauaaaacacuauggaaaaacacaugauucauucugguaggggcuaaguggaggauggcuuggucuuugaauaauguguugaagcuuacccuauccaauugaugaaagucauaucagacaaagagaaaaucauaaaaacaguaaguagauguaaauauguuuaagaaacaccacuuaccacuguacccagaacacagagaaguuggagugggauaaccuggggugguuacaugguuuucaguaucuguuuggaagaaguuuagaauuuucucugaaggcaaugaagagacauugaaaacuuuuuaguaggggaaacaaauagaucuaugcauuagaaagauagguauggcugcuuuguuuguaaagguauucaauucuccagaauaaggaacuaguguaugauaaaauaugaggcagagaugaugaguaccuuagguuauaacaguggagauggagagcaggagacagagcugcaaguccguccagagagaacucucaggaagugauccauaaauauggguggugagaaagugggaggccaaggccaacuggcaguuuucaguuugagugauuggguggauuguaaaaccauuaauauagaugaagaaucuaggagauaguuucuuuuuuggggggacacaaagauuagaaggugugaagaguaugaacuugauucuagauauguguuugaagugacacugauguguugauuagugauaaggccauauuuauuagaaauaacauagaauauguuucugaguuuagaaauuuguguuaaaguuccugguccguaacucacuagugauaugauucugaauaauuuccuugauucucucaucuguaauucaugaguaauaacuagcauauaaccuuggggugggguuaaaugugauaagguauaaaguauauaguaaauaaauaacuaguacuuaguauaauauuaacaacuuauuggccgggcgugguggcucaugccuguaauccuagcacuuugguaggcugaggcagguagaucacuuucaggaguuugaaaccagccuggccaacauggugaaaccccaucucuacuaaaaauacaaaauauuagcccggcguggugguggaugccuguaaucccagcugcuugggagacugagaaaggagaauagcuugaaccugggaaguggagguugcagugagcugagaucaugccauugcacuccagccugggcggcagagcaagauuccgucucaaaaaaaaaaaaaaaagaaaaaagaaauuauuuucuccucuuuuucuugauuucaaguuucuucaacuauagaauuagaaauuagagaauuuacucuucucacuuaauccuguuauuaugaagauuaaauaaaacaaucucugaacaagaaaaauggagacaaauuuuagcaauuaaauaaauaaauuauaggucuuuuaaagacaaacaugcuaaaaguauacaguuacaacagcaacuaacuuuuauugcauuuuuaugacuugacagacacuaugcuaaguaucuuauauacauuauuuccaauacucacaccaaucacagagaguagauaccauuauuauaacaauuugacagaaaaagaagcugaggccuaaaagguuugauaagaucaacagcucaucagugguggaguugggauuugaauuaaugcuuuuucacuuuagacaccaggacuaaaaacuauuuccuuuauuacaucugaauauuuagcuuuuguuaaccuagacauuccugaaauauaaaaauucuuccugcacacauaguuagccuggugaacaaauucuaaccacccaauucaaaguauuuaaguugcuaagaaugucuucaauuuuauugacacuuugauccauccauuaccuaacuuacauuuuuuaauauucgaucccuuuuugacuauuuaauauuuuaucccuuuuuaggagcuauauuaauccuuuuguuaggcugauaaauacaccacaaccuaaaaauuuauugagaaagaccuuugaaauacacaucacaaaguuucagacucaaccaaguuuaauuguccucagucauugaaaacaaauucuuugauuuccuguaaaacuucguugagugauggaguauaauuagaaugaucugaauuuuuaaaaauggggauuaauaaaggacuugagaauguuuuacuggcaaaucucaggaugcaaacauaucuuguguucauccuauaaauugcacagccaaacuguucacugggaggagaaaacagcagcagcagcaacaacaacaacaacgaauauguuguucuugcuaugcucuguaacacaaagcacuggagguuuauaaacccauugaagguaucuauuagucccaucauagagauuuuuuaggugacuuauguuuacgcagaacucuacauuuuaugagauuacuauguagugauuaaacuuuccuccuuuugcccuuuugacuugauggaaaaaagaaaguucauguuugcugauucuuauaugacuaaccaauaaccugaaagaagguguuuggaguuugcuucuugcaagcaggguccauuuaaugauaucaguuugugaagcauacagaugcaucauuccaauaugugcaaaauucucaguacaguaccugguguauagaaaaugcccagcaggugucugugaccauuuucuuuucuauuauucuguauuuacuuccugacuguuucgugaaauauugucauuuuauucaaagaaugaaaagagaaaaugaaaggagguaaaauuaaaugagcaaacucuacaugcuuuagcauguuuggccucaaauuuugguaggggaagagauuaauauaagguuucuggaccaucuaagaccuugguugcuacauaaucauuguuuccuauucuuuuuaauauugcaucaaaaguugauugaggcugccuaucauuuaaaaugagauagagagcuacaacuaucaggaaugaauggccugcaauggaaauuucuuaauauguacucauuuguucucuucuuguagucauuuuuuuugggggcucucacucuccaaaccaacuauuggacuuuguucuuucauaucauuaaaaucuaauguuauacacaggagcagaguagacucuuuucuaugagauuuguuauuuaaggauucuaugaugaaacagacuucaucaaaaaauaagguggggugguaggaaguugagcauauaguuuaagaauagagacagcagcuugagaccagggagagaauucugcaauuuugaauggaggagggaaaaagcagcuuggagugaaugggaaacaucagggagucaaucagacugcacaggaaauguccaggaaaagaugcuuguucuaucugcuggaacuaacugcccaugccauacugcacuguguauuugcuuagugaccuggcuuuugugagucuugcucagacuauuggaaucauguggaggauauugcagcaaacauuuagguccagugaugaguggguaugagaucaucauuaguauuaaguauuuauuaaguguguaguaaaacuauagauuucaucauagaaacucaauuucccuauggaucugauugaugccuuguaauuuuucauuguuugaaaauguguaacacugccuugugagcggaaguagcccuucugugaauugaaaaugaaaauccaaaauaccauaaaagcuaugaugugggcaagaaaaaaaaucacuuuaucuauaaaaagaugagccuuuggagcauuuagcaguuuucuccuuaaaaaaaaaagucccuuggauugaaauaaaaucuaccauugucuucugguuuuauucuaacccaagauuagaaaaaauaacuuuucacaaauuugcaguugcuuaaucuacauaaguuuguaucagauucuucuguuuaucuugucaaacuuguaaaauugaguuagauucaacuuaauauauauagauagcuagaucuauagggaagaaaauaaaucuuaaguguuuuuucucuuuuaaguguuuauguuaaucugaaauauuuguaauauauuaucaaaguuaaaauguuauuacauaacugaauggaauugucacauuuucuucacauagauauacuuaauauauauaacauuuauauuucguauaauauauaaauauuaucauccaaaagcuuucaaagaauuuuuauauuuccuuauuuaaucauccaucaucagcuaugauuuaucuuuaucacaaggacaauuugaugcaugaaaagcuuggauaaccuucuaugaaauuuuaagaguuauaaguggggcugaaaauugacucauagaauuugagaagagaaagaauguucuuggauggaagauuaaaugauuugaccaucaucuuacaacuaguuauuaucagcggaacucaaaugucuugacuuucaguuuuguguuuuauccucuguacugcauugauuccuacggauuuuuuuuuuaaagaauucaguccaugauucugcccaguugucuggccaucaggaauggauugaaaccaaaauaugugccaagaguuucauucaacauuuguucaauaaguauuuacugaguagcuacuguguaaaagcuauuguuuuaggugcuuuggaugaaucaucaaacaaaaaagaaaaaauuccuaccuucauggaacuuaaaauaaaauuaaagcaaacuauaucuucaaagaagguauccuuggcuuuuucuaaaaugcaucaacuuaagauuucugaccauuacgucauuggaacuuugccugaauauggaguauuucuuaaaaguugucauuuuauuuaaaaugacuauucucagagguaugacugagcaguugcucaagcaaugucaaucuucugauagaauucuagaguaugucucuuccuuccucauguccaaacauaaaugaaaauaauuuuuuuguauccaaaucuuuaugauuccauuuuccuggaaaugcauauagggguauauauacaaguacacauccauauguaucuuauuuugaaaucuucuguaaguauuucauugaucaacuacaaagcacugugccucuaaaauacuuuguacuacuuuuuuuuguauuuuuaguagagaccagguuucacuguguuagccaggauggucucgaucuccugaccucgugauccgccugccucggccucccaaagugcugggauuacaggcguaagucaccgcacccagcccacuuuguacuacaucuuaacaacaucauauucuuuccuguauuacacucacuugcauaaauauguuucuuacucuauuauaacucucucaagauaguaaguaguaagggccagaauguucucauugaauuaugguugacuuguuuuaacccuucaacugccuauauucuaacaguaaaaaauaagcuuuuaagauucuuuaucuuagcacuugauucuauaaaaggcguaucaccuuuauggagacacuuacuggcuagaguuuauaauuagaauaaggaaaagaaaaaccuuguaagccauauacagcauauaauuauuaugaucuuaaacguaugguuauaaauauagacgaaaauacacacaaaaaagaaaacaucuguuucugggaaguagaaaauggcuuuuuuuccaugcaaguuucuuugaacacuacagcaaauauauuuuuaaaagauaguuagcagugcuuaaguaaugcuccaguaauacaacaaggggaauauaagggcucugaaguguuuaguuucaauucuucacuagucaguuacucuaaaaaaaaaacaccuauuacagcaucaauacaggcaucagggagaaaguuauccauauuacuuccauuaacccaaaagauaauuaauauugagagagugacaauaaaaaaccaacuuuaaaaacuaaaacugagaaaauacuucuccuuccacucccauaccccauaaaguuccaacaggacaagaauuuaaaaagagccaauauagucuuuaauuaguuauuuuaguaucuauguccaauauggcaaacacggaaugaauagaaauaaagccuuccacuuuaauuagacuuuucaaaggaagugauggaaagaacugacugcaaagcagagcuauaaagaagacucuuauugaauaguuagcaggaaaucuuuuaauuauugaagcugauaaagcacucuguaaagcuucuuuaucuaguugagccugaauacuuuucacugcauacuuuuuaaauauagguaaaaagaauuccagcucuauuuugacccugacuaugcguuuuuaguaaugaucuaaagaaaaaaauuugcauugaucuagagacccuuucuuugaauacauuuauaaaguucuguuguguauauuaaauuccuuagauuuaagcaauaacuuuuaaauucauguugaaauugaaaagaaauugaguagauauaaggcaugcuagaaugacuaguauuagugaaggagggagagcuaacuuaauauuuaaguauguauugauuuuaaaagguauaucauauguauacuuucauuauaaauguauauauagcacauauauuuacauacauauuaaauauauuuauacuuacauauauauuguaaguaauaacuguccauuuuaaauagauaacauuuaaaagcugaauugaguaugacuaguauaaaguggauuccacuauuacaauuauugucuuuuuaaggaguuaagugcuuaauauauucuguugacaauaguguugaaauauuuaauuaugucccugcuauauuuugaguaauuugcucacagauuacagaacuggcacagcugaccuagaggaacauuucugaacucugcccccugcuguguuuuggcucugcaaugauaauucaauuuuaauacguaauuauuuuggaaauaucuagcaaugcucaggauaguuguuucccucaucuuuucuauaucuuuuauccuuaauucauguguguaugugcauauguaaacacaguucugacugugcugccuacagguuuauauacacauauuuacucuuauauacccaaguacaugcauacuuaaaugguuccagguaagcagaauuauaugcagcauauaagugggcacauaucuaggaaauaagaagguugaaaagauggcaaaguaucaauaugauacugaaugggcaaaagcuggaagcauuccccuugauaacuggcacaagacaaggauacccucucucaccucuccuauucaaugugguauuggaaguucuggccagggcaauuaggcaagagaaagaaauaaagauacucaaauaggaagagaggaagucaagcuagcuuuguuugaagaugacaugauucuauaucuagaaaaccccacugucucagcucaaaaguuucuccagcugauauacaacuucagcagucucaggauacaaaaucaaugugcaaaaaucacuagcauuccuauacgccagcaacaggcaaguugagagccaaaucaugaaugaacucccauucacaacugccacaaaaagaauacaauaucuaggaauauugcuaacuagugaagugaaagaucucuacaaggagaacuacaagccacuacucaaagaaaucagagaugauacaaacaaauagaaaaacauuccaugcuuauggauaggaagaaucaauauugugaaaauggccacacugcccaaagcaauuuuuagauuugaugcuauucucauuaaacuaccauugacauucuucacagaauuagaaaaaccuauuugaaaauucauauggaacgacaaaagaguuugaacagucaagacaauccuaagcaaaaagaacaaagcuggaggcaucauguuacuggacuucaaauuauaguauaaagcuacaguaaccaaaauagcaugguacugguacaagaaaagacacauagaccgauggaacaaaauagagaaugcagagguaagacugcacuccuacaaccaucugaucuucaacaaaccuggcaaaaacaggcaauggggaaaggauucccuauuuaauaaaugcugcuggaagaacugguuagccauaggcagaaaauugaaacuggaccccuuccuuacaccauauacaaaaaucaacucaagauggauuaaaaauuuaaauguaaaacccaaaacuauaaaaacucuagaagaaaaucuaggcaauaccauucaggacauaggcaugggaaaugauuucaugaggaagacaccuaaagcaacugaaacaaaagcaaaaauugacaaaugggaucuaauuaaacugaagggcuucugcacagcaaaagaaauuauccucagagugaacagacaaucuagagaaugggagaaaauuuuugcaaucuauccauuggacaaaggucuaauauccagagucuacaaggaacuuaaacacauuuauaagagaaauaccaacaacuccauuaaaaagugggcaaaggacaugacagacacuuuucaaaagaagacauacauguggccaacaaucauaugaaaaaaagcucaacaucacuguucauuagagaaaugcaaaucaaaaccacaaugagauaccaacucacaccagucagaauggcuauuauuaaaaagucaaaaaacaacagaugcuggugagguuguggagcaaaaggaaauguuggugggaguguaaauuaguucaaccauuguggaagacaguguggcaauuccuuaaagaccuagcggcagaaauaccauuugacccagcaaucucacugcuggguauauacccaaaggaauauaagucauucuguuaugaagauacaugcauacauauguuuguugcagcauuauucacaauagcaaagacauggagucaaccuaaauguccaucgaugauagacuggauaaagaaaauguggcccauauaaaccauggaauacuaugcagccauaaaaaggaaugagaauuauggucuuugcaggaacaugaauggaccugggggacauuauccucagcaaacuaacacaggaaaagaaaaccaaacaccacauguucucacuuacaugugggaaccgaacaaugagaacgcacggacacagggaggggaacaacacacacuggggccuguugggggugggggaggaaggagagcaucaggaagaauagcuaauggaugcuaggcuuaauaccuaggugaugggaugaucuguguagcaaaccaccauggcacauguuuaccuacguaacaaaccugcacauccugcacauauaccccugaacuuacaauaaaaaaaaaugaaaagauggcaaaguauaagaaaaagcauaugaauaccaacauagauugaggaugcaguauuaacuuuuacaaauauauggauggagaaaauggaaacauaugaagaguuuugggaaagaacaggugugaauuaguuaagcuggaguuuugagugaaaaaguuugauacuaguaaauuaggacauucaccagauuugcucuugaggauuguaaaguaaaacucuuguuuuaggguuuauuuauucuuuuccuugguaacccuaucuaaaaaagcacccugcuugucacucucuaucccaauaaucuauuuuucuuacaaccuaacauuauauaaucuuuuuuuuuuguaauguaccucccuagaacaauauaagcgcaaucagugcaggaauuuugcaugucuuuuucaccauuguaucuucuccacuuagaauaaucaaugggaaauaguaagcacucauuaaauauuugaaugcauaaauaaauaaauaaauaaauaaauaaauuccacauuuaagaucucugucaaaguuaugaaguccaccugaacuccccaacuauuuuuuuaaaaggcagaaaaugaacaacaacaacaaacaaacugucaggauaagacuuuaaaaugucaaaaacugacagcccagaauucuggaaacauugaagguacucuaggcuagaggugagcaacugguuguaaaaugaacuuauauuauuuacugaaaaagaaaagauuauuacacauucuguuccaacuuuaaagaaguaauaccuugagaaucauuagaaauucauugucuaacaucuaaauuauuuggaaagaauuucccaaauuuuaauaaguugaacucauuucaagaacccaaaagguaaaaacaaaacauaacaaaaaacucuuauauucaggaaaauggcucauauacaguucuauguaauuguagauaaauuggccaggugggagguaggaugcgaugucacagauuuuacaugucuuacugacuugcauacuggauaccuauuguaucucuuauacccuuacaaauuggauggaagaagccagcuguguaaguggaagccuuuuagaaacaaauaaaaaacuuauaauaagaguucaagcaguagcguuuacucaguaucacauaaaucguggaaaauuuaagguuauuuucagccuuguuaaaaacucaaggcaucauaaaucaauguauuuucaucucacacauuauggaaauaaaauaauuuauuuauguaucaguugaauacuuucacaggcauuuauucugaauuacguaccacgucaggaccaagguuauagauuuaagugagagaugguuuauguccucaugaaauuuauaauuuuggggaggagaaggggugaaaccagaaauuaauaaauaauuacaugaauaaucaauuauuuaaaauuauuuugauuuuuaagaaggagaauuauaaaacauuauagcacauauaaaagugggauauaacucaaugggaaugguuaagacauucuuucugcaaauuacauuuaagcagagauacaaucuguacauuaaaaauacaacuaugaugauaguguaauuuguuaucuacauggaagaaaaucuuauaauugcaucacuauuucacagcacacuaaaagauagauuccaaguagauuaaagauaaaaugugaaaaagaacagaaauaagaauauuuggagaaaaauauauaagauagggauugauuucuuaaauaagaaagaaauauaaaccauuaugaaaagauuggcaaauucaauaaaaguaauaauaaaauuugaacuucucugugugaaaaaauauuguaaauauguaaaaaguuaagccaaaaaugguggaagauauuuguaacacaugaaaacaacaaaggaaucuuaucccuaauguauuaaaacaacaacaacaacaaaaaaacugaaaagcucucagagcacaggcagagcaagauggcugaauagaaccuuccagcaacuguccccaccauaggaauaccaaacgguacaacuauccacacaagaaaacagcuucauaagauuaaaacaucaggugagcacuuagaguaccugauuuuaacauuguaucgaggaaagaggcacugaggaggguaggaaagacagucuugaauugucuacaccaccacccgcccaugccccagcagcagccauguggugcagauggagaaugugugcuugcaggauggaaacagcacugauugugggacuuugcacuggaacucagugcuacccugucaugguggagagcaauauggggcagaauucagcuggcgcacacagagguagcauuuagaccaucccuagccagaggggaaucauccaucccacuggucagaacuugaguuuuaucaagccccaccaccgugggcugaagugcucugggguucuaaauaagcuugaaaggcagucuaagccaaaagaacagcaauuccugggcaaggacuuugucuugcaacuuggauaccagcucaaucucaguaaaauacagcauaaacggagucuugaagucccuauuccagacccuagcucccagacaacauuucuagacauacccugagccagaagggaacccucugccuuuaggagaaggauuuccuccuggaaggauucaucacuugcugacuaaaaagcccuuggacuuugaauaaacaucagcaguagccaggcaguacuuggcacagguguugggcaauacccaguaccgugcuggcuuuaggucugacccagugcauucccaggugggaaagccaugaaaauagacuccuucuacuugacaaaaaaggaagaaggaguauaaaggacuuugucuugcaacuugggcaccaucucagacacaguaaauuaaagcacuaaaucccugauuccaggccuuagcuccuggacagcauuucuacagcugcccugggugagaagggaaccugcuucucugaagggggagauucaguccuggcaagauucaacaccagcugacugaagagcccuuaggccuugaauaaacaucagugguagccaggcaguacucaccaugggccuggggcagugguggccauggggagagauucuuuuugcuugaggaaaggagacggaagaguaaaaaggacuuugccuugcaacuuggguaccagcucagccacaguaaaauaaagcaccaaauagauuucuaaaguucucaacuccagguccuggcucccagacagcacuucaagacccacccugggccagaaaggaauuugcuguccugaaggaaaagauacaagccuggcuguacuuaccaccuguugaccaaagagcccuugggccuugaauaaacauuaguuguagccagauaauaguuguuacaggccuugggcaagacccaguacuaugcuggcuuuaggucuggcucagcacagucccagugaugguggcuacagcagugcugugucacucgucccucaacaucaagcagcucaccguagaaagagauacuccauucguuuagcgaaaaguaaaggaagagaacaagagucucugucuuguaauacaaggaaauuuccuggaucuuacccaaggccaccagggcaguaccucuaacaggcugcaaggucacagcauuacugggcuuggggugcccccuaauguauauauggcugcauugaccgaagauuuaaaucacaacauucaauuccuuugaauacuuggaaaacuuuuccaggaaagagggguacaaacaagcccagaucaugaagacuacaauaaguaccuaacuguucaaugccuaaacauugacaaacauccacaaguauuaagaccauccaggaaaacaugaccucaccaaacagacuaaaaggcaccagugaccaauccuggagugacagagcuuugugacuuuucagacagagaauucaaaauggcuguuuuaaggaaguucaaugaaauucaagauaacagagaaaaaaauucagaauucuaucagauaaauuuaacaaagagauuaaaauaauuaacaaaaauuaaugaauucuggugcuaaaaaaugcaacugacauacugacacacaucagucucuuaacaguagaauugaucaagaagaaaaaagaaugaaugagcuugaagauagacuauuuaaacauacagucagaagagauaaaagaaaaaagaaugaagcacaccuaagagauacagaaaauagccuuaaaggggcaaaucuaaguuauuggccuuaaagaggagacacggaguaagacuaggguagaaaguuuauucaaagggacaauaacgcagaucuuuccaaaccuagaggaagauaucaauauucaagugcaagaagauuauagaacaucaaacagauuuaacccaaagaauacuaccucaaggcauuuaauaaucaaacucccaaaggucaaggauaaagaaaggauucuaaaagccgcaagagaaaaggaauaaauaacauacaaaugaccuccaauacaucugguuucacaguggaaaacuuacaagccaagagagaguggcaugacauauuuaaagugcuaaggaaaaaagccuuuuauccuagaaugguauaucccauaaaaauauccuucagacacaaaggagaaauacuuuccaugagaaauaaaagccaaggaauuuugacagcaccagaccuguccuacaagagaugcuaaaggguguuuuacaaucugaaagaaaaggaaguaaacaagcaauaauaaaucaucugaauguacaaaacucccuaguaauagcaaguacacaaacacagaauauuauaacacuguauuugugguguacaaacuauuuguaucuugaguagaaagaugaaagaugaaucugucaaacauaacaacuacaacaacuuuucaagacuuaaaacaguaagauauaaauggaaacuacugaaagcuuaaaagaagggaugaaguuaaaguguaguuuucauuaguuucuucuuugcuuguuuguuuuugcaaucaguguuaucaucaguuuaaaauaauggguuauaagauguuauuugcaaaccucaugauaaccuuaaaucaaaaacucuguaacagauacagaaaaaauaaaaagcaagaaauuaaaauaugccaucaaagaaaaaucauuuccucaaaaagaagacaggaaagaaggaaggaagaaggaaagaaaggaaagaaaggaaagaagggaagaccacaaaacaaucugaaaacagauaauaaauuggcaguaguaaguccuuacuugucaauaauaacauugaauguaaauggacuaaacuuuccaauaaaaagacauagcguggauaaauagauuaaaaaaacaacauucaacaaucucucauguacaagaaacacacuucgccuauagagauacauagacugcaaauaaaaagaucgaaaaauauacuccaugcagaugggaaucggaaaagauaagaaguagcuauauuuuuaucagacaaaauaaauuucaagacaaacccuaagaaaagagauaaagaaggucauuauacaaugauaaagggguuaauucaguaccuaacacuggagcauacagguaaauaaagcaaauauuauuagagcuaaagagagacauaaaccccugauacaauaauagcuggagacuucaacagcccacuuacagcacuggaaagauuauucagauagaaaaucaacaaagaaacacuggacuaguguuucacacuagucugcacuaugaccaaauggacauaagagauauucaaagaacauuucauccaauggcuaaagaauauacauucuucucuucaguacaugguucauucaguagaccauaaguuaggcuacaaaacaagucuuaaaaaauuaaaauaauugaaaucauaucaaguaucuuuucugacaaggauagaaucaaacuagaaaucaauaacaaaagaaauuuugaaaauuauacaaacauauggaaauuaaacaauaugcuccugaaugaucaguggggucaaugaagacauuaagaaggaaauuuaaaaaugucuugaaacaaaugaaaauggaaacaaaacauaccaaaaccuuuggaauacagcaaaaguaauacuaagaggaagauuuacagcaauaagcaccuaaauaaaaaaguauauaaacuucaaauaaauaaccuaaugauauaccuuaaagaacuagaaaagaaagaacaaaccaaacccaaaguuaguaagaggaaagaaauaauaaagaucagaguaaaaacacaugaaauuggaacaaaaaauacaaaagaucaauaaaagaaaaagauaauuucuugaaaagauaaaaucaaaaaacuuuuagccagacaaacuaagaaaaaagagagaagagccaaauaaauaaaaucagaggugaaaaagauguugcaacugauauuguagaaauucaaaagauuauuagagacuacuaugagcaacuauaugccaacaaauuggaaaaucuggaagaaauagauaaauuucuagauacauauaaccuaccaagguugaagcagggagaaauucaaaaccugaauagaucaauaacaaguacuuaguucaaagcuguaauaaagucuuccagcaaagaaaagccuagaaccugaugacuucacagcugaauuuuaucaaacacuuaaagaaauacuaauaccaauuuuucucaaaguacuccaaaaaauagaguaggagagaauacaucccaacuuauucuaugagaccaguauuacccugaaacuaagcuagacaaagacacaacaaaaagggaaaacuacuggccaauaucccugaugaaugcugaugcaaaauccuuaacaauacaccagcaaacugaguucaacaacacauuaaaaagaugauucaucaugaccaagugggauauauuccggcgaugcaaggauagaucaacacacauaaaccaaucaaugugauacaucauauuaacagaacgaaggagaaaaaucauaugauauuucaauugaugauaaaaaggcauuugaccaauauuccuucauaauaaaacucccacaaaacugaguauagaaagaacaugccucaauacaauaaaagcuauauaugacaaaccuacagcuaauauuauacugaaugggaaaacugaaagucuuuccucuaagaucuagaucaaggcaaggaugccugcuuucaccacuguuacucaacagaguacuggaaguccuugcuagagcaaucaggcaacagaaagaaauacagggcauccaaauugcaaaggaagaaaucaaauuauccuuuuuuuacagaugauauggucuuauauuuggaaaaaccuagacuccacaaaaaacuauuagaggugauacacaaauuuaguaaaguugcaggauacaaaaucaacauacaaaaaucaguagcauuucuauaugccaacagugaacaaucugaaaaagcaaucaagaacauaauccuguuuacaauaaguacacauaagaugcaauaucuaggaauaaacucaaucaaagaagugaaagaucuguaaaacaacuauaaaacagugaugaaggaaauugaagaggacauaaaaaauaguacacaaauaaggaaauugaagaggauguaaaaaaauggaaagacauuucauguucaugaauuggaaguaucaauauuguuaaaaugucaauuauauccaaagcaaucuauaaauucaaugcaaucccuaucaaaaugccaaugauauucuucacagaaauagaaaaaacaauguuaaaauuuaugcggaaccacaaaagaccuagaauagcuaaagucaucuggugcaaaaugaacaaaacuagagaaaucucauuaacugacuuccaauuauacuacagagcuauagugaucaaaacaacacgguacuggcauaaaaacagacacauagacuaaugguacagaauagagaacccaggaauaaauguauacauccacagugagcucacuuccaacuuaggugccaagaacauacacugaggaaaggacagucucuucaauaaauggugcugggaaaacuggauauccauaugcagaaaaaugaaacuagaccccuaucucugaccauaugcaaaauucgaaucaaaauagauuagagacuuaaauauaagaccuccacuaugaaacuccuaaaagaaaacacuggaaaaacucuauaacauuggucugcacaaagauuuuaugaauaauaccucaaaagcacaggcaaccaagcaaaaaugaacaaaagggauugcaucaaguuaaaaaguuucugcauggcaaaguaaacaaucaacaaagugaagaaauaacccacaaaauggggaaaaauauuugcaaacuauccaucugacaagggauuaauaaccagaauauauagggagcucaaacaacucuauaggaaaauaucgauuaaucagauuuaaaaacugggcaauacaaaaauuagcugggcaugguggugggugccuguaaucccagcugcuagggaggcugaggcagggagaacugcuugaaccugggaggcggaaguugcagugagcugacaucaagccacugcacuccaaccugagcgacacagcgagacucuguuucaggaagaagaaaaaaaaaaagaaaaaagaaacaaaacaacaacaacaacaaaacaaaaacuaggcaaaagaucugaauagacauuucucaaaauaagacauacaaaugaaugguaaacagguaugugaaaggugcucaacaucauugaucaucagagaacuguaaauuaaaacuccaaugagauaccguugcacccccaguuaaaauggcuuuuauccaaaagauaggcuauaaccaaugcugguaaggauguggagcaaaaggaaucuuuguacacuguuagcgggaauguaaauuaguaaagccauuauggagacuaguauagaggcuccuuaaaaacuaaaaauagaguuaccaugugauccagccaccccacuccuagguauauacucaaaggagaggaaaacaguauaucaaaaaggugucugcacuccuauguauauugcagcacuagccacaauagugaagauuuggaagcaaccuaaguguccgucgacagauuaauugauaaagaaaauguguuacauauacacaauggaguacuauuugaccauaaaaauugagauccugucauuugaaacaacauggauggaacugaaggucauuauguuaggugaaaaaaauccaggcacagaaagagaaacuucacauguucucacuuacuagugggagcuaaaaaugaaaacgauugaacucauaaagagcaagaugaugguuaccagaggcuggggaggguaguggugggaagaagggaaguggggauaauuaaugaguucaaaaauauaguuagaaagauaaaacaccaaaagcaauggcaacaaaagccaaaauugacaaaugggaucucauuaaacuaaagagcuucugcacagcaaaagaaacuaccaucagagugaacaggcaaccuacagaaugggagaaaauuuuugcaaccuacucaucugacaaacggcuaauaucaagacucuacaaugaacucaaacaaauuuacaagaaaaaaacaaacaaccccaucaaaaagugggugaaggauaugaacagacacuucuuaaaagaagacauuuaugcagccaaaagacacaugaaaaaaugcucaucaucacuggccaucagagaaaugcaaaucaaaaccacaaugagauaccaucucacaccaauuagaauggccaucauuaaaaagucaggaaacaacaggugcuggagaggauguggagaaauaggaacacuuuuacacuguuggugggacugccaacuaguucaaccauuguggaagucaguguggcgauuccucagggaucuagaacuggaaauaccauuugacccagccaucccauuacuggguauauacccaaaggauuauaaaucaugcugcuauaaagacacaugcacacguauguuuaucacggcacuauucacaauaggaaagacuuggaaccaagccaaauguccaacaaugauagacuggauuaagaaaaugugggacauauacaccauggaauacuaugcagccauaaauaaggaugagcucauguccuuuguagggacauggaugaagguggaaaccaucauucucagcaaacuaucucaaggacaaaaaaccaaacacugcauguucucacucauaggugggaauugaacaaugagaacacauggacacaggaaggggaacaucacacacuggggacuguugugggguggggggaggggggagggauagcauuaggagauauaccuaauguuaaaugacgaguuacugggugcagcacaccaacauggcacauguuuacguauguaacuaaccugcacguugugcacaugcacucuaaaacuuaaaguacauauaaaaaaaaauaaauacgaucuaguauuugcuaccacaacagggugacuacagucaaugauaacuuauuauacauuaaaaauaacucaaagaguauaauuggaaugguuauaauacaaagaaauaauagaugcuugaggugauagauacuucauuugcccugaugugauuauuacacuuuggaugccuguaacaaaacaucucacguaccuuauaaauauacucaccuacuauauacccccaaaauuuaauaauggaucucuccuauucaauaagaauuaggaaaguaacacuuuagaaaaaugaguuaaaauauuagcuagcaauuuacaauagggacaacacaaacgguaaauuaacaugaauacaugcuugaugucagaaaaaaauuaaaaauccuaaugagacaaauuuuuaccuucauuuaucuaacacaaguuaaccagugugauaauaucaaguaagagugaaaauguauagcuuuuuuccuucaccccuuucaguuauuugcucaaauaucaccuccuaguacaguuuuccuugaucucuguauuuaaaauugcaucuccuauucuagcacucuuuauuccucuccuugcuucauuuuuauccauaguacuucucccaauugagauauuauguauuuauauuuauuuucugucuccccacauuagaaugcaaacugcauuuagacagagaguuuuauaaacuugguuuacugcuauacauccccuucuagaacacagucugucacaugaaugugcaauaaauauuuauuaaaugaacaaaugaaugagcaggggaaacuuccagaaauugcugagguaguaucuauugauacaaacacuuucagaagcuauuugccauuaauguugaaggugugccauaaauuccguguuuccaauucagguauauucucucagauaaacucuugcauacaugccaaaggagauauguacaauaauuuuuuuuagcauuaugguaacagcaaauagaugaaagcaauacaaauacccaugaauaaaauaauaagcacaucuuaaugcauuccuacgauggaauacugugaagcauuuaaagugaaugaacuagagcuaccuguauauaaacauggauaaauuucaaaaacacaauguuuagagaaaaagacgaauugcagaacugugagcaaauaugaugccaauuugcaaacagauauccaaaguuaugauuaauaagcaaaacaauuauuuguuuuacagaaggacuuaaugcagaaugcauugaaaucuagacauucuugguguauggaaucuauuuacaaaaagccaauuuauauauaacagguugaauuauacugagaauauaucuaggguuaaaacuuuuugaaauguuugcauuuucaguuauuauuuggagacacaagagucgauuucauaauaaaagucuaaucaagcaucaccaaaccaauguggcacagaauaacuauuuucuggaaauacuguaauaaaguuaguuaaugaauuccuuuuaaaguugcucacagcuggaaauauaagacaaaacuucauaucagacugauuauauuauauuauaauuacugauuauauuaucuuaaauauguagguugcuuuuguacauauaaauuaauaaacugucuuaaauuuguagcauaucuguauguuaaaaaauauauauguauuuuuagagaugggguuuuacuauuuugcuuaggauagacuugaacuccugagcucaaggaauucucccaccucagccucccaaguaucugggacuacagauauaugccaccacaccugccuuuuauauauuuuuaaagcaacauccauugaggaguuuuuaugcaggacuuguaaagagaaaaaaaaguuaauguucuugaacuuaucaaaauggucuguuucuucucuguucaagauaauguaaauuguaauaaucaucauagagcuaauucccauauucuuuuuuuccaaacugaguuaucaaguauaaaaguguuuucuaagcauuugcucccauuaauuuagaaaguaggcucccuaggauauacuaauuuuuagaagagaaauuagccugaaauaaucagcuuagaaaacuuuaguaauuguuuuuauagcauauguucuauagaauuuacuaauuuguuuuucucagacacaacugauuuugaaguuuucaaggaagucagauuuuaaaucuccuccagauagcacuggaagcguuagcucuaaacucguuccaacuuuuuuagaaauaaaguucuugauuugaaaucauuccuuuuccaauuuuccuguaagauggaaguggacaagucaugugauaugauugcucaauauaggaaggaauaaaacauauuuaauaccaaucaaauuacuuuuuauuuuuuauuccucuuagcaugcaugggcugaacaaagcuuccuucacuggggauaagucuauaucugaaugucaaaaacuauaacucuuugugaagcuugcuuauuaagaauuugcuaugguucauuuuacaaugacaccuucauauucaguggugucagcauuuggagcagcaaucuaggaucaauuuaucuuggcauuaaaaggagaaaaaaaaaggaaaagaaagaauugauagcuucacaagagcauauggaauuguucaaagauaaaacagauucauuauggcacacacgugcaauccccuuccaaaccacccuuccuaccccuaucucaagcagcaggcaccacugcauugucaguacagacagugauagcccacaggaauacaaaacagccuuaaugccucauuugcuuaagcagcaagacuacuuuauauccuuagaugaugugcugaacccucagauaaaauugccuuaggggacagagcuuguagugagaaaaagagagaggaacagcuucaaaaauauuuucuuucuagaguuaccucauuuuagaaauauaaucaaaccuuuguaaagacauuguuaauauacccugaaaaaugagugaugaaguauggaaugagcuacucuuugcaacucuagcugcaucauucacaaauuauaauagcuaucucucuuauuuagaacuucuaaauaagauugacaauuaauugagucaaucgaaauguucaagagugaauccuucacagugagacugaagcugcccaagagauuauuaaugaaaauuauuuaaaaauucauacaggguugggacagguuuuauuuauauacagcaaugaaaccaugaauaagaugguuuauauuuagaaaucucuccacuugacugucuaggaaaguucaggaaaaaccugcucuguauuagagucauuuguaaugucaauccacuuagcaggagauuugaaaguaucccaauguaaagugagacaaaagggaauuauacuaagagcacagaccuuaaacuaucuuuggguaauuuuuuaaaaauagcauauuugauccuguuguuuuuuuagggacuugcugcuguaaaaaccucuggccuccacugugucauacauuucuggcugacacauuuugucuaguugaaugagaacccacauuucagaagucauugaauuucaguugguuagaagucuaguuuagagcaaauaugucacaguuuagaauaaauucccagcuuaugucaauaauuuuggagucccaguucacaagguuuuauaacaucaaaacagagaaaguuggaauaucaucuaauauuuuaaacuuuaugucauaacuuauaaccaauuuuaaagagaaaaaucugaguaaaacauaaaagccuucuucaguucuuuaacuuuuccuauuucaggacucucccuuucauacucaggguuccaccuuuggauucauaaucucacacaacugaagacagaacuauaaagggcuuuuggcuuagaaaaaccuggguuuuaauuccagcuucuucaauuagcuagcuaugugaccuuuggacaaacuacuuggcuauuuugaaccucagauucuuuauuugcaaaauauagauauuaauaucuuauggaaguguucugaggaaaguacauccagcauaguucuugcauaacaacugcucagcaccuguauccuuucuacccuuucagugucuuaauacguccucaccuguacuucucccuccuuaaagagaguaaauaccuuaauuaacuuuuauggcuauuuauauuuuuaaaaagguuaauugggguuacauuaauguuaacaauuuugacauggucuaauuguaucuguucaauugucuuuacuucaccaaacuuacugaacucauuccaaaugcuuuagcuucuucuucuuucaccucaacuugccuuuuaaaaaauugguaauuuucuucacaauuucucaaaugcuuuuugcaauaacaguauuucuucauugguguuacaauaguaauaaauaacaauuauaacagcaacagauguugaggagguguaagaguugaagcuaauuauaggacguuauaggaugggcacccuacuuagcacuuuaccuacuuucucauguaauuuucauaacagccauugaaaacagaaacugucauggucaccaauuugcaaguuagggaauuaagccuaaggaagacagaggaauuaucucaaggccacuuaauuaacaaguggaagaacuggggcuuaaacccaggcuugccuaauaucaaaauauuugcuuuuaaccuaucacaucauauuacuucuguuaaacaggauucuuuuaguggaaaauuauuaagugugauccuuaaauaauguggugaagaauacuuuugaaguuaaauggacuaacacaaauuuacagagaaaauguaaaaauaaaauauucaaaacuuauuccuaaaaucaauauuuauuauaauuuaacauugcaacacuuuauaaugccagccaguuauuaauuaaucuuuaagcauaauuuuucuuuaucaagaagucuauuuuagaacauaaaagacaaagugcuuucccccuuaaugaaaccucaguucaaguuaugaccucaguuaguacauucuacucucacgaauagaaauagaaaccacauuuacuuuuacauauuuauuuucauguacuuauaaaaagaacauaacauauaucagagucucuucuguuuuucucagaugcuguggauaaauaugguuuauuaaacccugcagagacaagcuguuguguuuguugaucuguuaaauguuguuauacagcaguuaaacuuguacaugcuuguuagcuacauguacuaauuuaguguauugauagguugucaguauaaguaucugauuuaacagaauaaaacagacacgcauuuggaauucacagcgauuucuauaauuuuuugaaggaggagagaaaaaaugauccaaaugauagcuuauaaaaguguuugacagaguugaaaagugaaccugaaaacauuugacuaauuacucuuaucagcauauguacaagaguuauaauuaagaguuuugaaagugcaguuaccaaaaauaucccguaaacuuuuauaguaagcauagaucaaauauaagcagaauccaguaauuuuaaaaauagaaaauagaagaaagguguuaaaauuuuucuuuuuuaaaaaaauggacaaaauuguaucguguacaacguauuguuuugaaauauauauauacacacauuguggaaugacuaaauugagccaguuaucauaugcauuaucucacauaucuuuucuguggugagaauauuucaaaucuauucuuuuagcaaauuuuaaagauauaauguauuguuauuaacuauagucaccuuguuauaaaauaggucuccugaacuuauuccacuuaucuaauugaaauuuugaaauuuuguauucuuugaccaacaucuuucccccuccccugucuuucauuuugaaauaagaaagugacuaauauucgguagcaucuggcacugcaucuucuucuggacaguaaauuaaaauauggaugauaauugauuuuuggcauggaacaaauccaccuuggcuuccaacaaaagcacauauauacaaaaugaacuaaauagaccaaauuccuggagucucaagugaaagugaccgucaucugcuaugucugccuuuuggaacuagauuauaaccugaguucuuaaacuugauguguagcccacaaacucucugucacuuguucacaagaauuggaaugauaagccaaucaacuucaaccauagugugugaaggauucuaagagcccacaaacuagucuacuucuuuucagaaaagaauuauuucccauuacugauggaaauaauuauuuacuucaauucaguugugaaauaaauaaaaauauuagcacuuguguugcuucauuaaaacagucacauuaaaauccuugucucuaaauuccagaaacccaguguuuaucaaauauccaaauuugaauugccuaauauuuguaaaaccauugaauaaucuuaagauacaugucuuugauuuuacaauaauuuuaguauuuuuugcauaauagcauguuucaggaaaauaacauagaguggguuaaugcauuaugacaucaguuuuuucuucaaaaauccauuguugaauaucuauaauguggaacgaauugcauguuugcauggacucuguagaagccuguaaagguagauuaauacgcguaaaauacuacaauucugggucugauauaugcuguauuacaagccaaaauuugggauuauagaggagggagugauuaaaagggcaggaaaagcucaaacugauauuugagcaggauguuggaaguuauugagaauugugacagugguuauggcagaguauugcacuucuaguuucaaauuugaggugaaaaguggaccugaaauuuggcaauuauuugagaguuuucgcuaaugcuuuaaaacaauacauauguaacuaaccugcagguugugcacauguacccuaaaacucaaaguauaauuacaaaaaaagauuuuaguuucuuucauuuuucuaugugaaugucaacucaguuuucuucauuguuguaaacaccaagggaggagagguuuuaagaaguaucaaauccugcagcaacgucuuauagccugagugcuggaaagagaguauugagugagauaauuaggagguuauucuuauuuuugcagagauaaguuuuaaaaguguuaaauugagcaguugauuaucggcaguggaagaaacugaaugcaaagugaggaaaugcugacagcugauguggaagcagacaguuugagagagaagccagcuaaguaaagggaagaaaucaagaaggucaaguguggaagaugacaaagaucagccagcugaggcaaagaacggaugauguagaaggguggaacauggucaguauauagaucuuagguuauacuucaucagcugggaaaaacauguggaauauguuaccuuuggaaauagaauuucauaagcuuuaauauggaaugauuaugguuauuuacauauaagaaauccaucuuaagcaguguguaaauacguucuuugugaaguuauagugugguuuuaccaaggaaucucaguauguugcuuggcuuggcauguuuguuaaaacagauaugcauauauccauuuuauaaaguuuugcaaauuacagagcauuuucaaauacauuaucucauuaaguggucacauagcuaauaagaggaagauagcauugucuuuucacauuuaagaaguugagcggcuuagagaggcuaagugacuuguagaagccacauggcuaagaaaauggcauaguggacacucuucuagucccaugcucucuggcugucuccuaaucaacuaguuugaucccuuucucuaguaacugucuguugaaggacuaauauacacacauagagaaaauagagccaaacaaugacaagguguuggugauuuuucagcaccgucuaacacaggcaucauccugaccauagagcauggcaggagauggguguaccaagcuauccuaauucacuuaugguauucauuauuguucauuuccuuuugaugauuccucugguguuuacuaaagcaaacuugcaguaauuauuuuauguguacagaagaaacgugcacugacaaauagacauaggcauucuagucuuuugguucuacacgucuuaacauaaauuacucuucuuacaauuugauuuaaugcauuucgauugugccauuauagcccaguccuacaauaaaugaguauuagguaaauucuggaugaauuaaaaaauacacgagguugaggcuaaaagucuuaucuaugaaaaauacgacaaagucuuuccagccuccagugcccuuccauggcgcucaguaaccauuuuuuuuuuuuuuuuuccgagacggagucucagucuguugcccaggcuggagugcaguggcucgaucucggcucacugcgacuuccgccucccggguucaagcaguucuccugccucagccuccuagguagcugggacuaauggcgcccgccaccaugccgggcuaauuuucauauuuuaguagagacgggguuucacuguguugcccaggcuggucucgaacuccugagcucaggcaauccgcccgucucggccucccaaagugcuaggauuacaagcgugagccaccgccccggccaccauucugaacauuucuuugauacaaauauauggaguuuaagaucuucggggugagcauuuccggguaauuauaaauucacaauacugucaugugugugugagugccugaggucaaaugaaaagcaaguucaucaaauaugauaagugaaguaacucugaagacaguuaaacggguggucgacguugaugcccuguaagaaaauggaugaggagaaagaaaaauuuugauuccauaauacaaccaugaacuuuagaauauggaggaauguuuguaaagugauaaggacugggaggcguggcaagauguuuguauuuuaaaaucauggauuucaaaaaguguuaaaacagaagugauaagucaaugcaauggaaagagacaucagugguagaggauugaaacugcaucauacauggaucgcaagacccagaggccuauacaugacaguagccaaagcaagaggugucaugcguagcaaguaagcuguaaaucaacaugaggauguggaagaccuacugaauggaaacaguaaggcuaaaugagaccuugauaauaacaaaguaguagguucugggggcuuugcggaagacacagugaggagguugguuggguacauggccaggcaauagggcagaguuaaguggggaggagccauagcaguguuugggagagcaggaucacagaaaugaaagugcaauugagacggaggacaaugggcugaauaugaagaugagaaacguguagugauuacugaguucaaaccacacgucuuauaaacaguuucuucccuaucugauauuuaaauuuuagcccuauucuuuuccgucaugguacaaacucuccuaccuuuugacuaaaauccuuccagugcuucaugugucucucuuagggaauauccagccuugauuuacaguucuuugcucuuuguuuuacaaucacauuuccugucuugauuuauauuucuuggguccucugggacuuauugucucuuaaagucugauuuauaguaguuuucuccucaacauacuuauuuaagaaguuuugcuuuacaguaaauaauuauuuccauaauauauauuuuuucagauuuuuuggucccaaauuacuggugcuguggugguuuuauuguguucucacacaaugaaauuacugugguccucgacuaauggcgaaaauuaaaucucuuaguuuguuucauagaacaauacaguauuaauaauaauuuaccacagcacuucaauuuuuuacugugaaauuuuagguacagaaaaguuacaugcuaccacucaaccaugcucagaacaguaacauuaagaaugcauauuuucuccuaaaaacuacuuagacuaauuucucauauuucugcuauauaaaauguagucuuuucugaugucaaacacacuuuaaauagaaaacaaaacagcuugguaauuuuauaaaacuacccucaggggauaucuaguuuucaggucauuauucuucaacuaauauucauuugagucaaacagauguauauuugugcuugcggauuccaguauuaagaguuucuaguacggcgaagcagaugucaaaguugucaaacaaauguucauuguacuucacccagauaauacugugacuuauacaguuucuaaaugcaacacuagucuugaccuuaugaguauuacccuuugcuucuggaagcuaauauaaauaagcugauucaaaauguuagacauauucaagucuuuacuuuuauaauuucuuguuaaugcaaaaucaaccuuuagcaaauagauaaaagaaauaguaaaacucaaggccagauggauuuauuuucugaaauguaguaaaacauagcagaucuuaguucaacuggcaaucacuaacaagcuuccugauuuauaacagcucucccuacaugaauagcaucuuuucaccauauuuauauugcacuaaauaaugauacuuguaggcaaucauaaaaauuaaugaaugagcuaaugagagcuuuccaacuuauaaucugcaugagaaaacacaguuaaacugucguguagugaaugaggacaaucugcaaaaacuguaaguaguuaccaaaaaauagcauguucauuccuucagucaaugaagaaaacuuuauaaacauguauaaaguguacgucauuacugugcuagauacaggagaaaucaagaacuuuaaauguaguaggaaaggagggauagaaccugucuuaccuuagaauaugucauuauauuacauaugauuaaaacuagaaauuauuuacacaauggccuaaaugauaugaggcuaaguauacauaauuccaaauaccuggauagaaacugaaaauuuugaaacaaauauaaaaauauuacuuaaugauuuuuaaauaaaaugacuaaugcuaagaacugcaaauaauaacuaaaauuuauggagcucuuucuauguagcagauacauucuugguguuuuacaugugcuaaauucauuuaauccucauaauacccccaugagggcauuuauagggcuuuuccaggcauguccccaccucaguacuuuugcacuugcuguuugcucugccuggaaagcuuuuacuucauauccauguggcuggcuuccucacuuucuucagguuauuauucaaauggcauaucaguaaggccuucuuuucuaaacucuauucuaaauuugcaacccccccaauuuuuaucucacuuucuugaccauuuuucuccuuagcagcuaucacuuuuuaauaugugcuauauuuuuuacuuauuugccuuuucacugcuuccccgccccgcauuugaauacauguucuauguagguaagaauuguugucacuuuuuuugacuuuuuugacuucuugauuuccaugauuccuagaacaauacugagcauauguaaaaguguucaaugaauauuuguugaaugaaugaauaugguuaggacuauuauaaucacacauacauacacacacacacuguuuacauguuacuuaaaaacuuuauauuuaaauauacuuauauuugaaauuaguauauaaaauuauaugucagaucucagagaaugaaaaugagaaaauaucuauauauauguaaauucuuaugugcagauggaaauaaaauagucucuaguaugugagcauagcuauagaauucagguaauagauacuauaauuuauuuucuauuuaaaaaaugugaaauagcacacaucuuucuugucuucagcaugauaaaaauagcuaccauuuauuaagcaucaauuaaguuacaguguuaaaagccauugcaguuguuuuccucuucuauucuauaaaugaaaaauacuaaaacuaagcaaaguuaaauaacuucuaauaacuuuuaggucacaaagcuaauaaacagcaaaguugagauuugaacucaggucugcccauaacaaaacccuggacacuuuucaugauaccuugcuacucuccuugguuuuaugcuuaaaauacaaccaacuauuugaacuuuuugugcuguuuuuuaacuucugugucuagaccuauugaccacauuaaagcaaaaauaacacauccauaaaacgcuuugaauaaucugauaauuaucuuucaagaaaauaggaaaccaaccuaauuauuucaugcucugaauaaaauuuguucuaaucaaucuaucauuugaaacauccaaagaucaucauuaaguuuauuuuagaauuuuaaaguaaucaaauuaacuauggaaauagauauuuuguaacaaagaugacaucuauuuguauuucacauuuuaaaucaauaaaauaaccugauauuaaaagcuauugcacaguuuuuuauaaucagaaaaagacuuucaaguguuuauuaaaagucaagcagacuaaauacauauauaauauuuuauaaguaugcuuuuuuagugauauuaaaaugaaagacuuauuuauauauauuauguauguuauaauauauauaaaauaaacuauuauauauaaagcuacauaacauaaaguguuauaauauuacauaaaaauguuauaacauauuauauauaaaacaacauauuauauauaaaauaagccuuucauuucauuauauuggaaugauuaucuaguucaaaguucaaaccagauaaucauuccaguauaaugcacuauguauauguacauuauauugaaaugauuaucuaguucagcuuucucagugagagaaaauagugaaaagggguaaggguauguauuuagaauugaacuguggugagccaagcucauuuaaauuugugaugagaaauauuucuuucugguucaauuguuuacuauuuuccucaagaauauacucaugacaacucauuaggaaagcaauuugccaguuuuuaucaaaaggcuucaaaauguucagacccucugauuuaauaauacauuucugggaauuuauaccaagaccauaauuugaaauuuaggaagaguuuuauacacaaauauguucacugcaguguuauuuuaaauuauuuaaauuacaaaaauaaugaaugcuccuuaaauaacacagaaguacaugcaguagagagugacaguacuucuucucagaagccccuuccuccacaccugccucagaaguuaucuuauugugcguuuuuuauagccuagcauuuguuugaagaaagcauauuuuauauguauguacccccacaagguuguuucacauauaggaucaugugaugagaucaauuauuuuuaucaaagccaaaaaaagaauguuuacauaaaguuugguguagcuacugugcaaauuguauacagauuuuaaaagauuugcaaauaaguuuauccuauagcauuaaaaggaagauauaaaauuauacauggaauuauaguuauguauacacuccuauuaauacacauuccagaauaaaauaaauucaaauguuauuaguuaucuuugggugauaggauauuagaugauuguuuuugucucucugacuuuucuguauuuuccaaauuuguaguaguaaauguaauguuuaguuagauuuuuggaggaugcuuucuuuauccagaaucaggaauucugaauuugaauauuuuaaaugaaauccaaguguucugcuuugaagauuacauuauuaaucauuuaaaauaucuuaguuugaagagaaaaaucagaauauccuucacugacauaauguaaugaugccaaaagacuauguuuucuucauguuuguaaagugcccuuuuuguuaccaaugcuugagucucaguauuuacauaggguaauuuuuuuuugaguuucuuuugggauggaacaaagagaaaaugcuaaauuaaugaauuugacucagguguucucaaggucaguucauugaugggcagagucacucauuucuccaguucaaggaagucugaucuggagcaauuagaggcuuaucuuuguuaugcaaauuuauuuguuaaugauuuauuuauccaaaacuauuuauuaagugauuaugauugcuggggacuuuggcacaacugaauuauuucucagaaggccauauaguucaacauauugaguuaguaauucaacauauugacacccauggaagaagugaaaugcuuuguuucuacaauagugggagagauguuguauuaguuuguuaggacugccauaacaaaguaccacagacuggguggcuuaaaccacagaaauuaacuuucuuacaguuuuggaggcuagaagacugagaucaaggugucagcaggguugguuucuccugaaaccucucuccuuccuugguagauggucaccuccuccccauugucuucacgucgucuucucucugcguguguuuguguacuaauuucaucuucauguaaggacaacagucaucuuuuuuaagggucauccuauggaccucacuuucacuuaauuaccucuuuaaaaaccccgucuuuaaauacagucauauucugaaguacuaaggcucaggacuucaauauacgaauuuuguagggacacaauuuugccuguaacaaguaaugagaacuuaggaguuagaugaucugaguuaguguuacaaauuggucacuuauucuaacuugcuauaagaucaugagugaguuauuuagccuuaguucucaucuguguaaauggacaguauaauguuauugugaugguuaaauaaaaaacauucugucuuuugacaaguacuuauaagagggccacucuuuuccaggcauuaugcuagacauccauagaugcaaauauuuuguacuugccuuucauccuuaaaggaagaaauauaaugucuuucuauguagagguauauuuacaaagcauagaaauaacacuuugaaucacacagaucaggguugaaauccagauauugcgaauuauuacucuuaugcuuuugggcaaguuauccgaccucuccaaaaugguuuuaccuuuugaaaaauaaggacaaaauacucuaccuuucaagguuauuauaaagauccaguuauauaacauauauaaaaugccuuuuagauaccaagaauauagcauuguuaauuaauucuagcaagcaucaaguagcagugaggcuauaacaggaacaaguagaagaaaauguucagguguacaggugguaaacaccugaagaugagugccucaucuuucuaucagauuuggagauuuacacuguaaccucacagagaaagaaaaaaaaauacuguuuuucuaguagccuuguuuuuauuuucugagacagcaauuucauaaucaaacuugugagacugccucuauccccucauucucagcuguugaucucacuuuauauuccacugauaaacagaaacuaucagaugugaacuacuuuaucuuccugccauccaacccaguugcaccugcauagguggcucuucuucccucauuuuauaauggagaaagugucaguccucccaucaagggacaauuccucaugucauucugaaggacuuuucuccuuggcugauuauuuuucuccuauauccgucuuugccucucuacuagaucauuuccauuagaauucauacauaauauacuuuuauaaucuuaaaacuuagcuuugauuccaguucuccuuucaauuaccaccccauuucuuuauucuuuuauaacagaaauacuugaaaaagcugucuguacuuauuaguuccauuuucucuucuacaauucuccuaaacucauuuuaaucagacuaauuggauuuuuauccucacuauuuuuauccucacuauucuccccaaacuucucuccucauuaugaauccaguggucaauucuaaaucuuauuuguuaaaucaauccuuccuugaauuucuuucuucaagugcccucugggugcuauaccacuguuuuccuucugcuucccuggcuguuacuuuuugguguucuuuguuuguacugccuuuugaucucaccucuuaacaugugaaugccuuaaagcucagccuucagccuucuucucuucugcugacaacuccuacauuuauauuucuagccaggaccucuccccagaacuccaggcuuauaaaauaaacuggcuaagaucucccacugggauguccaauagacaucucaaacuuaauaugccccaaacugaacuaccaauaauuucccuuccacccccauugcaaccuaggauuucugcaauuuuccauaucuacugaugguacuccaucuuucuggugcaaaggccaaacauuugagagacauccuuuauuuuugucuuauuuuauaaaccucucucucucagauuccacuuccaauccaucagcuaucaauuuucaaauauauccagacucugaacacuucucacugucuccacugguaacacucauguccaagauaacagcaucuaucaucuggauuuccauaguagccuccuaacuguucucccagcuucuaucuuucccacuuucaggcgguuuucagugcagcagucagaucaugucucuucugugcucaaauugcuacaauagcuucuguuucacucagaguaaaaccaguauccuuauaguggccuccagagcuucauguaucuggcccauaauugccacucuuaccucauccucuaccucuuuccuuccuuggccucuacucaaaaugcacuggccuuuuuacuauuucuucagcaacuagguguccucccaccucacuaggugagcucucuuucugaaacacacuucucccggauaucuccaaggcucauccccauacuuucuucauuuucagucauaugccacuuuaucaaaaagaucuguccuaacuguccguuuuaaaauugcaaacaucccaccccaauccacaacuuucuaccuuguauuuuuuuaugggacuugcugacuuuuaauguuauauaauuuaccacugaaaugcaaguuccaugaagguggggauuuuuuuuuuucuauucgucuguuuacuucuauaucuuaagccuguaagcaauaucuggcacauaguagcugaugaacauuugcugagggaacaguuggacugcagagguaggagacugaaagcaguaagacugguaaagaagcuaguggugaugggaccugaaaaagagccauggggauagagagaaggagauacguaugagauauugauaagaccucaugagcaggguuuagggauucacuggaugguacagaguggaagcugggggcaggagagaaggugagugugacucaaaggcaucugcuagguaauuggguggauggugauaagaugaauucggugaacuaagaaagagaauacgagacguagagauaguuuuggcaauggagagacagagaguucauuuuuagauaguuucuauuagaaauagggugaaauagcugagaauaauaauaauagaauaauaacugcaucugcaacagcagcagcagcaguaguaguggugguacuaauggcaagagcuagcauuuauugaacacuaacuuaugucagacacuguaucucacagccucucuccccuguguuuuagagaaaaggaggcugagaacauacagaaauuaaggacaauuuguucaaagugauuugacuucucugaauagaauuuguauacagaauguaaugaauggaaauaggggcagagucaagaauagaaacccaaguagucugguucuagagucugcucccuuaucacauggauauaagugucuaaaacuugguagagaaaaguugaugggaagcagagaauuggaagugccuaauauauaggugauaaucuaaauccaugaagggagaugagauuauccaggcagaguuuggacugcuaauaucaccauugcuaacuaacuacuggugucauuuagugagcaccuacuauaggucagacauuaaacuaugauggugaacaagauagaucugaucucuacuccuauggaaauuaccaagaguuaaaaauaguaacacuuguuuuaguugugacguuaaaaugagaggagaucuacuuuggggaaauucaaagaguuggcaaugaaccuggcucaguuccaggagucaaggaacaccucuuugaggaugugacgucugagcuagaagggaagagacagguaacagcacaugauuuugauaagacaagucccaagaucaaagaacaagcuagugaaagcaagggaguaaaaaucgguaagguuuugagauuguccucagaacagggauacaaagcauucacucacuacuugguacagacaccaguacuuaacaauuucuaacuuuucuucuuuacaugauaaagugugugaaugagauuggauuauuugggcagaguccuuauagucauaagccaggagaggcauuuugccuuuuuuuccuuuuuaucaagccauaaacuguuauuuguuauucuguuugcaaauagccuggacuaauauggaagauacucccacagauuugccauuuucagcaaugguuauuuaccccuugaacaagagagccuuuuaccacccccacucaccuauuucauaucauauccuacagauuuuaaaucuauuucuaaauauguuaugauaaagaguuuugcuugaccaaacuuuagucauggucccgagucuucacagagccccauuuguguacuucauguaaaauccaauuuugggaagaacugugcuaagucaguuuagcaagaacccucccccuauacaauagauacuguguuccucauccucuaccacuccccacgugauaucugaucacccuggccuguuuguggcaagaauccuguaaggcugguuuagccagcauccccuguacccucgauguuucuuagucauccauugagccccacucugcuucuuggcuauaaaugccuucuugcccaccugucaaugaacuggccuugagaacaccugagucaaacucauuaauuuagcauucucuuuguuucaccccaaaagaaacucaaaacaaaauuaucucauagaaauacugagacucaagcauuuguagucaaugguaacaaaaagaacacuuuuucaacaugaagaaaacacaguccuucagcaucaauauauuaugucaauuaagcauauucugauuuuucucuucaaacuaagaucuuuuaagugauuaauaauguaaucuucaaaagcagaacacaaggauuucauuuaaaauacugaaauucagaauuucugauucuggauaaagaaaacauccuccaaaaaucuaacuaaacauuacauuuacuacuacaaauuuggaaaauacagaaaagucagaaagacaaaaacaauaaucuaauaugcuauuauccaaagauaacuaauaacauuugaauuuauuuuauucuggaguguguaugaauagguguguauagauaacuauaauuccauauauaauuuuauaucuuccuuuucucuuaaugcuauaggauaaacaagccauagaauuucaauugaaaauaaccuuaccuuaugucucuccucuacugcaaaaucccauugcaguggucccuauaccuuuugcaauguuccugaauaaagucguccuuaucaugcuuuaaaaagugucauugaguaauuuuuacuuuaacaguuaauacaccacaauuguguugguuuuauaauaauaugggacaauccuauguguuguaaccuccugaaacacagagagauuguggauagcuuauacuuuuaaauaaaauaaaugauuuucccuacacaaaaauucauaaguacaaaaacauguaucuuggcauauuuaaugaagagaacuguaacaaaacuauuauuuauaaaucauaaaacacuggaaugcuaauugccaaguuucaguaguuaggaaaagggcaguaaugcugucaauuguuuagcuaaacaaaauaaaaauuuucuccuaaaauaacuccucacuuuacgacucagaaucucuuaagcaaauaccagaacaccaauuucaagaaagaaccaaaaucacaugcauuuacaguaagcagaguauaggaauauuuuggcuaagucugucuuccuaggcucauaggaucauguucuaaaacuugcuuuucuuaucuuaaggcgaauuccagucaaagacugaaacugccauuuaaccuugcaucugcuauguuguauuuaaagauacuaagccugaauuaucaugauuaaaauucagugcauuauucuuccagaacacagacucuugugauguaacuugagaucugagcaggguuauaguuuagaagcaggccuauagguggaaaugguggacaauucaaaugccaaggagaagcccagggagagaggcuaugcugaugagaauggcaaauagagagcuuuuuuuccccccaaagguaacaucuuaaaaagguuagaaauguaugaccuuaaaaauguuagcaauuuaaauuuucccuauuaaugggaaagauauauugaaucauauuucccucaguuuuuaaccuaggguuuuuuuuucuucugaaacagauacggguguuuuucuuuucuuucuuuuuuuuuuauuauuauuauacuuuaaguuuuaggguacaugugcacaaugugcagguuaguuacauauguauacaugugccaugcuggugugcuccacccauuaacucaucaguuagcauuagguauaucuccuaaugcuaucccuccccccucccccaaccccacaacaguccccagagugugauguuccccuuccuguguccauguguucucauugugcaauucccaucuaugagugagaacauaugguguuugguuuuuugucuuugcaauaguuuacugagaaugaugauuuccaauuucauccaugucccuacaaaggacaugaacucaucauuuuuuauggcugcauaguauuccaugguguauaugucccacauuuucuuaauccagucuaucauuguuggacauuuggcuugguuccaagucuuugcuauugugaauagugccacaauaaacauacaugugcaugugucuuuauagcagcaugauuuauaguccuuuggguauauacccaguaaugggauggcugggucaaaugguauuuccaguucuagaucccugaggaaucgccacacugacuuccacaaugguugaacuaguugacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagugucuguucauauccuuugcccacuuguugaugggguuguuuguuauuuucuuguaaauuuguuugaguucauuguagauucuggauauuagcccuuugucagaugaguagguugugaaaauuuucucccauuuuguagguugccuguucacucugaugguaguuucuuuugcugugcagaagcucuuuaguuuaaugagaucccauucgucaauuuuggcuuuuguugccauugcuuuugguguuuuagacaugaaguccuugcccaugccuauguccugaaugguaaugccuagguuuucuucuaggguuuuuaugguuuuaggucuaacauguaagucuuuaauccaacuugaauuaauuuuuguauaagacguaaggaagggauccaguuucagcuuucuacauauggcuagccaguuuucccagcaccacuuauuaaauagggaauccuuuccccauugguuguuuuugucagguuugucaaagaucagauaguuguagaugugugguauuacuuaugagggcucuguucuguuccauugaucuauaucucuguuuugguaccaguaccaugcuguuuugguuacuguagccuuguaguauaguuugaagucagguagcaugaugccuccagcuuuguucuuuuggcuuaggauugacuuggcaaugcgggcucuuuuuugguuccacaugaacuuuaaaguaguuuuuuuccaauucugugaagaaagucauugguagcuugaugaggauggcauugaaucucuaaauuacuuuggguaguauggucauuuucacgauauugauucuuccuacccaugaguauggaauguucuuccauuucuugguauccucuuuuauuuccuugagcagugguuuguaguucuucuugaagagguccuucacgucccuuguaaguuggauuccuagguauuuuauucucuuugaagcaauugugaaugggaguucacucaugauuucgcucuguuugucuguuauugguguauaagaaugcuugugauuuuuguacacugauuuuguauccugagacuuugcugaaguugcuuaucagcuuaaggagauuuugggcugagacaaugggguuuucuagauauacaaucaugucaucugcaaacagggacaauuggacuuccucuuuuccuaauugaauaccuuauauuuccuucuccugccuaauugcccuggccagaacuuccaacacuauguugaauaggaguggcgagagagggcaucccugucuugugccaguuuucaaagggaaugcuuccaguuuuugcccauucaguaugauauuggcugugggguuugucacagauagcucuuauuauuuugagauacgucccaucaauaccuaauuuauugagaguuuuuagcaugaaggguuguugaauuuugucaaaggccuuuucugcaucuauugagauaaucaugugguuuuugucuuugguucuguuuauaugcuggauuacauuuauugauuugcguauauugaaccagucuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugccaggcuuugguaucaggaugaugcuggccucauaaaaugaguuagggaggauucccucuuuuucuauugauuggaauagcuucagaaggaaugguaccaguuccuccuuguaccucugguagaauucggcugugaauccaucugguccuggacucuuuuugguugguaagcuauugauuauugccacaauuucagauucuguuacuggucuauucagagauucaacuucuuccugguuuagucuugggagaguguaugugucaaggaauuuauccauuucuucuagauuuucuaguuuauucguguagagguguuuauaguauucucugaugguaguuuguauuccugugggauuggcagugauauccccuuuaucauuuuuuauugcaucuauuugauucuucucucuuuuuuucuuuauuagucuugcuagcggucuaucaauuuuguugauccuuucaaaaaaccagcuccuggauucauuaauuuuuugaaagguuuuuuuggucucuauuuccuucaguucugcucugauuuuaguuauuucuugccuucuucuggcuuuugaauguguuugcucuugcuuuucuaguucuuuuaauugugauguuagggugucaauuuuggaucuuuccugcuuucucuugugggcauuuagugcuauaaauuucccucuacacacugcuuuaaaugugucccagagauucugguauguugugucuuuguucucguugguuuccaagaacaucuuuauuucugccuucauuuuguuauguacccaguagucauucaggagcaggcugucaguuuccauguaguugagcgguuuugagugaguuucuuaauccugaguucuaguuugauugcacuguggucugagagacaguuuguuauaauuucuguucuuuuacauuugcugaggagugcuuuacuuccaaguauguggucaguuuuggaauaggugugguguggugcugaaaaaaauguauauucuguugauuugggguggagaguucuguagaugucuauuaggucugcuuggugcagagcugaguucaauuccuggguauccuuguuaacuuucugucucguugaucugucuaauguugacagugggguguuaaagccucccauuauuauugggugggagucuaagucucuuuguaggucacuaaggacuugcuuuacgaaucugggugcuccuguauugggugccuauauauuuaggauaguuagcucuuccuguugaauugaucccuuuaccauuaugcaauggccuucuuugucucuuuugauuuuuguugguuuaaagucuguuuuaucagagacuaggauugcaaucccugacuuuuuuuauuuuccauuugcuugguagaucuuccuccauccuuuuauuuugagccuaugugugucucugcaugugugauggguuuccugaauacagcacacugaugggucuugacucuuuauccaauuugccagucugugucuuuuaauuggaggauucaguccguuuacauuuaaaguuaauauuguuaugugugaauuugauccugucauuaugauguuagcugguuauuuugcuuguuaguugaugcaguuucuuccuagucucgauggucuuuacauuuuggcaugauuuugcagcggcugguacugauuguuccuuuccauguuuagugcuuccuucaggagcucuuuuagggcaggccuguuggugacaaaaucucucagcacuugcuugucuguaaaguauuuuauuuauccuucacuuaugaagcuuaguuuggcuggauaugaaauucugguuugaaaauucuuuucuuuaagaauguugaauauuggcccccacucucuuuuggcuuguagaguuucugcugagagaucugcuguuagucugaugggcuucccuuuguggguaaccggaccuuucucucuggcugcccuuaacauuuuuuccuucaguucaacuuuggugaaucugauaauuaugugucuuggaguugcucuucucgaggaguagcuuuguggcauucucuguauuuccugaaucugaauguuggccugccuugcuagauuggggaaguuguccuggauaauauccugcagaguguuuuccaacuugguuccauucucccagucacuuucagguacaccaaucagaugcagauuuggucuuuucacauacucccauauuucuuggaggcuuuguucauuucuuuuuauucuuuuuucucuaaacuucccuucuugcuucauuucauucauuucaucuuccaucacugauacccuuucuuccaguugaucgcgucggcuccugaggcuucuacauucuucaugcaguucucgagccuuggcuuucggcuccaucagcuccuuuaagcacuucucuguauugguuagucuaguuauccauucgucuaaauuuuuuccaaguuuucaacuucuuugccuuugguuugaauuuccuccuguagcucggaguaguuugaucgucugaagccuucucucaacucgucaaagucauucuccauccagcuuuguuccguugcuggugaggaacugcauuccuuuggaggaggagaggcgcucugcuuuuuacaguuucuaguuuuucugcuuuguuuuuuccccaucuuugugguuuuaucuacuuuuggucuuugaugcuggugauguacagauggguuuuugguguggauguccuuucuguuuguuaguuuuccuucuaacagacaggacccucuguugcaggucuguuggaguuugcuagagguccacuccagacccuguuugccuggguaucagcagcggugucugcagaaccgcggauuuucaugaacugcgaaugcugcugucugaugguuccucuggaaguuuugucucagaggagugcccggccgugcgaggugucagucugccccuacuggggggugccucccaguuaggcugcucgggggucaggggucagggacccacuugaggaggcagucugcccguucucagaucuccagcugcgugcugggagaaccacugcucucuucaaagcugucagauagggacauuuaagucugcagagguuacugcugucuuuuuguuugugugugcccugcccccagagguggagccuacagaggcaggcaggccuccuugagcuguggugggcuccacccaguucgagcuucccagcugcuuuguuuaccuaagggagccugggcaauggcgggcgccccucccccagccucacugccaccuugcaguuugaucucagacugcuguguuagcaaucagcgagccuccgugggcauaggacccuccgagccaggugcgggauauaaucuccuggugggccauuuccuaagcccguagggaaagcgcaguauuugggugggagugacccgauuuuccagcugccaucugucaccccuuuccuugaccaggaaagggaauucccugaccccuugcgcuucccgagugaggcaaugccucguccugcuucggcucgugcauggagcgcugcacccacuguccugcucccacugucuggcacucccuagugagaugaacccgguaccucagauggaaaugcagaaaucacccgucuucugcaucgcucacacuaggagcuguagaccggggcuguuccuauucagccaucuugcggaaacucucagguguuuuuauuuucuuucuuuuuuuuuuuuuuguaauaucuuuuuuuuuuaauuucauuauuauuauauuuuaaguuuuaggguauaugugcacaauguucucauucauaggugggaauugaacaaugagaacacauggacacaggaagguguuuuuauuuucaaaguaaaaagcuaaacuuaaguuaucauuguauuauguuacacaaucccauaauuuguaaccauaacaaggggguggagguuacagccauuuaugugugagcagaagccacggaaaauggguaaagccagauugccaugucuuugucauucaaauuucagugucaucaauaaagacacaggacuuucuucuuuaugcacauuaaauuaucuaagcuaugcuacucuaucuucuucuuaugcaggaugaucuagaauuuuuagaaagaucauugcuuugaggccuaauuugguucuugaagcuaauaaauuuuuucacauuuccauuuagcauacauuuaagaauuuuaaaucuuucaacaauaauuuacccaaaacauuucuccacauuaaauggauaaugaacauagaggauuaguuuguucaaaguuacaggucuucaagaacuauuuucaugccacaagugugaaaguuccauuggucuaucuaacuguucuagcauuaguggcaaucaauacagaugaacuguuuugugcaacauacugaaugcuuuauuuugaaauaugacaacucuucccggguguauucauauucugguuaccucaaauuacucuugaauuucaaaauacuguccugucuaaggcuauuaagugccaauaaacauuaacauuauccaguugaaggaagcuaucuuucagugacgcgugaaaauuguuuccaaccucugcuuaggaaauucuuuggaguggaaaguauaagccauuauuauuccuuacacuauaaugcuuuuacuuugcaauuuaaccuugaaaaaauaacauauauauucuaugaucaaaaauaaaacagaagcuuaguaaguaaauaaugcauaauauaaaguuagagaaacaggccauuuuccccuuucucuccuaaaucuuucacugcucuuaagagauaguagagcaaagugguuagaugugugagcucgggauccacugccaaucuugccugcaguaccuugacucauuuggugugugaccucagguaaguuacucaacuucucuuaguuuccuuuccacaauaguacuuauuucagacuauggcugugaaaauuauacaaaauccuacaugauaagcacuuagaagaguguuuaauaugcaguagguguuuaauaaaucuuagcuaucaauauaauuacaagaaccagauaccuuuucuuauuaaacacuuauagaaaaugcacuaucaaaguaucauguacuuuuaacuacuacucacaaguuacuauuauguuauaaaugauuuuaugugauagucuaucuauuaaaaaaaacuguuagauaauguggauauaauuuuaguuauuuaagucaaggucuuuggcaaguuacuccagacuucauuucucuucauuucuuuuuguaaccaauuuauuaccuuugagauguaagggagaaaugcacacacagacacacacacgcaauauaugacagguucacguuauuugugagauguuuuaaggagcugaugaauuaauuauaaauuuauuugacuuuguuaguuauacuuuacauauauaggaccauuuuugguuggucauaauuggcuuauaaucaagacuuaucaaagauaaccaaagaauaucuuugauaagucuuaugugaaauaauaaacauaaugauaaauugauagaaauauaccccccucuuccauccauuuacuuauuuaucuguauuucuggaacacauuuuuugagaaucuuuggggaggaaaaaagcuuucauuauauagcagauauacuuaauguacaguugaaaaaucaaacaaauuucaaacucauuuuuuuaauguccacuuuuuagauguucuguuggcaauaaagaaaauauauuuauuucuuaaaagauuacugagauauuauuuggauuuuucucuuaaaauaauuaaauuucuuauguaagaaaaguuaacagggaagugaccuauugggccuuaugauauuuaaagaaauaaaaaaaaaaagcaccguuaugccucaaaaggucaaaugugaucagacacucuguuuauuauucauaaugggagaguuaaaauuuaaaucaaaacagggaaugaaauguuaaugagugcuuauacauucacacuaaucauugauuacagaaggaggguuugaagucugaaacacaaauuuagugcccauuauuuuuauuuauuuuaaagaaaauaauagauuaauuccagagacugcacagcauuguaccugacagcuauacauaaaaauacagcacucaaacauggacuggcacuucaauauaauuaaccaaaaaugaacuugaauacuuauaguagugauggauuuuuaacuagaaugaugaucuuaucucacgcucacgaguauuaguggacaggaaccugaggcacagggcagacccaccagaagugcccagaguuaagguagauauaauuuguuuugacuuuauacuucagaguauaacaccuagcagcaaugacaggauguagccagagggcacuugcaaacugucugaaagauagagccaaagcuucaaaacagaagacgccauauaugccaugagucaaaggagcaaugugggggucaagaaaagaagauaaagccaaaagucaugagucugaaaaaaaaagcaggguugaagaaggaggugaagaagaaaagagggaacuagagagggcggggucacuaguuggugcucugagaggaacauacuacccagagaguuugaaaaucaauguaacuaaccaagcaaaugugaaguaugaucacacaucaaguuugauuuauggugcgcaucauaaguuuuguuaacugucacuccuugaaggcauuugaguuuacaaccccuggggacagugcuuaauaaaagauuagaaugucuaagguuauuuucaaucgaaagucaauggcuuguuucauguaugucuggcucuuguuuaaaggacagcuuagggauuaggacaaggaaagaucugucuacauucauuagaaucauuuggaauguuucaauugucaauaaaugaugaauaaaagaaaaauaaugucuugugaaaaaaagugauuguaagauguuuguguuacauuuuuuaacauguaagauugucaugaugcaaacaugagaaaauagauauaaaaggaaaauacuggaagaaaaaggcccuguacaaauguaggccauggcaauaauugucuuuuuugcauuauuuugcacugagaugggaagauauuuaaaguuuugauacaaucuuuuaaaucaaagaugaaaaauuaaaauaauuuuuuuaaaacauaaaauguuuacaguagauuuuuccacuuucuuuagaugcuuguaauacauaaagugcuuccugauuuagggaagcagugaagaauaaaagggguagucucaauuuuuauaaagaagcuaauuaccugacuuaccugcucuguuuaaucucuacuguaauaaccuagauaauuaauauaaguagguggauguugcugcuauuugcccagcugccaacuguacaaaugccaauguguaguguacuucagucucuucccauuucucaucagggcugaaaguaauuuaaauugguucuaccgcugauaaauaguauucuaugcuauuuaaagauauuacacaaaaucauuacagagauucaauauaaaaugauuuugaguauaaagcuuaaacuauguaaucuccuuaucauccuuuuacauucaacuuuuuuaaagggcuuaucuuuggauaccaaaggaaaaaaagagauuauaauguuuuuauuuuccaaacugaugugagaagaggauugugcccaucaggcaacacuguccugguauaaaagauaggauaucuacaaauugguuagauggcugugguauaagcaaaaacaaagcagguggcauaaucaugaagaaaugguugggauuuugcucagacaaaaguuuauuuuccucucuaggguaaaauauucaacaacaauuaguccuaaaauuagaaaaaaauugugggaauaaauuauaauugcacagaaugaucaaugauggcaaaugugaaacaguuaauauuuguguagcacagggugaaaguacaaauggaagcuggcaugccacguuucuaaauauuuaagucaaacuaucaaauuuuaaaguaaaauacauuuuugaauuguagcugcaugauauccuuuucuuuccacuuuuagcucuuuucugcccauggggguucuugcccacaugcacgugacaugcuguacauguccacacuccaucgacacccccacaaacagcuauucccuuggccacccuuggauguauggaguuacaucugugguggggggguucccccuuggagaauguaauggggacaagugauccauuggcccagaaaauggggucaggggaguuugagcagggaauuauggggucuggacaccuggggaaugaucuagaagaggggcacaggcuccugcuggaucuauccccuugacucuauaaacuccucaacugguagugaggggagcagcaaaaagaaggucagaaaggggacuugaaauagcaggauguagaacagauaccuucauugcuuguguuuaagaaugcucugguuuauuauauuuuuuuauuuuaucauuauuauuuuuugagacagagucuugcucugucacccaggcuggagugcaguggcgggauguuggcucacugcaaccucugccuccuggguucaggcaauucuccugccucagccuccaaguaucugggacuacagucauaugccaccaugccuggcaaaauuuuuuuuuuuguauuuuugguagagacaggguuucagcauguuggucaggccagucuugaacuccugaccucaaaugauccacccaccucagucucccaaaguuuugggauuacaugugugagccacugcgcccaaccugguucauuuuaauaagugauaauauauauaguguuguucuacuuacauuuaacuuucauguuucuaaucucauugacuuuugacaaacaucccugugagguagauagaaauuaucaccauaauuucauagacggggaaacugaguuguagaggggcuaaaugauguacuaaggccucacaauuaguauaaagcaguggcagagcucacacccagguacucccagugugggaucccuuccauuguaccugggcaggggcugaucaaguuugcaacaggcuucuauaccagacagucaaugcagugcucaugucccaagacuuuugaaugcucaaaauggggaaaaaacccuuuuggguaacacuuacuuaacuuucucaggcugaaaugauuaagggaaaucccuccauuuacaccaagggccuaggucaaaaguuugcaucaaacccuucucuuuagugcauaguauuuuagaacgucacucugcucagagugcuuucugccacagcgaaacaugacgaggcacucugaaacugguucugucagacccuuuuccagcagucuuaggaucuucucuauuaaaauaggacaguuucaaauuugggguguauugcuuagcuacuuugauucccccuccccacguuucuauggcaaaaguagaaacaaacccaaacuaacuauuccugucuuauugacccaucucagaaccugauacugauauaguccuauguacacauauagaauguuugaucauaaagcaaacgcacacugggcugccuucaucaaagucuggucuucccgaaagaaucagauucuugcuaauuuguuuacaguguuugcucuuguggcauggucccacuggauggacucagugauuuucaaaugagauuaguaguggguucuuuuuuaaaauaaaucuauguggaaaacaaccaugucacuaacaaagacaacuagauuuguuuuggaagaaacaaggggaugaaaugccuaggcuacuugccuagaacucaaaguagucagccuuccccuuaccucuaggggcagacacugaugcaccguaggaccccucuaaacacugugugaaaguaucaguguagcccauuuauuccauaggcaaguaauucagcuucgagacauucaaaguuuuguuuugauaaaucauugauguagguauaucuaaaucuaggcuuauaaauccaaguuaaaaugucaagaucuuguaugagaugugaauaggcuuuggugaugauuucuauuuggucaugguugcuauucucuuuaucaguauauuagaaaaaaauaugacuuuugcuucuuucucuugggucuuuguuauuggauaggaagcaauuauaucccaagagauauaaauuuauuacaggauuucaguuuucuuaaguuuagcuuacugcaccuugaguuucagggugcauagaaaugaucuuugacaugaacagauaugaaugaaaagauguaaaaaaccauauuaucauucguuccaauaaacaauuguucuaaacuguaccuagugcaaagaaagaauccuuuaagauauaacugcuguaaaagugaaaaauuaugcuuuuugccauacuuuacuaguaucuauguguagacuuuauaugcuccuacacauacauaaucccuagggucacauuuugccacuaauuuauccugggaaguucaucaagaaguuauacuguuagaaguuagguauuucaaggguauagcauuggaauuuuaaaacagccacaaaagcugauuagcaaguggugcucugaaaaacguccagguccagaucaucuucaaauuuuguaguaaugauuuuucuuguauucaugugugagagagaaggugcaggguggguuggagcccagugagaggaauguagaguagaaagaaaaauuuugaggacugacuuuuucaaacuguaccuauauacugucuggagaaacugaugugcaguucccccauccaucucuuugaaaauugcuacaugaaauaaaagauauguguuuggaguguguugcgugaauauuaugcaagggaauggggagacacauacaaagucuaaucuugagguuaaauugaaauucagauaguucaaagacugaauauauuacagugaguuucauuaguuuuucgcuuuacugacauuaguuaacuucaguauaucacuaaauuuuuuuucuguacauguaggaauuucagcaggguuccaaaauaagucugguagcauaucauuuuaaaugauaauaauaauaaaauggccaauauauauuuuuguacugugcauuaugcuaagaaugguauuuuaaauaugaaaagguaacacauauguuugccaccagaaauuucuuguagguugauuauuuaaugccuaaggacauauuuucuaugcaugauuauaagguacagacaugcaauuccaucauaaacacaaauugucucauauagaaaguauauuuagaaacaugaccccacauuaacucagaggcuuccuguaugucuaauacuauuuuugaauuauuuucucauuagaaaauacugauaguggaaagguagugucaauaaaaccugauguacuauaauaaaaugcagucucuuauuacaaauucucauaguaaaugcaucaacauuucacucaugagauaucacuuacuaagcaugccaaacuauuuuguaccuacuauaaaacauaauguuagcaaaauaaaaccccaaauggucaaaacugaugccacgaaguaacuauccaaagcucauaacugggauaguaucuucagucuaacugugaguaauuuguucuuauuuuagacacauuuuuuacaaaauauuuguuaaauuuuauagcacauaucuuucuccacaggaaauucacucccaugcaccuuuaagauuuacuucaaaacucucugcuuuaaauucuuccauuauccauugaugcugagcccuuuuaaguccuguccuggcccauccuaccuugccaaaauccaggaacacaagccacauuuuccggagaauaaaauccuaauaauugcaauuagcacacacaaauuguaauuacuuguuuauaucucuacuucuuucucaccugacaacucuuugaaggcuaagaccauguuucauuuaucucugaaucccuagcauauacacauauacaaugugacuaacacauuguauaaccucaaugcauauuugcugaaauaaauugcauuugaaauagcauauuacagauggaaauguugaaaggggagguagcaauaggaauuauaaaaaguaagggcaaacagucugaaugcaaaaaaaaagagaacaacuaugaaaaucagauaacagaacucaaaguucauugaguguaggagaaaacgguuauauacauuucaguaaucucucaugguaucauagucuuaaagcacauuaaaauaaugcuuuuucauagugauuauuugggauuaaaauacucuguuuauaaagacagagaaauguguaaugcuugagugaaaagcuuuagguauauaaaaaauuauaaaaauuaucugacaguaacagaaaacuaaaauauuacuaagcuauuguuggccauagcuaaugcauaacaagucauugugucucagguuuguaugaagauaaggagaaaaaugcuagucuuuuaaucacucaaaguuuacagaaacaucuuaaauauaguaaaggugaaaaacaucauuacauuugauaaucuugaaaagaaauacuaguuccauaauaugccacuucuuuuaaauuucuuauuagaaauauuuggaguccaucucaaggcacuaugcugauccuacacugcauuacguuaaaucuuguuucacauggcgaauuugaacaaaagaaaaaaucguuauguggcuuaauaaauccaguuccuugaucucaucuuuuucacaggauaaacacuccuauaauauuuauauggggauguuacuuuauaaaucuuauggcuaaaauauuaaucaguauguucaccuaaacuuugguaaagagugcuacuuucauuuucagcaaauggaaguaacagugauauauuuucagcaucuuggugacagacaggaugguauauccugggacucuugacaacugaagccacugcucuccaugaaacccaucugcagaccucucuuuugauaauuuaagcccaucaaugacacuucaugguagaauuaugcuuuuucaaaggcaguaaagauaagucuucuccauaggugguaccuccugguuaucacuaaggccaugaagagcacagauuuuuggaaaaaaaaaaaagagagagagagaaucuaacagauauauuggauaccuggauguacuugguuagaggauucuucuaccuaguaauuaugccaugcuagucugucuuuguccuuuaaaaucaccccauuuaagcacaccauuucuuucaaaaagccuucccuuuuguuucccagucuaguuuagauccucuuuucuguucucaaaaauccaugcacaccucugacuuaacucuaacugugauauacugaauugucuuauuuauuucucuuuucaaucaguuggaauaugcuaagugaaggcaaaagccaauuuauuugucuuuuuaucucuagauccuaguaaagaagucaucacauaguauguuuucaauagauguuuguacaauuaauaauuacugacugauaaauaaaaagguucuauuucauuacaaauaaaauuagagcacccgauaccaaccugaaauuugacaaucauuugaaggaguguuguaauauuuaaaaagaauuuuauaaagauuuuguuuuuuccuucuuucuuacauuaauguuguagguucauuuucuaaaguaguugugucuuucuuaaggaagauucugggaacuguuguuaugaauucauccuaauuaucugagaagcuacuuagucuuauuuuuucauuuucauauucauguaagauccagagacuucucaaaugaggauauaagugacugaaagcuuaggucaacaauaaagcagaaaaaccauaucaacaccaugauccacuuaaagugccuuaccuuuagcuauauccucuuacuguccucugaaccuacauucuaagugccaccauguaauuaauucaacaguguuuauagaauggcuuccacaggaaggcacuguuccaggugcuuauaauaauuauugcacucuucaaaucgcccaaaucuaacauaaugacaugccaaaccccaucuuccucugaaacucuuuagaugcuuaaauaccucucugaaaaauaucacuaccguagcauuuaucauauagaauauuauuuacuugccaguuuuuucuuucauuuugugaguuccucuagggaagggauuaugcauaugcugcauucucaggaccaaauucaauaaaaggugcuuauauauaauauauaaggugcucaaauuuguugaauuaauaaaauuguguuuagcacaauaaaacuagcauggauuguuaugccagaacagugcugacaaugaagacauagcagauaaaaacuaaaaggucauacuuuuaaaagaagcauacuauuucaauagacauuuacugaucaucuauuacauucaagacauuuugggaaauaaaaccuaaaccaguuauuguaccuucccuucaggggcuuguggucaguugaagauaugcauauaagugcucuacuacucaaccgauucugauaagaaaaguggggaugaauaaaugcagaaugaagugacuuccaggaagacguaauauuagaaccaaaucuugaaaacugaguaagguuucauaugggugagggaaagagauauuucaggaaggaaguauaaauaguaaaacacacagugacaugucaggguuuuucuguucaggaacauagaauguaacacaaacaaaggguguuagguagaacaaauguaaccaucauggcaaaugaagccggaaauuuaagaggagagacuucuaagaagauacagaaaauuugguauauccaagcaacuuaaugaaugucaacuuauagcauuuagagcagucaaaauuggcuuuuaaagcacaucaucagcaccuaacucaggugcgaaguguacaaacaaaauagcagauuuugaggugauggagcacacuggaagugaagcaguuuugacuguuuugugugaaccagcuuuguaaagaaaauggaagacaaaugcauauaaaagacacaucuuaaaaugagcugaauguaggcaggaugaaugaaguaaaaacacuaccccacauaaaacaaaacuuuauuuaacaguaaacaagagguuuaaggaaggagaguaugaauuaguaauuuuggagaacaacaugagacaaauacaucagaauaauaucuugauaacuugaccaucugagggacuauauaaauugcaaaggaauaaagccaagagugcauuuauugcuuuguacagaaaucucuaccaaacugacugaagauuuagcuuucuugccaagugaugagaaaacaacugacauaccuauggaagagcagagaauacugaccauaguaaacccagaaaaggaauuaaaaauaaaagacaaguugaaacuggaugguaugcaauggggauccccuuucuuaaguguuuaauuagaauucauuucauuaaaccacagucauagaaauuuuccuaaaaguaauucuucuacuguuauaagaaaccccacaccuacugucaugaugauuuugauaaacacaaauuacuaaucacuuacuuaauacuugauuuuguuucauuuuacuuucucuuaaaaucuguguuuuagguacauuauaccucuucuuuuguugaauucucacaacucuaacuuacacauuagguucuaucauccucauaauacagauaagaaaguugagucucagaagugcugaguuaaugcccaagaucucacagcuaauaaacggcaaagcaaaggcagguccagcugaaauuauguauacuccacagcuucaaacgucccacguccagaauugaucucccaauuuucacgucccuacccaccccaaaauauucuuccuguaggccucuuaucucauuagaugacagcucuacccuucuaguuguucaaaccaagaaacuuggagucauacuuggcucuucucuuucagacuccacauccaacauguuagcaaauucugucucagcuauucagaaucagaccacuucacauacuucacauugcugcccuuaugguccaagucauugccauauaucacaugaaacugucugcuuccacuuuguccacuacaguuuaccauaacagagcaucugcugugauccuuuuaaaccuucauucagauagcaccauuucucugcucaaaacuuuguagugccuuccuacucacucuaaagcaaagcccuggcacuggcuauuaaaguuguaaaugaucuggcccugggccaccucuuugacuuccacuccugugacccucccucucugcucucugccugcuuacuguuccuugaguaugaaaucgugcuucuaccucagggccuuugcacugcuguucccuuugugugaaaugcucuuuugcaggcaucugcauggcuugcuccuucaccuguucagguuucugcucacauauuagagaguuuauccuugaccacuguauauacauuauuaaguccugauccacaacucauuccacucauuuucucccuuaucuuauauuguccuuuguagcacuagaauccagguuccauaaaauccgaauacguuugaaaaaaauaauguuuaagccaggugauguaugagaaagaugaucccacauagcauacacuaaagcaaucucccacauuuucucacugagauacccuggguaacuacuuuuuauaugauaaguuuuucaugugaauucacuaauacacucaaaguuuuagagauugccuucuugaaauauaggaaucagaaaaacuggaagaaacguuuuucuagccaaaaauuccauaauaacacugaugauauguauaucuggcccauagacugagguuuacguaaaugcuccuuccuucaugaagcacugccugauccuuagagccuacacuguccgcuaccuccuucauauuacaguaacccucuuacucuggggucauauucuauuuauacacaaacacacacagacacacacacauacacacacauaauacauacauauguauuuuggacacacagugaguacuguggggaaacuggcucugcuucagcucccaaagguuugcaccguugguguggcugugcauuguuauaguugagccugggcagccaaaaugugacucucaaaugguuuugggggacacauuauuagaugagaaaucuuaagaggacucuucaugagcacucaaaauaccuccauaacuguaugaaucacugaagggaggcuguaggcacuauguucugcugugggacaugaagcagugaauuugaaguucucauugaugaugauauggccuuguuugcauuccucaauuggcaaggccuagagaaauuuggguuaugauagcaugagagaaccacugaugguaaaacucagaauuagaguuaacaucaaaucaaaccguuucaaaguuugccuggcauuuguuccauuuaucugugucucucuguggcaauaugaggaagcacaaugaguucgcuugauaccuguuuaggugcagagagaaacaugcuuguaagggacuugccuuccauuaauggagacugcuucuuuauuuaggauuuaaacaagcuaugucuucucacuuaguuaaaugaaacauuucguguuuugugggcaguuuagcuagaaucuaauuguuuuguuuucucaaggaaaagcacucuucuuccuucaugagggauuaguuugaucugguacuauuagacaaagaaauuacagagacaacauuuuucugaguuaauaggguuuaagucauuuuuuuauuuugauagccuaauauaaacucucaugcuacuacaaacauugcucccaauuuaaaaaugaagagauucaccacucaucucuuuucaagacagcuugaaaacacccugcuaccuuuuuccaauuagcuuucuagcuuuacugagucugaucaagaguuuugagcugugucucuacguuuauuuauguuucagagaaauguucucuggugcugucuuuagaagcagaucaagauagagcuuacucuauugcaaaaaaaagucacugaaaauuucaaaaacuuuuaggcacuguuuuagguacugggcauaccacagugaauaaaacagacuauuguuugcauaauauuugcauaauauuucugcauauuaugggaaggacacagguaaacauaauauuuauagugugccagguggugguggugccauagagaacaacaaagcagaaagagggaugaagagaaccagaguuggcagggaugggcgugugccuuuaaguagguuggucagugacggccgcagugagacggugacauuuuagcaaacaccugaaagcaaugcaggaguaagccauuuagauauuuggaaaaaaaaaauccaagagcuuuuuaggcagaaguaaguaaggcggucuugaggcaggaagcugccugggauguuccauaaaccucagggaagccagguagcuggaacagaaugagcaaggguuggggggaauggaagaagugaugucaggagccacagggaaagagcuggcaaggcggggagcccacaugcuguaggaccauugggauaacuuugccuuugauucugaguuagagggaaagucacagaagagcucugaggagaaccgagccaugaucucacuuacgguuuauauaauaagaaccacucuuguuguuuuguugaugacacuguaagagagccagaguggaagcaagggugcugccauuugugccgacuacacagcugauuaucauuauucaugguagugauaguccauaaaaucacugcaaacacugaauucacugauauucaaucauuguuccuacaagaaauucaggguuagguuucugugaggcuucggucacuacauuuucaucaacagauuaacccguaaacuuguuuuaugcauguuucuguuuauagaaggcuuauuuaauauauauuguggaugcacaaacauuaagcucauggcaacagcacuauaauucaagugcgaaugagcuuauugaacacacauauuuucuccauaagacacaccacagccuucuugcacuuaggaguaucagacagcacuucagcaccguucagugucauuuuaaaaagcaaagucaccaacuaaagaaagcacgaaaaugcaaaaaacaugacacugaaaaaaggauacuuguuuacugcaugagagcuaaaacaagaugauagaauaucaccuuguuugaccucagcuggaaacuuaagcaucgagcaaacucaaauuuucaccacucugugcauuucugcaaaugaccaugaaaacaaugcaagaacugauuuggagguuacaaauuacuuucagugaguaagccaauucucagaugcagaaucgugaauaaugaggauugacuacuacauuuuguugggaugcaauucuccauuucauuucugcauaucuggggacaacuuucauccuggacucuuuucaaggauguuuguaaagccaacacacuugggagauaguaguaccuuucuucaggugcgaggucaguuuuuugcuuuuuuuuucccccuguggauaagagagauaauaucucccucuggggcaguguuugggcagguuuucuaacagucucaguguaagauugggggcuuucuaaaugcccucugugagcaggauccaucugggccugucuuuguauuaucugcaugggcucuggagacaaggggaacuggugaaaacauaaggcucaugcugccugugcuaugcauaauaaacucuuguuucugacccaggagucuugagucuucuguuagcaucuaugaaacuguggcaggcuaacuugguagauugcaagucauauaagaucucagacugucacaauuuuugacauauuuauaauuuuaaacuuugauucuuaaaauauauuuuuaaacuuuuuacucacauguugugggggagggaggcagauacgcgacuacugcuccauuugauagagaguauuucucauauuucuuuacagaagauucaaucaaaauaauaagauaaggcauuuacuccauaaucauuucuaauacacaaauguauauuugaauuaaaucguaccucucugacuuccuuuuuuucucauuaugaaauuauaaaaaaggcuccuuuuucugacuucaagcaccuguaauauaaaacuucuuugggugacuacauguaucugcuggcauaucaaaauaauaucauuucaaugugguuucacuuuaaaaugguauaauuugagaaauaaccauaauuuuacauguauaggagcuguuuugacugggauagcauuuuaacugacauuaaaacacugaguaaauguagcuagaaauacaggauacccgccacuuuucacaugcggauauucuuuguuagaaauaauucauauggauaauguucuuaaauucaacuguaauuauuuaagucuucuucuauaaaaauuuuuuuuuuagaaaagccuccaacccugcaucagaaaaaaaaaaucacgaauagugcuuuauuuuugacacuauuaucauaccaaugcugguauucauguaaaauaaugagucaugugaaagcaauuuuuuaaaguaaauuagagauuccauuaugaaaagagggcauuaaaaccuuaauugaaaaugauauaauacaaaagggucagaucuuauaucuugaugagauuuucgcuuuaagaacuaggucucccaucuucaguacugaguccucuuaacagugaagcuuaauuuaauauuuaaaagagacugagaaaccaauggaaauucccacugaugacucagcuauguuugggucugcaaucugccuauuaaacuuucauuauaucucuucuuccugaugucuuauucuagucugccaaucauucacugcagggaaauuuauggcagaaugcaaaaucuaaaaaaucuaaaaaagggaauauaaucuuccauucaucaucccuucuuaagaccugacaucuaucaaauuaaaauuuucucuuuuaauuucagaacuuuuuauuugucaaauugaauuuuaacacauuuuuuuaaguuaaauauaauaugaugaacauaaccaaaagauguaugggaaagaauacuaguaauucguuggugaauauauaaucugugucucucagccuauacccacaauggagccaggugugacgacaacuuuauaaacaagcaguauucaucugguccauaugcacccauaagugugagaccuccagccucuguaaauuuccuuucaauuaauucugggaaucaccugugcacauuuuacaugcacuucuggacuuugggaugucauauggcccuuuuacuuccaguuuuuggcacuuuuuuuuuuugccugauucuaagaccuuucaaaacuuggaagccugguaaacaugccuccuuaacuuagcuguugcugccacugcugcuaaauugcuacgcuagacugucuuccuggugacagggcugcugcugcuacugggcuggcucugcccuuaaguccauuaaggccuccguucaaaugcuugcuccagggcccuggagucuccccagaaguguggagaaaaacuuauccucugagccaugcucugcuaacugauuacaaagguuuguuaacaugugcucucaaguucuugcacaaauuuugaguaaaaauaguuuuuucaguugcuucguucaguuucccuauauaaaaacuauucgcuggagauugaacacuaugaaauucuaaaauugcucuuacccucuaauaaugggggcaaaacuauucagccaagcauccucaucccuuaugacucauucauucucuagagaacuacucagaaucugaaggcaauauaaugcugauggcuuauuuugccagucauugagacugguaauaguagaggggaugagagcauggacucuggagccagacuauaaggguuugaauaccaacuccauuauauacugcucuugugaucuuggguaagcuacuuaagucacuuaaccucuguaaucuccaguuuuuuuuauuuguaaaacacgguaguugcaaguaacaagagguauauaaagcucuuagaauagugcuuggugauagcaugccuuauauugaccuuugcuguuaaaauuauuuaaaugguauuauuucaauauuaaauaaauaagaccucuuuauuaauuucuaaaauuccuguaauuuuauacuaacuucuguugaugcuccaaauaugucuaauuguuaucuuugucuauuuuugaaaccucuuauucaccccaguguacugucauccuauuucaauuaccuaccagcuaaagucauugaaauuaguccaacaggucagucuaaaaugauaggguuuauuuuaugcucuaagauugauuaaaaaucccauuauuauaaauguugcccuaagauacaaguggcaaacauaaaaccuuguuuuuugcuucugaaaauuccuaucacuguuguuggaagaagguaagagcaauaaccuuuuugaacaggaucccaauggaaguagaaaugaaugguccauuucagcucaacacucauucugaaaacgauccaggucacugacucaguacaaaugaaguuccucucuguuucaacucaauuacuaaugaacaucuugauugcccucaaaagcaaauuggcagcuguauuggguucuacaagaaauuuguaccuuaggcaaucuagcuauagacucuguccucaauguagcuuggagacagucccccaaggagaggcuuaaguagaacauuuugaguaagaacucagccacagaaaacaaacgaacaaauagaacuagugguuugaguuugaguucuuugaaguuggggcagaagugacuggaaguagagggaucaguuuuuuguuuuuuuuuuccuccuacaucuacgcuugagccuuuggugcacagguaugaaucaaagaguguaguauuacuugguuuuuuguuugcuuguuuuuaugugugugcaugugugcauguuuuuauccaggaugacauuacgauaaaaagauuuaugucccaucaaaucgaauaguuccaugauagaguauuuaaaguagagaaaaauuuuaggauuuggugggagcuccucuguaucuccgaagcucuauaacagugguucauuuagucaaucuacaguuuaauuucaguauucacuccuuauuuguuaaaauauguacaguauccuaaguauuacauaugauauacaauauucuaaauacauuaaaguauuauaauuauuaagauaaagugaguuucuaccaauauacaaauacuuaagaaguagaagcagagauuuauaaagaaauacugugugaaaagaaauaaaaauaugaauaaaauaucaucugaagguagggcuagcuaaugaauuucuuauucuuaaauagauguuaucaauguauauuauccuagguagaguuacuaaaaugccagacuuucuauauauaccaaaggcccagaacauaccaacugauaacacauugacaccuuuucccucuagggcaguaaaccaucuuaucacacuguuaaaacuaccugaaaaaacaaacucaugugagcuugucugaaauuguggauacuguuaaaaagucucaagaaaaaauugaaccucuuauggaaaauucaauugaaaugacagcuggaauuauuuguuuuuuuuuuuuuuuuuuuuuuuuuuuugaggcagagucucgcucugucacccaggcugaagugcaguggcgcaaucucggcucacggcaagcucugccucccggguucacggcauucuccugccucagccucccgaguagcugggacuacaggugcccgccaccaugccuggcuaauuuuuuguauuuuuaguagagacgggguuucaccguguuagccaggauggucucgaucugcugaccucgugauccgucugccucagccucccaaagugcugggauuacagacgugagccaccgcgcucggccuauuugucuuauuugauauagguauuuacauguugaugaauaggcuaaauuuacuuuauuuaguaacagacauaaucaucuguaguagaucuaagcugacaauaauuuuucaaaaauagcaaauagguuaauuaauacaaacaaauuaccuaauauauuuuagagcuuuucuugucccccaaucuuuacacuuuaugguacuuauuauucucaaugcccccauagacuguggaauacaauuaagguugaaaauauuuauuuaauauuuaaauaguucccacuuagacaaaauacauuuaucuguucuaauacauuaaauagaaacaauuuaguagaaugacuacugacuccaguaaacaauuauuuuuuucucagaaaaaauaauugacuccuagaaucaauuauuuuuauuauuaucaaauaaaauggauauuuuaauaaaauuguuaauguuuuaaacuugccuugauguacugaagauacauuuauauauauauaauguuuuuaugauauauauugcauaacuuuugaguucuuuuaaguaucucagcauuuuaauauucaacaagguauugcuuuuaauauaaaacuuguuuacaaauuugaaaacuaugcuaaugaagguauuuuuuaaauuaaaaaaaugcuuucugaaucccauugguguauauaucacuguaaugacuuuucugaguguacaucuagaguuaugcuauuagucauaugguacauaaagaaucaauaugcaucaaaaagccauuaauauuuguaagaaguuccaagacaaugaguaggugagacaaugagggauuuagaacaauuuaaacuuccuaaagcuuuccaaaaguaauuuuaauauuuuguuauaaagauucaaacagaaauaaaagagucauccuuaauuuggggucuuaauaacauucagauuaaacacaacaucuuuagaaagaauuaaaucuuauuucuagaaauagaguaagcaaguagaugaccuaucuuucggcuuuuacaauuuucuuacuuuauaauuucuuccaguuuugauaauuacucuucaucauaacuuucuuuuuuuaaaaaaagaaaugauuuuccaaacaguggaucuguuagagauuuuucauguccagcauaauuucuugaauauuacuuuaggaaaauauguggagaaacauaugaagugaagcaaauucauaaaguuauauaauugccccaaagacaagagcaacacagcuuagauuuuucuguucuacugaucuguggcauuaauaaaaauguuuuagauuuuuguauuuuauaauuuacuuuugauaagagguuugaaaacuaauuauuaugucuuauuuaauuuucuuaucuuaugcuuuaugcaagucuugaaauuugaggaauccuaaggaagggccaucccuaucggcagagaaauucccugauucccaaguggauuucuaugguacuuauaugguguucaguucugaaguauggguaagaucaaaagguagagaaaagagcagccaaauggggcacaggucuuuucagauuacaugcucaguaguuuaucaagaaugauaaaggaucuggauuucuaauuaguuccucauaguuuuuauuauuuuuggucaaagcauguguuuuuauuguuguucaguaggagauuucaugcuaaaauuucucucaaugacagcauccauuagcagagucuacuuaaaucccugguuacuggaaaggaaguaugugauacucacuuacucacugacacuggggcaguggaauuuucucauucggcuccuuaucauuuucaaaaaauuccaauccuuuuuaugaauggguuuuuggguucuauaugucuauuuuguaauccuacauuuuguuggccuuuuaaagcauccauuuauaugcauuuauucuauuuuuauucucuuguaucuauuguuuuauuaggcaguuucaauauucugguacuacauaaguuuuuuuuccccuuacucaggcacuauagucuguaauaauagcaaucaaggcaguucauucugacaaauaugugucagaaaaagccugcugugacuuugaaauauugcaagugacugacaacauaaugugugaagcagaauaaaugcauacaaauggaaguuuuagcugagcagucaaaguaugaacuaaauacagcaucagaacucggcccugaaagcucuuagugccagugguuacaauggcaaauuacuaaaugcacucugcaaaguguuuuaugaauaaagcaggggccagaguuuuaucauuucucuuugugccugggcuucuauuggaagcaaaaugaagugauguucccuugaaaauuuccugguauagaaagucacacaugguuuaagaagauaaaugcaguaaagcguaguugggaaauaugaugagagagagaaaaugaucguggauaugaaaaggcuggccacuagacagacagacaucugggcuacaauaaguccacuuauuaagaaacacccaggaaauaaaagaaaaaccuugacuggcaauuugcugaaaucuaucuuuauuguugaaaagcuuacugacauuuaaaauggagugcuuugaagaaaaggauaauaaaaauaaauccuucuaauauuugaacauuucauagauggcaaauaaaguuuucccaugugugagacucacugacuuuauauacuucuugcuaacuccugcuuguccaaagguagagcuccuaagaaaaucagacacgcugacuauguauacuuuccagcagagauuauacucucaucucagagaguaaccacaucuuucaugcacuaaaaguagguuguugagacaaagagauugacuaaacagucaaacuagugggugguaaaaaucucuuuucuuuccccccauuuccacuccuuccucuacuccuccuuuccuaaucuuuucucuuagcuaacuacauuuagaaggcaguuuauucuucuucagggacgucaaggcuggagaugcaaguuaagaggguuugugaauguuguguuggcaauuuucacacauacaaaauagcacacuucugggaaguguuuaaauauagguauuauagaaugugccucaauccauguucuucuuagaagugugaauuaauuuagcauucucggguuucagaguucaagaguaaaagccugagauacacuggaguuggcaggugccuuaggagaaguugccaaauauauuaacuaauaaaaacggaauuugccuucucuuacaaauauggcuauuaugagaagacuaagcacugggguggaaaugugacagcguggaggagacucagagauuguucuaacaacuuuguucucacauuguuccuuuauuauaacucaaauuuacguuuccaaacuuuuuccccccauuuucacuguauuuuagguugguaucaucucucaucuagauuaaauuucugacuggucucccagcuucaaagagucuugcucucagacaacuaauaaucaacacugcagccagagugacuuuuauaaaauguaagcuuuuuauguucaaucucacuuaaaaaccucugguggcaucccuucaugcucaggauugagucugaacucuggccaggcaucucaggcccuucucaaugaagcuaagaaguccccauguccuuuguguaucuucccaggcucauuugcugccacuuccugauuaauauuccugauuaauacuccauucgaaguggugucucuuuuguuccaguucauuuuuuuuuuuuuuuuuuuuuuuuuuuuagcauuuacugcauuuacugucauucaucgacuguauuaauuugccagggcugccauaaccaaguaccauggacuggcuggcuugaacaagagacauagucaugugcugcuuaacgacaaggauguguucugaaaaauguaucuuuaggugauuuuugucaugguaugaacauuauggaguguaguuacacaaaccuagaccguauagccuacuacacaccuaggcuauaugauauagccuauugcuccuggguucaaaccuguacugcauguuacuauacagaauacugugggcaauuguaacacaaugauagguauuugugugucuaaacauagaaaaguuacgagaaaaaugcaguauuauaaucuuauggaaccauuguuuuuuaugcagucugucaucgaccaaaacgucauuaugugguacaugacuguauuaauuuucucacaguucuggaggcugaagucugagaucaaggugcuggcaggguugauuucuuacgagauaucuugcuuacuuuauagauggcugucuucuccuugugucuucacguggucuucccucugugcaugucuguauucuaaccucuucuuauaaagacacaagucauauuagauagggcaugccccagugacuuuuuuaaaccuuaauuacauuuuaagacccuguauucaaauauaguaacauucugagguacuggagguuaggacuucaaaauuuagcccauaacauuaaccaacaucaauuguucuuuaaauaaucuuuccaguaucaauuccacuaggaagcuuuccugauaauuuucaccugaggucuacacugcuucccuguggucccaaaacaccuaucacaccaaacagaaaauagcucauucacuuguucaccuuuccuucuagagagcaagagguuuggaggcugggguuguguauaguucaaagcuauagcuccacagccuaccauagugucuggcauuuaguaggugguuaacaaauacuuguuaaaugggaugaaacacugcuaguuuguauauauauuuuucuaucucuuuucaaacaaguucacguuaacuuaaaacauauuaagcauaaugcauggcugaaucuaccagucucaguauauauguuccuuuuagguugacuuacauuuucauugccuuuuaaaaguuauuuuucauauuagacucguagugugacugcaucaaaauaggcauacaagugggaauauugaggugaugcaagauccccauuaaaugcucugccuaacagcagcuucauggauuuccaaaguguaaagaugcagaagaaagggaagcuuaaggauucaaagauacgcuuuaccagguguuucauugugaagccuaucagcuguguacaguauaugcuccaccaagugaccacauccuuuuggagcucuuccuaugaaauuuagcuguccugaauuuuaaauccuauguuaucgaaagaauaacucucuugugcugccugcaaaacugguccuguacacaaggucaucuuugguggaaaggaaauggaacagucuaaccccuaggaaacacaugaagugguuguuugcugugagggauaagauggauuuucaauguugacaaaagauaugagaaacucugaagggaauaugaauuggcucauuauuuaaauauuuccuaaagggauuucacuaccaucuuuugugaggugaugcagaaucuguguccuagagguagccaguuuucagagaaaugauuuugugcagggugguuacaauggcuauuugagaccucaaauggucaccuucacaucugaauaagacgagucugaucauuucgcauucaguaaacugagucuagaagccuuuguuuucagaaugaauuuuuuuuugcaguauguauauaaaauauuuuaagggacaacuccuuuuaaaccuuucaguuuguuccccuucuuauuuuaaucaaugauaacagggagaagcucugcuugaagaauuuuuuuaaagcuuuucuuugaacagguuaauuuucucauuuauuuuuuacauuuuucuacaugcacugaaggucaaaagaguucuuagauuuaaacuaggacguagcauucugcauaaaacaucccaaaggacuuuuuuuaaguguaaggaaucuaaaaagcauuugcuuagaaacuccuauguuucacacaccacuauacaagcacuggguugcuuuaaaaaggaauuaaaacagagggucuuguacagcaaguugguugcacauuucuuauuuuugugccccuuuuucuagacugaaucuuugcacaguaauuuugaguaaggaauaugcauuccaagacuuucaaauuucaggaaaaaaaguuggagggauugacagagguugcucaacuuuuauuucauugagguauuuuaaaaaaaaaucuaugcuuuuucauaaauaaaauaacauauaauuccccaaauauaaaaaggauauaaucucagaaaaaaagacaguucuuuuaauugagguaauugaguuaacaucugaugauuuuguccuuauuuuuuuuccccacuuuccagugaauuuuggaacauauccuuagggcugcuuucugucuauggaaaggcauuggaaguuggcaauaaagguggcuggauuucaccuuagggacaggcuauuuaaagugagauaggaaauugagcaggaguuaaccagaggaagugugagccuaggaaucaaggcccucacagaagcaggcaccaagaguacccuagugccuuggaaugcagauggggggcugggucagggagguggugguggggaaaggcauauacaaggugagcugggggaggaaacuuguaggauucuuuuuauuuauucuguuuuucuuuuuuuuaucuucauagugccugauucaaaaccuauguagcuagucacauucugaacaucauaauguuuuggagauggacuaggauuuuggaguuauaaaguuaugcgacagaaagaauuacacaagacugauaauagggaaaucugggauuuucuguaacucuaacucugucaggcuguaccugaaugacucuggcccauucaucucuccucuuggagacuucauuuccucacagugaccuggauaaagauggcuuugaaacagaugauaaaauaucacucuuaguuuugaguuuaugguucugugauuuuaaguuaucaagagaccuauagacuuuauggugugaugcagggagaaaauacucggaguauagacuugggaauauaguagacuuguuuuccuucuuuaagugaaaaaaacuuuucuuaguaaguucuucuucacccuccaugaaaaccaaacaagcuuuaaugacuauaaaaggcaaaguuuuuauugucaaauaauuauuauguuaauaaaagaaaaaaauaaaugaaacuuuacugggauaaggagaguggccaaguaggauauuggcuuaggugaaagucugaaagacugcuacccaaugcauuaguuaacaucauguuguugauuuccuauaggcaaagcacuguuugagacauuaggccaaguuagagaaaugaguugaucaauaagaaggauucuauacaggcaaaaggaacaacaggcacagaacgauuuuaaaaauuaugugauauggucaaaauagccguuaaaaaaugauuuugguuguugaagaugauaucaugguugaucaaguagaagaaaggaaauaaguggaauuggggaauauuaguucaaaaagaaauuagaauguuagucuguuguauaauuuagguuuauugauucaguacuaaaguaucuauccuuugugcuaagcuuugcuuuauaaucuauaagacaggcacaauaaucauucucucagugauguuuugcaagaauuaaauaaaauaauguagaguaguagcaacuguauguguuugcauaugaaauccaaaaaacaugguaaaaaaaagagaauaaagaagcaagaaaaagauacaagggagagaauaagagcaaagaagucaaagaccauguauuacaagagugguucucaaaauguggacuagaucuagaucagcagcacagcaucaccuggaacuuguuagaaauaaaaauuauacaugccugcgaaaccagaaccucuggggcuggagcccagaaauguguuuuaacagaccguucaggugauccugaugcuuggcuaaaaauggagaaccauuguguuagagugaggaaacacaggaugagccgaagcggucuauagcagcuguuuauucucucauuuaagaaauagcccuucaacaauggcuuuguacagaaauugcucaaggucuugaggauguacagauuucauaguuugcugucauuacuuauaaggcauguuucuagucauuucuuuacuaaagccucuuccucuuuuuccuuuaauaucaguccuuaggggcuuuguuccuuuuucucugcacauaguuucucuugauuuuuccccauguuacuuuuuauugauaaauccuaaauccauauuucuuuccuccaucuuacccaaccuucugucucauacguuccacaguuuucagacuucuugaugucauuacaaauucaacauagcuaaaccaauaucauacucuuccuucccauacaaucccccuucucauguuccuguuuauaauuuuccaguugaguuuaugguaucgucccucuuucuauuuucauuuaacuagagcaaacugguuaagggcaugacagcugaagucagauuugucuggauucaaauccuagcucagccauuuauuaacuauaacuugaguagcuacucuaugugucaguguccuugacuauaaaaugaaacgauaauagcagcucuucugggguguuauaaggacuaaaggaguuaguacauguaaaaacuuuagaaaaguagcuggcacuuaauaaaugugcaauaaaugauagcuauuuuauuguggguguuaauucuuuuucauuuguuccuuauauucucuauuaucugucaauucuuuaaauuaguuguagggaauguuauaguauagguaugguauaguauaguauaccuuccaacauuucuuccaucccauuagguacacagucuaagccaucaguauauauucuuguguggaucugcucaguccgugguaaaccugugaccuaagaagaugaacugauuuggguaaacauaugaccuaagaugaacuaauaaagcugaagagacagaguuauauuaaucuguuucugguugagaggggagauuucuccugaaugagaacaaggaacuauauuaccucugucccuguggacaggacacuucugucacaaggcaggucugccugaggacaguuuugucucacucaccauggauggaugaguauagaggugaaaagaacuucgguucuugagaacauuguccuguugaaccucugaauugagcaaucauggagcccauucuaucauuaaauaugucgcuaugugagauaaauuucuuaggaacauuugauuucagauuuccuuucuuacagucaaaagcguauaaugaagucauuugccauucucauuccuagaauuuaggaacuuuauaaaaaggugccuaucuuuuucugcuucgauucucuucccacccacuucaguguaucucucagaucauuuaagcaucccuuaauaacuacuaaucucuaacaucaucaagcucaaaguccuucaucuaacacagaaaucuuucauaaguaccuucuaccuuucaaauuguaauuuuuauuuauuuuguuuucuccugaauuucacauuuauacaucuguuauaacuuagauuaaucugucuaauaaaaaucucaagcuuacuaaacccaaagccgagguauuaauuucccuuguuuguuaaccuacuuuggguucaugcuugaccaguucaguuaaugauaccaucauccauuuauuuguucagaaaauaagcuuauccugauuucucucuuuaccucacccaucauauaacauccaaacaguuuccaguccuaucaguuucacagcuaugagagaccuguagcugccacuuucacaucucaauuacaccacccuagacugagucaucacccucucucuccuggauuacugcacuggcuuccuaacuucucuuacuacauucacucuugcucacugccucugcugcacucucuccuucucaccauauaucuuucucuacuuuaagagccagagguaaaaaaugcuucuuuaaaaauuuccaauggcuugucuuugccauuagaaaaaacucuuaagucuuuacuauguuuuucaagguucuauuguauaucugggcccaacuaacucuuuaaucuccuuuuauaugacugccuuguuuguucccucucuuugagucaacauuggccuccuagucauuccuuaaacacucccagcugguucccaaugcagggcuuuuauaucuguugcuucuuaugcauuggauauucuuccuccaaaauuuccauuugagguuguaauaaaauguucccuccuuuggauagucuucugugucccacccccaugcugaucuaccuuuauucucugucccaguuauauuuucuuuaaggcaaauuuuccaauauaaaauuaucccauuuauuuuguuuucuuauuuauugucugugucuuccucugacuugcuaguaaaauguaagcuucaggaaaguaauaaucuugucagucuuguucacuguuuuaucucuagauaaaucaaagaguuucaagcacuaaguaacugcucaauaaauauuuacugauugaaugaauaaacaugaauucuaaucucuaguaaacugcuugccuuaguagucauagugaugauaggauugucuucuuucccccucaaauauuauuaacaaaaauucauugaacaccuacuuuauuauggaagaugaaaaaggaaguguaagauagauuuuguaauucuuugcaagcuaagaauuuagaauauauuugaaaugucaaguaugaacacaagaaaugauuaauuaacaaaaaugugacaucagugguacagggaagauaaaacauggaaauuuaauaaagagcugaauuuucuauagaagccuuaugguaaggcuggucauaaggugagguccacaaaauguauuagaugugaauagucuggagagaaagggaugacccagguauccaggagacaggcaacaugaugugcuaagagauuuaauuagguuugugaccauggaauggaaagaauaggaaugcaaaaaagagacauuugaaaacacauuuuugccucaaccuuuuucuuuuuaucucuaugcccuuuccauuggcuaucuuuggcuuuuacuguuuuaauggagaguuugcccaagucaauaaccaucgcuccagccucucucucaaauucccacccuacuuugucauuucuuugucauauucccuacauuuccuuauauggguauaucauccucuggugccccaaguucaacauaccuagaccaaaauuagcacuuucacucucaaaccaguuuccucuucuggcuucucuuuuguuaaugacuucuugaucucucagccggugaggcuaaagauuucaaaaugauuuugcuccccucuuuccguugauuucuguguccauuugaugcucaacacuaaguucacaauaucuuuuccuucccuuucauuucuuuugccuucacuccaggucaggccuuugacuuugccugggucauucauucaugaauuuuuucacucagcuaauauuuaucaaacagcuauuauguauuaggcuuucuuccaggcacuuuggaauacgucucugaauaaaacagacacaaaucucugccuucuuggagacauuauagauacagcauggccuccuaugugguacucucucgucuagucaauuccuuucauuucauugcauauuuuuuuuucaaacugaucaaaaagcaugcuucugauuauggcuaggcuuuacuaaacccuucaaugauuccccuuguccuaaauugagucaggcuggucugauauuuacagccucugagacccagucuauuuucucaucuaccuuaaugaaugauuuugagucacuuuacugaauacauucugguuaagaaguaauuuguuuggcaaauuucugcacuugcuaaaaacaugcagaaaagaggaaauuaauacuaguaaaauucaugcugauuagcaccaagaauauaagaggcucccuagaagggccacgaugguuuuuuuagggaguacuaaagggaucuugguucauuaauggaaaauacacagaaaauugagaaaaaucaucagaacaaaaauuuuacuaucaaaaccacuauuuuggauaaagauuaaaaaccuuacagaguagaaaucucacgauuuuuuuuagcgugccaguuccuuucugucaugccauggacauugcucauggaacauugguaaaaauaucauuaagaugcaaguuuuaguggggaggagccaagauggccgaauaggaacagcuccggucuacagcucccagcgugagcgacgcagaagacggugauuucugcauuuccaucugagguaccggguucaucucacuagggagugccagacagugggcgcaggccagugugugugcgcaccgugcgcgagccgaagcagggcgaggcauugccucaccugggaagcgcaaggggucagggaguucccuuuccgagucaaagaaaggggugacggacgcaccuggaaaaucgggucacucccacccgaauauugcgcuuuucagaccggcuuaagaaacggcgcaccacgagacuauaucccacaccuggcucggaggguccuacgcccacggaaucucgcggauugcuagcacagcagucugagaucaaacugcaaggcggcaacuaggcugggggaggggcgcccgccauugcccaggcuugcuuagguaaacaaagcagccuggaagcucgaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcaagcagcuggagaucugagaacgggcagacugccuccucaagugggucccugacuccugacccccgagcagccuaacugggaggcaccccccagcaggggcacacugacaccucacacggcaggguauuccaacagaccugcagcugaggguccugucuguuagaaggaaaacuaacaaccagaaaggacaucuacaccgaaaacccaucuguacaucaccaucaucaaagaccaaaaguagauaaaaccacaaagauggugaaaaaacagaacagaaaaacuggaaacucuaaaacgcagagcgccucuccuccuccaaaggaacgcaguuccucaccagcaacagaacaaagcuggauggagaaugauuuugacgagcugagagaagaaggcuucagacgaucaaauuacucugagcuacgggaggacauucaaaccaaaggcaaagaagcugaaaacuuugaaaaaaauuuagaagaauguauaacuagaauaaccaauacagagaagugcuuaaaggagcugauggagcugaaaacgaaggcucgagaacuacgugaagaaugcagaagccucaggagccgaugcgaucaacuggaaggaaggguaucagcaauggaagaugaaaugaaugaaaugaagcgagaagggaaguuuagagaaaaaagaauaaaaagaaaugagcaaagccuccaagaaauaugggacuaugugaaaagaccaaaucuacaucugauugguguaccugaaagugauguggagaauggaaccaaguuggaaaacacucugcaggauauuauccaggagaacuuccccaaucuagcaaggcaggccaacguucagauucaggaaauacagagaacgccacaaagauacuccucaagaagagcaacuccaagacacauaauugucagauucaccaaaguugaaaugaaggaaaaaauguuaagggcagccagagagaaaggucggguuacccucaaaggaaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuauagacaagcaaauguugagagauuuugucaccaccaggccugcccuaaaagagcuccugaaggaagugcuaaacauggaaaggaacaaccgguaccagccgcugcaaaaucaugccaaaauguaaagaccaucgagacuaggaagaaacugcaucaacuaaugagcaaaaucaccagcuaacaucauaaugacaggaucaaauucacacauaacaauauuaacuuuaaauauaaauggacuaaauucugcaauuaaaagacacagacuggcaaguuggauaaagagucaagacccaucagugugcuguauucaggaaacccaucucacgugcagagacacacauaggcucaaaauaaaaggauggaggaagaucuaccaagccaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauuuaugcacccaauacaggagcacccagauucauaaagcaaguccucagugaccuacaaagagacuuagacucccacacauuaauaaugggagacuuuaacaccccacugucaacauuagacagaucaacgagacagaaagucaacaaggauacccaggaauugaacucagcucugcaccaagcagaccuaauagacaucuacagaacucuccaccccaaaucaacagaauauacauuuuuuucagcaccacaccacaccuauuccaaaauugaccacauacuuggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauaaagauguucuuugaaaccaacgagaacaaagacaccacauaccagaaucucugggacgcauucaaagcaguguguagagggaaauuuauagcacuaaaugccuacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccaggaccagauggauucacagccgaauucuaccagagguacauggaggaacugguaccauuccuucugaaacuauuccaaucaauagaaaaagagggaauccucccuaacucauuuuaugaggccagcaucauucugaugccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaaccggcacaagacagggaugcccucucucaccgcuccuauucaacauaguguuggaaguucuggacagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugggugaacucccauucacaauugcuucaaagagaauaaaauaccuaggaauccaacuuacaagggaugugaaggaccucuucaaggagaacuacaaaccgcugcucaaggaaauaaaagaggagacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagaacccgcauugccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuaaaccuaaaaccauaaaaacccuagaagaaaaccuaggcauuaccauucaggacauaggcaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggaugcggagaaauaggaacacuuuuacacuguuggugggacuguaaacuaguucaaccauuguggaagucaguguggcgauuccucagggaucuagaacuagaaauaccauuugacccagccaucccauuacuggauauauacccaaaugaguauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggugggauagcauugggagauauaccuaaugcuagaugacacauuagugggugcagcgcaccagcauggcacauguauacauauguaacuaaccugcacaaugugcacauguacccuaaaacuuagaguauaauuaaaaaaaaaaaaaaaaaagaugcaaguuuuaaauauguuuucuuaggcagcaacauacaaaauaaaaacauguugauuuugaucauuuucauuaguuacuaacauuuaaaaaauaaagagcuuuauaaaaugacagaagcagaauggauuauuaugaaaaaaguaaaugaacacauugagguacauauuucucuauuugaaauugguauuaaaacagagaacuacguucacaaagacagaaaucguuagagcuuauguuagacuuaccugggcuauauagaauaaugacucuuauuccauauaaaaauucuuauauuuuuaucuuaguaauaauucaugucuagaaguaucagauucuguuucauauuaguaaacguuuaacaugugaguagacugucugaccaauuaugauguuaguuuauuugagcugcucaaagaacuaugaaaugggauagauaagaggcaauuacgaauuccaccaauuaaaauguaaugaugaauuaaaacuuccaugaaggaagaauuaaaguuuugauuaaguagagucuuaaacuaacuuguagcaaaagaagaugagaggaagggaaaauauuucaguaucgucccauagcuuucaauuuucaauauauuuacuucuggucagcugaugcaagacaguuucaauuucagauggaucucucccucccuguaauggaggacccuuuguuauuggcauaccauuuaaguuucugaaaauauucugcauuucauuuaaacuaaaaugcccaacagcauuuuaauaugaaggaagacagccaugucggcagucaugaagacaauuuagauccuuauuauccuuuuccagcacuggugcauguucuuagacuugugggaauaugagccaggauaguauugucuuugacagcauggguucaaagccuggcuuugucacuuaucaguuuuaggauuuuggaaaauuucaaaucauuucugugauuuaguuuccucuucuauaaaauaaagcuacuaauaauauuuaccucacaagcuuauugugagaauuaaauuauuuaacauaguuagggccuuuauagugauacuuggcaccuggugaguuuucaaugaaugucgacuacuauuuuagucuacagcauaguuucuuuauaaguuagagaacacauuccaaagcacucuauucaucuuugugcuacauuuucuugugucuaugaaguaaugacaauuuuuaaacagauguucuaguuauguuugugacccuguugaaaguauuuccuaaugaauauuccugcucuuuuauguaauauauugacaugacuauguuugugaaaacauauauuuuacugguaaauuuuagggauaaaaacugacuuuuuuaaacaaaaggaacuggcagaacagggcaggggaugggacacuggacugggagccuggacuaguggucuccagggcaugguuuuaaccaaggguuauacucugggcagggcaccccacuucccuucuugguuucacauuugaaaaauuagagaguuaucuaaaugcaugccaaaggcucacucagugcucaaaaucuaugauuguuuccucuauagacauaauuauuauguaagcccacacguuuauucccaugaugucacuauguuuacaauauuuuaaggaccuaugaaaaaguagcauguucuuugauuauuuuugaugacaucaaauuuuccuuuuaaaaguagacugaauuuuucaaacaguaaaaagugucuugacguuauguuuguugaguagaaugaguguuuugaguguuaaaaaugugauuuaacuauaagggaauaaaagaguuuuggagagagucuuauaauuacucuggagaguaugugugugugcguguguaugugugcgcauguguguguguguauuuucaagugcaguguaaauuugugguuuuaaguucuggaauauuuuguuaaaaagccuuuaguaacaccuagauuauaucaguaaaauaacuaugcuuuuuguaaaccaauggguuucugaauaaacaauauuuacugagaucuagaaacagcacaaaucuuauuuguaaaaaggcuaaucagacuugcugcuugaaaagcagcuugguccagcaucaugggcuuauuauccagcugaaauacugccuugcaccuugcacuagucauuuaucuucccuguagcucaggacuuaucucagaaaaaucuaauaaagaugcuuguucauuaaggguacuguugcaucuugaauauaguguucccugaaugcuguaugauguagugcaagaagaauggaaauuuguaucacuuaaaaaucuaccccaugggguugcuguuugaugucuagguuugugcuuagcagugagaaugcuauaugcuucuugagaguaaagguuuauaauuguuuaaaauuuggcuacaguuuggcaagacuaauaaaacuaaucucaaaucauauggagcccauaaauauuuuugaaaaauucacauacuggaaauaucacuaacuauacuuauucugucaucuauuuagacuaaacucuaaaauaaauguaaauuauuuggauucuccacuagaaguagcagucagggugcuugcuaaaacucauaggauauccgucauaaaaguagcuccacaaggauucaggaaacagaaaaagaaugauagacaaaagcuuacucauuuuucuuguuuauugaaguucuuuaaguuaaaaauccucaauucaaaacagauguuuuaaagaggagguugcucugaaauaggaauagcauauuccuuuguauggauuccagaggcuaguccuuaucuaaauagauguguauuauaugagaaaagaaaacaauuuccuuucacaucuuauagcauaaaauguuauucuuuuaaagcaaaaauauauguauaaauauauauaauauauauauuauuauagcauccuacuccugucucccuuugagagugaaccuucaguguccucuuucuugcuuuuauuuugagacucuucaaauguucuccuuucuuaauuaucugcccaucuuaauuaucuuguuuucuugaucuggaacagaaaauguggauacaaugaaaccagcugauguuagugguauauauauacacacauaaaauuaaauaaaacauauauauaaauuaaaaaaaagucugauguauugugagagagaagaacaauaccaauaggaauauguuacugugaugugagcaacaacagaauagaaaucuguagguuguaugguucuuagaaauaauuauuuauuuaccggguaguaaaugaucauaauuaaaauaaauaaucacugccuuucuaaaaaugaugaaauacagcugaugcaaacuuguaauagaugaccaagaaaaggagaaguaagacagcuggaagaaguaggagaaaagagggggcuguuuguugccauuuaaaucugcauagccuuucuuguucaggguccuggauuuuaugcacuucuuugauuuuucaccaaguucucccuauccuuucuccaaacuuaucuuuuuuucuaaucccuuuuccuaauucuuuuguaguauucuuacugcuucccagcuagaauacuugcaaauggccuucuucaauuaaaagcuaaccuaacaccucagacuccucaaauccucgucuguacagauauuucucuucucagagccccacaaagcuggugaacggugcugcauaaggacacgagcuucaaccugaggccuagaucuguuuguuauuaguugugugaauuuggcaagauauuuaagucugaggcucaguuuccucaaauuuaugaaaugcaaugcacagaguuguggcaagcauuauaugaaacauaucaaguguuuaguguaguagaugcuuuauaacuagcagcuguugauagucuaucacauucaauuuuaguuucucuaccuaaaucccucaacuaauauuauuuccagugaaguuguuccuucucaucauccuuucaacacaugauggccguuuuuauuuaugugaaucucucauguuuuccugaguauuuuaccugcaccugcucucauauccaaauucgauuuauuuuugaauucucccugcucaagucuaguaaccauuuuuauucuaaccuucacugauuuuguuuuccuuaaaauuuuuccugcaaguauugucuauacuauauaguuuaauguauacuuugauauugcuuaauguuuacaaaugugucucaauaaugucacuucugcucucagagcuuggggcuaguuuauauuuugcaucucuaaagggaagccaguuaacuguuuaacuucugguuuuauguaccuuucugagagauucuuuuaaccagcugaauacagagcuuaagccauuuguugaccaauccuggagcuacuaagugggcaaucaaugggggcugcuuuuuuccccuugcugaauggugaacagaaugcuuggaaagcaccccauuccaauugggguauuaaaggauuaggauuaugcugucaaguuaaaggaauguuuuuuacuuuccuugugggaaaaagcauaaaaauuauuacagcagggaguuggaaagaaggguaggcaggugcuguguuuguuuucuuuuucuucuuagauuuuuuuucuuagcuuuuuuauugguuggaugaaaaauuauagaaaccaagaaagaaaaaauaauuaugauaagaaggaagacuuuagaaauuaucaagcaagcaaaaugcacagagguuuaucuggcuguaaguaaaugggcugaucuuuagccaaaaaguuaaguagaucuuuuauucauguaugaaauaauuauugaaugcuuacugcaugcuaaacaagaaagugggcacuagagauguacaaacacacgugugaacucaaggagcucaggagcuuuccaacaggagguaggaaacaagagguaaaguguaagaaguaucaagauagagagagguaaaaagaucuaauguucucuuuuugaauaauuuuuugaauaauuuguauuuuuacuuguaaaaauacaaaguaaagcacuaaauauucuaauacuuaauaggaaaaaaauucuuauaguuauaauauuaaauuaaauauucuaauaguuuauaggaaaaaagacuacaacuaaggaguauaaaacuaaucaaauaaaugaauaaaaguagcuauuuauggacccauuaugagaguauugugaaguaccaaggauugugauuuguucuacucuuugugugucuaugugugugcaugcaugcauguguagagagagagagauagaaagagaucuuauacaccaguaaaagacaaacagagagccaaaucaugagugaacucccauucacaauugcuucaaagagaauaaaauaccuaggaauccaacuuacaagggaugugaaggaccucuucaaggagaacuacaaacuacugcucaacaaaauaaaagaggacacaaacaaauggaagaacauuccaugcucauggguaggaagaaucaacaucgugaaaauggccauacugcccaagguaauuuauacauucaaugccauccgcaucaagcuaccaaugacuuucuucacagaauuggaaaaaacgacuugaaaguucauauggaaccaaaaaagagcccgcauugccaagacaauauuaagcaaaaagaacaaagcuggaggcaucacgcuaccugacuucaaacuauacuacaagucuacaguaaccaaaacagcaugguacugguaccaaaacagagauauagaccaauggaacagaacagagcgcucagaaauaauaccacacaucuacaaccagcugaucuuugacaaaccugacaaaaacaagaaauggggaaaggauucccuauuuaauaaauggugcugggaaaacugguuagccauauggaaaaagcugaaacuggaucccuuccuuacaccuuauacaaaaauucauucaagauggaucaaagacuucaauguuagaccuaaaaccauaaaaacccuagaagaaaaccuaggcaauaccauucaggacguaggccugggcaaggacuucauaucuaaaacaccaaaagcaauggcaacaaaagccaaaacugacaaaugggaucucauuaaacuaaagagcuucugcacagcaaaagaaacuaccaucagagugaacaggcaaccuacaaaaugggagaaaauuuuugcaaucuacucgucugacaaagggcuaauauccagaaucuacaaagaacucaaacaaacuuacaaggaaaaaacaaacaaccucaucaaaaagugggugaaggauaugaacagacacuucucaaaagaagacuuuuaugcagccaaaagggacaugaaaaaaugcucaucaucacuggccaucagagaaaugcaaaucaaaacuacaacgagauaccaucucacagcaguuagaauggccaucauuaaaaagucaggaaacaacagguacuggagaggauguggagaaauaggaacacuuuuacacuguuggugggacuguaaacuaguacaaucauuguggaagacaguguggcgauuccucagggaucuagaacuagaaauaccauuugacccagcaaucccauuacuggguauauacccaaaggauuguaaaucaugcugcuauaaagacacaugcacacguauauuuauuguggcacuauucacaauagcaaagacuuggaaccaagccaaauguccaacaaugauagacuggauuaaggaaauguggcacauacacaccauggaauacuaugcagccauaaaaaaggaugaguucauguccuuuguagggacauagaugaagguggaaaccaucauucucagcaaacuauugcaaagacaaaaaaccaaacaccgcauguucucacucauaggugggaauugaacaaugagaacacuuggacacgggaaggggagcaucacacaccagguccuguccuagggucggggaguggggagggauagcauuaggagauauaccuaauauaaaugaugaguuaaugggugcagcacaccaacauggcacauguauacauauguaacaaaccugcacguugugcacauguacccuagaacuuaaaguauaauaauaaaaaaaaaagagaaucccuaaguguuuauuugaaacacacuuguuaaaagugugugucauuuuugugaaacgcaguauagcagaaugguuaagagacccaguuuuuggagccagacucuggguuugagucucagcucuaauaaucgacagcuuccugaacuugcacaaguuacuuuacuucaugaugucucaguuucuguaucuguacaauuaggacagcaacaguauuuaccucacggguuauuauguguaguagcugagagucuagcauauaguaaggacaauauaagaauauaagcuugacauuauucuuauaugcuuuuagaagaaauauaagggaagacagaauguacagugaccagaaaacuggauaugaaaucagaaauuuugaauuuuuuccaauuuuauugcuuuuuuuugugauucuaagcaaguuguuuauuccuguggacuacuuucaucccugucagaaagggcauagcuacuguuaguuccauuucuaaaaauucucaaauucugcgauuaguuugaacaacuguuuauauaugugucacuaucaugaaucuaagaaaaauuauucuccaugcaacuuggaacacguaauuguuuuugugacuuuggguaguucuauaucccaaguuuagggucuagaagccaauaagcaaaaugugaccucuuuauggaugaacuauaaaauuaaacuaaugaauuuuucccaauauccacuuaagauuugagaauagacuugagcucauacuuuuugguuaucuuuuuagcuuucugcauuguuaagauucugaagucaacacuggaguuaacuuuauuuauugcacaaugaagucaacccgaaaaauucaguuuucuucauucuugaaugccuuuaaugaggcaacauaugacuaaauguuuuuaaacuaagaaguuacaagaugagaaccacauaaaacaucugaugacaaaucgugucagguagagaauucacugcaagccuuacuuaccacacucacgcacacaucugaugaccaaaaaaaaagacugacuuuaacuucugcugccaaguuaucuaguuuaugugcagaaaggacacaaaaggaagcaaaacucuucuagccauuucuaugguuauauaaauucuagcacuuacugguuccuugaagucauuccaauguguguucgcucacauacaaucauacaugugaguguauugauauaacccaugucuccgaaccugaauuugaugcuuguccaggugcagacucauccacucaguguauguacuuguagcauagcagucaugcacuaauaagcaaugcuauaaugaacaaaugugcaaugccucauaugauuguucuaaagugccuaugaaauauauaaacauauaagacgucuggcagguagcagauaauaaauguaguuacuguaucacuauauauuuuuuauuuuacauacuaauauuuauuacauauuaaaguaacuuaauauuuuagaaguuguguuauagaaauauagucaccugaaaaguaauauugaauuauuaaaaaucaccuaguauacuauauuuucagugaaaauaaucacaauaguaauauguaauaucaauggccccggaugcugauguauaaaacauacugaccacaguguacuaaaaugguuaaauuugaugaucuuuauaauuuuuaaaaucaguuaacagaaagggaagaucucuuuuuccuuauggcuauaaaaaaauggaacaaaugcaaauauuuucugaauuuagcgagagguuuugggugauaaauuaauguggcacauguguauaaagagaggagcuggcacacugaugaucgccagguccugcuucuuuccuggcucuccuuuucuccauauguccagggaaucaggaugcagggugucguuaccaagaaacuccacagaaagaaacaauuuaaacugccaacaucuguacugcauaucaaacaaaggaaaaauaaugcuuaaugcuuaauaauacuuuuuagcaguucacuagaguacauuuucugagaauuaaaaucucugauagguaaagcacugcagggcuaauaagaaaugcaacacuuggugugauuuauuaaacauuucuuuaauuacuauuacguucaugcauuauuuuuuacauaaaaaauccagaaaaucgcugggcgcgguggcucaugccuguaaucccaacacuuugggaggcugaggcgggaggaucaccugauaucaggaguucaagaccagccugcccaauauggcaaaaccccauuucuacuaaaaauacaaaaaauuagcuggguaugguggcgugcauguguaaucccagcuacuugggaggcugaggcaggagaaucacuugaacccgggauggggagguugcagugagccgagaucgcaccacugcacugcagccugggugacaagagcgaaacaaugucucaaaaaaaaaaaaaaagccagaaaaucaagucugaaaagcaagaacaucuuuagcaaugaaaaagccaauuaaccauaacuaaucaauaaucaauaauccuuuucucaacuagcucuguaauguuaagcaugcauuaaacauuucugcuggucuuuuaccaugaaacccuggaucccuuuucauucuauuaugcuuuuccauccucacaacuaaauuaaaagcagugguguguuucuucccuuagaagggucucuucuauuuguuccuucuccguauuuccccuugccccaucaaggucaaguuccaggcuuaccuucucuggagagcuuucacucauuuuccuuugcuuaacuacucuguaugcuguucaauuauuucaguaccuuaacuacacaauuuaaaauaauauaaauaaauaauacugauauuauauacauauauaucaacacacauuuauagaaaugucuauauuguucuuuguuucuugugcaugggucuuauaucuccaacuagaugccaagugcuuuacagacggauucccuauggcauaauugauuuuuguaguuuguuccucuuagaauuugcucgucaauaaauguauuuugauugauuauuauuuaguauuuugcuucccaguuaaugcauauguauuucacuuuuggcucacuauaaccuccaccucccaagcucaagcgauucucaugccucagccucccaaguagcugagauuacaggcaugcaccaccacaccuggauaauuuuuguauuuuuaguagagaugggguuucuccauguuggccaggcuggucucaaacuccuggccucaagugauccaccugccuuggccucccaaagugcugagguuacacgugugaaccacugcguccagccuauucauaauccuuuacuccuuccuucccuauaugugggguacauuuacccacucuauugauuuugggcuuggccaugagacuugcuuugguuugugaucugugggcagauggaacauaugccacauccaagcaagaaacacaggaggcacugcagguuucugccagccucuuuuacaaaugcucuuugcaaugagaacagcaugucccuguuaggucggcuucuucagccugggccuuggaaugagaagcuugcacagaguaggacugcaguugacccacagcuugaagcauaacacaaccaaauuacagccuuguuucaugaaugagaaguaacuuuucuaaaucacuuauacuuuagaguuguuugcuacacagaaaagcugacuaguacaggaccuuagaauuaaucuaacuucauuuugcaugucaugagagagguuuagauuuuuaugguuugcuaauggaagaguuaugacacaaauugugaacuacugauuuuuaguucuuuuaaaaaaaaacauacacacaaaaugccuggauuuuuuguuauccuaaaauuuggagaaauauaacucaaguuguuugaaauuuagggccuuaguacuaucuggaacuguccucuuggacugucauuagauucuagagaauagguagaagaaaaucuagaaaauaaacaaaauguacuuucaguauaaaauggauauacuucuauguggaagauauuaaucugucuuagguccaagcuuguuugguaggagauauaaugaaaugcaguaaucuuugugcacuccuuugaggcccaagucuuucauaugcauuguuaaucuaaaauauauauuuaaaaaucuuccauuguaaacaacuccuucaucauagaaauucugauuugaaaauggauauaaugucucaauaaguuaucuccuugauuuccaugacaaaaucucacauauacuuugauguuaagcggggaacuccaaaaucuuaaccauuuccuuugaaaaauucagguggaaacaucccugucauuaucugcuucaguccaucagagcuuuaacuugguccugaaguuuauguuaugcuuuuguauccucagaaugaauucauuuucuuaacucugugacauuuguugcuaaaaauucagacuagacuacuaguuuaauucuaauagaaauuacuaacacaccuacuuucuuuuccaugucaauuuuuugagaguaaaaccaguuauauguagcauuauuuuucccgcuacuuauggaaaaaacaauacuucauguuuuagguaaugagugucuuauugaacaacuacuuauaacuaucuuuuuuguuguuguuguuuauugugcuucuccuaacaaaggaaacaaaauguaauaaaccagaucugguaaccaaauggauauucuuugucuaaauuucaucucuccccuuauuuggucauacacaaaucuuaccuuugugaaaaaacaucucgguaaggacugccauguuguaaugcaauuccauauccccgaucagcaacaguauuuccaaugguguaaaaggaacaaucugggucauugauagccacauauuccaauacagcugcaucccauacgaaagcauaauuuccauauuuuaccugugaaaaaaugaagaacaaaagaagaaauaggguuuaaaguuggaauuuuaauuuacauagacaggaugaaaaacauuacauugguauauauuuaauuaugcuaaaaauaauagaacauauaaucauccuucaguaucuguuggggauugauuucagaaccccuguggauaccaaaauccagggaugcucaaguccuuauauaaaaugucauaguauuugcauauaaucucuacacauccuccaguauacuuaaaucaugucuagauuacuuaugauaccuaauacaauguacauaugcuauguaaacaguuguugcgcuuuauuuuuguuuuguuuuguuuuguuuuuucugagacggagucuugcucugucgcccaggcuggagugcaguggcgcgaucuccgcucacugcaagcuccaccucccggguucacgccauucuccugccucaaccucccgaguagcugggacuacaggcgcccaccaccgcgccccgcuaauuuuuuguauuuuuaguagagcugggguuucaccguguuagccaggauggucucaaucuccugaccucguaauccgcccgccucggccucccaaagugcugagauuacaggcgugagccaccgcgcccggcccacuguauuguuuuucauuuguauuuuuauuauauuauuacucucuauuguguuuuaaaaauauuuucaguucauggcugguugaaucugcacaugcagaaccugcagauauggagggcagacuguauuucuaaguaagcuuuuauucugaaugagaauuuguacuuugguuaauuuauaucucuguucugaaaacaugggaaaggucgaauguuuacuauacuuuuaggccacguugcuuauaguaaaaugaccccugaguggaaaaugucauuuggauugagagaacaaaaaaugcaugaaaggaagccaugucuuugugcuucuaccaguucagugauucaugugacugggacugccccuucuggggacccugaaagcuaugccuuugggguuaugacaagagcuacugacgccuuggguuacuaggcuucuaagccaggugggcuucuguacucacucaguauagguaucaucuugcaugugaucccuauucuaaaugaaagcugcaaguacaacucacauugaagaaaaaaugacaaugcugcccugcugaugagcuauaucuccuguccuguguccuucuaaauuaaucuauugucacauguggccuauggauaucuugcagcugaacuuagaagaaaacucccuggugggcauugcaaugaggaaaauaaaacgauuccacaaccuccucuaucaucacuuaaggaacacaacuuuacucugguucacuuacaaugucuuuagugauuauuuuuuuuccccucaguaaucacucauacacuaagucacaaauuuacccaauaaaagcccaaccuacuauccuaaacaucucaauaagguauauuuucaacuuuuucacauauaaaaauggacuuaagaaauucauaaaauaaauagaaguaauaguuaaacuccaagguuaguuugcuuauauuaaaagaauaauguaacauuauuaaacaaggaaaagcaacauugguucaguauuagaaauguuacuggggugacaacauaucuuacaaaugaggcuuuauaaaauuuuuaaaugaucuuucaauagacacaagaaagauacuuggcaaaauuauaaacaguugucuaccuguuaucuaucuauugguaaaccaggaagaaaaaaaauccguaaugagauacagaauacuucaaacaacagcaagccuauuacaagcuuaaacucucuuugcauugccauuaaaguaaagaaaauuaugcuugcuaguaauccaaaauuaacauuauuguaacaacuuuauccuaugcaaaaaaggauggaaacaaaacuaugauugcaaucuauuaggaaaaaauuaucauccaguagagacaaaauuaucauuauuugaugauauauucaagaagcccaccagaaucaagugaaaaaguauuuuaaaaauucagauuaaaaaaauagauugaucauaaauggauauauacaaaugauuugcuuuucuauuaauauauuaaugagaugauaguuugaguaaaaauaucuauguacauuaaauauaaauacauagagagaaauuuaacaauaaauuaguaggagcuauaugaagaauaccuuaacaccugacugaagacaacuugaacaaguuucuguauagacauaacauauuccuaagaaugcagaugcauaauuacaaaagacauuuaaauuuuccucagauucuccaauacaaaauguaauucuaaauaaaaugccugaagguuauuuuagaaccucuuaagaccuuugcaaauuuaauuaggagaaaacagacaagaauaguaaugaaauuuugaaaauuaaaaaauuaauaauuaucagagacuuagaauaccaaguaaugagacauguuauaaagcuuaaaaauaaaacaguacaaaauguauuuaagaauagaaaaucaguggaacagaacaaaaguuuacuguuuuuaaaaguauauaaauguuauauaaagacuguauuagacugcauaguauuccauaguguauaugugccacauuuucuuuauccagucuaucauuguuggacauuuggguugguuccaagucuuugcuauugugaauagugcugcaauaaacauacaggugcaugugucuuuacaguagaaugguuuauaaucccuuggguauauacccaguaauggaauugcuggcaguucguguccuuugcagggacauggaugaagcuggaaaccaucauucucagcaaacuaacacaggaacagaaaaccaaacaccacaugaacaaugagaacacauggacacagaaaggggaacaucacacaccagggccuguuggggggucagggggcuaggggagagauagcauuaggagaaauaccuaauguaggugacagguugauuggugcagcaaaccaccauggcauguguauaccuguguaacaaaccugcacagguucugcacauguaucccagaacuuaaaguauaauaauaauaaaaaaaagaaucaucugccaucauaaaacuuuuaccucucuuuaaaaaaaagacuguauuagaaagucgauaaaucaaaucaguguggcaaauaugaaauauucaaaaaacgugagacaggugauuauugcaaaaaugucaauauuagagcacuaugucacaucacacaaaauaaauuuccguaguggaauaaauuaaauauaauuuuuuaaagaccaaguuuuaagaaaagaaaaacuagaagaacaugcgagacuuuuuuugguacugaaaaaagaauggaauaucaaaacauaaagguaaaggaagcaaauauagaagaaauauuuaauuguugccuuuuaauaaauuugcuuagaucccaccaauauuggauacccaauaaaaaguuuuguaugaaacaaugaauggccuaaaaccuucaguccaguuaacugugcucaguggauacuuacugucuuuuguugaggugaaccccaaccaaaccaugagguauugaaacagacaaaaguuuuuucccuaaagaaagcauuuaauucaaguauuacucauggagugucugugguacccuagacccuaguuuaggugcuaucggucaguguuucucacaaugugaugcgaagacuaccaccauuagaauuacuaggggauuuuuguguuagaaauguagauucuagaucuaaucccaaaguuacugcaugaugauguuugauguuuaaggccugggaguaugcauuuuaacaauccugacagcuuaugcacaccacuuuuuuauuacuaaugaugcugaugauaaaaaaaugaguaauaucaucggaaacaauuuuauauacguggggcuugauauaauuauaaaacuaggagaugcuuggaguguuagugugagagaaggaaaaacacuugguuagguuucgucugcauugauuucucacccacagaguuaucccauaguuuccuucuuuucucugaucuuugcaaccaacuugcagaccugcuuauagcucccuaggucuaaauuuacagugauugggaguagcagugaccuugaagcuuccucuaacaaccuacuuugauuuuugugauuaucuucuguuuuaaacuguuagucuggccuccuggauccccuggcagcuucuuuacaaaccucaagggaccuccccaguaggcgacauauugcuuugcuguuagaaaaguuuucuagcauuguugucaaugcuuugugaacuguagagcucuacuuaaauguauaguaacauuauccuugccauuauauaugcugucucuugcaauacuaauguuccaaagaauuaugaauggauuuuuaaaaagagaaucauuaaaacagugugauuauagccuguagcaauggcaaugaaagguugcauaguaacccaaacuauuuuagcuuuuaaaaauggcccuggccuuuuucaucaauuaaaacauauaaucacugccuuuugaauggucuuuaaccaucaaaugaaaacucuauaaaauacucaucaacaaagucugaagucaccuuucaacagaauaauaauugaaggacuggccuaaaaauuuucaauccaucugacuagguaauggaguuuucuuaaaauuuuucaacuagcccuguucuugaggccauguuuagacaggcaacugaaucacaugccauugauuuauuuacuaauggauuccacaccagcagaguccuucauacuagguuaaacagaagaaagcaaaagugaaucugggagcuucaugucagcauauuccaggucucauuaugaggaagaaaaauaauccaaagugauaucuaccucuaguguuuucaaucuccagaccccaaaguagagaugcuaggaugcuaugguuauugauugacauugguaacuauugaggcucagcaccuguguccucguaauagugccugagauaucaauagacuccccgugauaaauuucucacuucccagauaacacuaggagcuagguuuuguucccauuucuauauuuuucuuuaacaguuguuguuuaaauucaauuuuacuaacaaucauuacacauuaacucuaaaauccugaagguuaagucuauaaggaauauaaagguaagacuugggcccccaucaucaagcugcuuacaacucaguaguggagauaagucaaguacaaaauuguuguaacacgaaucacauuaugguaaggaucauaugaacagauuuuguuuaaagucguaaaagaaaagggaaauuaauuuuuguuggaaggaaucaggacaagucucaaauauucugguaacugaaauagcuguauaagaaaaccccaaauauuuaaauuccuuaucaauaguaccuaaccaauugaaaacauagauaugcuuuggagaccauuucucguuuaugcacauuccucuagccuaaaauuuuuugaaauuuuccauuugucaggugaagaacuguaaauauucaauguuauuuucuugaauauuugcauuucuugccaaguaaagugaagaaugggaaagugcauuuucaaaaccugcaccuauguuccucaacauguuagggauuaugacacauuucuauuuguauauagauuacuuguguccuguaugcuccuguucugacaucuccaucaugagcugaugcugaaagcacuuugcuuuuuaauucauuagguagcagccuccuguacuaacuacagaaguccaugccacaaacagacuuaucgcuaccuguuaucucaccaauuuugauuugaaucgggaggacaauacucuuucucacaugaaucuuuaauuuaguaaauuucuuaaaagcucacuccaaaaucuauggcuucagagacacagaagugaugauccuuucuuauuaaaaaacauucagugggaacaauuauggaaaagugacauuaaaccaaaaggguuagauaggaauuuccuuugcuaaagaaaauccucccucuguccuccauuuauuucuuaugauaauagauaacauuuaccaaacauguuucaacugcuaaaaaugccauuuacauacacauuuauuuguucuuuacaacacugugagacagcugauaggauaucuaauucacaggugagguaauuguaacuugcucuaagucauaccaaugauuugcgguagauuuggaaugugagaucaaggcuaucuuccuaugcucuuugcacuacauuaaauauaaauuucugggagauucuccauaggaaugcaaaagcaugugacauagaauagccuuugccuguaagguauagccuauggaguuugagaaacaacaguuacguaaagaaauauaaugcuauguaguuuacggcaagggccacagaaagcaugcagcuuccucaguucuauaugaucacgguauuaagguaaaaaaaaauugggcuuuuaagaaaaagguugcuuacuucucaagaucauuggaaaaaaugaauauuugguuuauaugacucuggacccucgaggccuguugauuuuguagccauugcucucuaagcauuucugauucuuaggaaugaaacaaagcagagcuuuugaaaauuaaaauaaagcuugaauaaugaaaaucuauuuuuccucaucaaauaaaaaugaaaaggccugagaauaaugugagggaaauaaauucuagccuugcccacuaagcugcaaacuucuuuccaauuuuaacuaauggucagugggggauaaugugauugugaaucacaggcgcaaagaguuaugauuaacccagaauugauuuacagugguccuuauaauucauugcccacauaaguccuaaagaugggauggcuuuaauauuuauaacacaugguucugggcgguagccucucacacuuugggcaaauuaauaauuuagcagcauucaucaauucuucugaauuuauacagcacaauaaaucaugaucaaacucaaguuuaaguacuuaagacugacuuuaaaauauauaugguuuuguuuacugcuaccuuaauuguuggccuaugauaauuuaucuguuauuuugucaaaauuuuaauuugugcucugacauaguuaucauagggcacaaacuuucaaaaagaauauaugaauguauuuaaaauaaacaucaacuuuuuuaaaaaaaucaauuuuuuaaccuagaaaagaaguguuaugcccaccucuaaaucuuauuucuugccuguucuuuuggagauuaucaggaauacuaaauauauuuuuuaaaguuuuuaaaagcauucuaggaaaauagaaaacugaauguagcuucuuuacccuccgcugccaacuuuuucuugaaacaaauggcugcugggcucuggaagacagaagguuagaaagguuggggcucuagguagagcaugugggaaaagaacuggugauucucuccuucaggcugggugugucugcgaaaacaagugcaaccugcagggaaggcaaggaagaaacuaaguuugaggaaagcuugguucacagagaucuguggcucccaaguccuccggacuuccuuccuuagauauuuguuaccauuaauauacauguucuguugccuuuaaacuggccagaaagaguugaauggauggacagagaccucccuauccuggaguccugugccuugggucagaccagaagacuggagagcccuuagcugcuucugugugucucaggaggggaauggagucaccuuguuuguucuggcccacaggaagagaggauauuuuaccuucuacaauuagcaagacugccagucccuaggcuacuucaacaacuagaccugaauccucaugagcugacgaagaaaaagaauaauccauguagugaguuccacagucggaaagggaaaaauaaauuagaacaaguagaauacacuccagggaaacagcaguguggaagauuacaauucuaacagaaaaguaagaagagcacuuaacuggauucaagugagaccaaaaaaaucuuugaggcuacaacaaauaauccagccccaguuucucaaccaaaguauugaauagaugaauugacggaaaugcucauaaauguaagcuuaauaggaagagcuagggugacaauugcccagguuugccuccaaugcccagucauagcacaaaagccccaugucaugaguaaacuuucagggaggcaacaaauccagguuuuuggcaauggguacagaagguuaggggggguaguaucaaacccauaccacggcucaaaaaauagcugaaagcaacacuguuuuuguagcagauggauauggcauagauuauguuucccacaguugcugucacuguuuuuccuccugacugcugauguuggcaacugugauuugcuguucacaauaaugaaucaccccuuguugcacugcugugagugcugaggcuuaaguguguuacuuaagcacauuguauucaugaguauuaacaguccuuugucuguggauuaacgguuuucuugguaucaucucgauaccaagauaauguuaauuuaacuuucgauacugguuuuuuucugagaguucagauaauaaaaaugagaaugauuauaauaccaaugccagcaugacccgaauaucgcugaaaaauaaggcuaaaugacaauguuaucuuauuacagauggaaggacagaaauaacuggaucagggaggcaaauaaccaagacaaacuacugcacaaucugcagaaaagaaauuugcaauuggguaugauggaggaaaacgauguaaaaacacauaugcagacugaaucucauaguuuggaauaagacagggaauacuucuaaaucaaucaaaagauucugugucucccaaaagacaccaaugcacaguuaaaaacaguggcuaugaguuaguuugggcauaccacaucaagaaacauacauuauuguaccauuccccugauagcucuauaaaauggaaugaagcuacuuuuccucauuacuagguuucaaauaaaaugugccgugggaaaacaaaaggacaaaauuuugcuaacagacguguuggccucuuacucuauagagcugauucuuucagaucuuacuugaauguuuucugcaguaaaguuuugugucaaauaauggcaacaaaaacugauucaucuagcuuuuagguacuuuuauuuuaaaaauggagcuucaaaucaucuucuugauuuuuaugaauuuuuuuuuuuuuugagauggaaucucauucugucgcccaggcuggaguguaguggcaugaucuuagcucacgcaagcuccaccucccggguucacgccauucucgccucagccucccgaguagcugggacuacaggcgcccaccaccacgccuggcuaauuuuuuguauuuuguuuaguagagaugggguuucacuauguuagccaggauggucucgaucgccucacugauuuuuaugaauauuuuaauaaaacugcagaaaacauaaagcaaaaguuuacugauauuuuguccagauacuugcccucuaccugcauauucuauagacauugcaaguguaaauuuaagcaaguuuuguuuagucuauaaacuuuuuuuuauauuuauuuuauaaauauaauaaaauauuuauuuuauaaauauuuauaaaaauaaauauuuauauuuauuacagccugggcaacagagucucauucuguugcccaggcuguaaugcaguagcucgucugagaccacugcagccuccaccuccaggguucaaaccauuuuccugccucaaccuccugaguagcugggacuacaggugugcaccaucacacuggucuaauuuuuguauuauuuuugguagagacaggguuuugcaauguuggacaggcgggucucgagcuccuggcuucaagugaucugcgugccuuggcuucccaaugugcugaaauuauaggcgagagccacugugcccggccuuagucuauaaacuucuuaucuaagaaaauuaaaagaucuuaccugcaaaaugaacugcacagcuuguguacaacauugcuuaccugugauauuaaagcuuucauaauuaaaauuuuugaucacuuuucaguuaccucaaaaugugcagaaaaacuugaggauuuuuacuuaauagagauggaaggagauaacuagcuccuuuagacauaugacuacaagaugacuaugaauggcuaaaauguuggacuaucauaaaaccauuuucaaagugugagacaagaagaaauguccuucucuaauuuggaaauacauugagugacaaugcagaaaagaauacaguaaaauaaaaauuuauauacuauauuuccaaacuugcuugaugauuuuugaaaaaaaccauaggaguauaaaaaaggaugaacugacugcaccuguguuguuugaugguauguguagauuguaacaaaaacucagagugaaacaaugacacauuaaaaaaauacaacuacuucaaaacuuuuuuacuacgaaacaauaaaaauaaaaaauaaaacaguaagucaccacaacaagguagccaaguuacacagaacuuccucaauuuccuuuuuuuuuuuuuuuggggugaaggccuuuuauuauuagcacauaauaauuguacauauuuauuggaguauaaauuaguucaaccauuguggaagacaguguguugauuucuccaggaucuagagcuagaaauaccauuugacccagugaucccauugcuggguauauacccaaaggauuauaaaucaugcuacuauaaagacuuucucuauuucuuuacuaaaacuguaacuuuagaaucuagcaccaauuucacaaaauucaaauuacucuugugcuuuaaaaucauuuuccuaagagagauuucacuuauaauaacauccaaagugcuucagaguguuuaaaaaugguggacaccuuagauauauuuagcuuauaugaugaauuuauagaugcaaagacgauugacaaaagccuggccuuuaaaagaaagcuuguagaaucaaagaguauggacaucuuuuuggagagcuggaacuaauuucuaugaguugaaaaacauuauugcuaauaauugaacucucauuuuauagucaaaugcuuguuaagaguauauuuagcuuggugucaucacauuggaaugacaccagaaucaacguaaugcaggcuugauaagagcagcauugcacaccaaagugcauuuuauguuugacuauauucaguucuacaacugaauaaaagaaaaggaagccccaaaaauuacaggcaauucauugaaguauuaucggagaagaaagaguaaaauuguccuacuauauuuggggacagaaaagaacauguuauugcuguuguuauuuaauacaguuaauaucuguuaaauuaguccuguaguauuuauguuccccuuuuaaaaaguuucacacuuauaugucuuaaauacacacuacaaauguaaauauccagcacggugucagcaaagaguuaaaaauaacugcuguaucagaggacagaaaaaaaaccuuauuaaaauauuguuauacuuuugucacaucuauuauuuaauuaguacuacuaucaguuacuacuuauugacccuguuaacucguccuguuguuuauauagcauuuuguaauaaaaauaaauaauacagaauaauauauaauuuuaaauaaaugacuauuucauguuuuuauguuaaaguaauaaaacauauauaauuauuauuacacacuauauuuuauggguuuugaucugaugcauuuguguucuggguugucuaucuaaaaagcuggucacuuuuuaaugaauguuguuggcauaauugacaggaagaaaauaaaaucaaaucauuuuguacucuaaauaauaauuuucaggggggaggagccaagauggccgaauaggaacagcuccggucuacagcucccagcgugagcgacgcagaagacgggugauuucugcauuuccaucugagguaccagguucaucccacuagggagugccagacagugggcgcaggccagugggugcacgcaccgugcgcgagcugaagcagggcgaggcauugccucaccugggaagcgcaaggggucagggaguucccuuucccagucaaagaaaggggugacggacgcaccuggaaaaucgggucacucccacccgaauauugcgcuuuucagaccggcuuaaaaaacggcgcaccacgagacuauaucccacaccuggcucagaggguccuacgcccacggaaucucgcugauugcuagcacagcagucugagaucaaacugcaaggcggcaacuaggcugggggaggggcgcccgccauugcccaggcuugcuuagguaaacaaagcagccuggaagcucgaacuggguggagcccaccacagcucaaggaggccugccugccucuguaggcuccacgucuuggggcagggcacacacaaacaaaaagacagcaguaaccucugcagacuuaagugucccugucugacagcuuugaagagagcagugguucucccagcaagcagcuggagaucugagaacgggcagacugccuccucaagugggucccugaccccugacccccgagcagccuaacugggaggcaccccccagcaggggcacacugacaccucacacggcaggguauuccaacagaccugcagcugaggguccugucuguuagaaggaaaacuaacaaccagaaaggacaucuacaccgaaaacccaucuguacaucaccaucaucaaagaccaaaaguagauaaaaccacaaagauggggaaaaaacagaacagaaaaacuggaaacucuaaaacgcagagcgccucuccuccuccaaaggaacgcagcuccucaccagcaacagaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaaguguuuaaaggagcugauggaccugaaaaccaaggcucgagaacuacgugaagaaugcagaagccucaggagccgaugcaaucaacuggaagaaaggguaucagcaauggaagaugaaaugaaugaaaugaagcgagaagggaaguuuagagaaaaaagaauaaaaagaaaugagcaaagccuccaagaaauaugggaguaugugaaaagaccaaaucuacgucugauugguguaccugaaagugauguggagaauggaaccaaguuggaaaacacucugcaggauauuauccuggagaacuuccccaaucuagcaaggcaggccaacguucagauucaggaaauacagagaacgccacaaagauacuccucgagaagagcaacuccaagacacauaauugucagauucaccaaaguugaaaugaaggaaaaaauguuaagggcagccagagagaaaggucggguuacccucaaagggaagcccaucagacuaacagcggaucucuuggcagaaacccuacaagccagaagagagugggggccaauauucaacauucuuaaagaaaagaauuuucaacccagaauuucauauccagccaaacuaagcuucauaagugaaggagaaauaaaauacuuuauagacaagcaaaugcugagagauuuugucaccaccaggccugcccuaaaagagcuccugaaggaagcgcuaaacauggaaaggaacaaccgguaccagccgcugcaaaaucaugccaaaauguaaagcccaucgagacuaggaagaaacugcaucaacuaacaagcaaaauaaccagcuaacaucauaaugacaggaucaaauucacacauaacacuauuaacuuuaaauguaaauggacuaaauucuccaauuaaaagacacagacuggcaaguuggauaaagagucaagacccaucagugugcuguauucaggaaacccaucucacgugcagagacacacauaggcucaaaauaaaaggauggaggaagaucuaccaaaccaauggaaaacaaaaaaaggcagggguugcaauccuagucucugauaaaacagacuuuaaaccaacaaagaucagaagagacaaggccauuacauaaugguaaagggaucaauucaacaagaggagcuaacuauccuaaauauuuaugcacccaauacaggagcacccagauucauaaagcaaguccugagugaccuacaaagagacuuagacucccacacauuaauaaugggagacuuuaacaccccacugucaacauuagacagauccaugagacagaaagucaacaaggauacccaggaauugaacucagcucugcaccagggggaccuaauagacaucuacagaacucuccaccccaaaucaacagaauauacauuuuuuucagcaccacaccacaccuauuccaaaauugaccacauacuuggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaaugaaaugaaggcagaaauaaagauguucuuugaaaccaaugagaacaaagacacaacauaccagaaucucugggacgcauucaaagcaguguguagagggaaauuuauagcacuaaaugccuacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaaaccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauaaauuccuugacacauacacucucccaagacuaaaccaggaagaaguugaaucucugaauagaccaauaacaggcucugaaauuguggcaauaaucaauaguuuaccaaccuaaaagaguccaggaccagauggauucacagccaaauucuaccggaaguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaacagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcauugccaagucaauccuaagccaaaagaacaaagcuggaggcaucacacuaccuggcuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucaugcccaaaacaccaaaagcaauggcaacaaaagccaaaauugacaaaugggaucuaauuaaacuaaagagcuucugcacaacaaaagaaacuaccaucagagugaacaggcaaccuacaacaugggagaaaauuuuugcaaccuacucaucugacaaagggcuaauauccagaaucuacaaugaacucaaacaaauuuacaagaaaaaaacaaacaaucccaucaaaaagugggcgaaggacaugaacagacacuucucaaaagaagacauuuaugcagccaaaaaacacaugaaaaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuugacacuguuggugggacugucaacuaguucaaccauuguggaagucaguguggcgauuccucagggaucuagaacuagaaauaccauuugacccagccaucccauuacuggguauauacccaaaugacuauaaaucaugcugcuauaaagacacaugcacccguauguuuauugcggcacuguucacaauagcaaagacuuggaaccaacccaaauguccaacaaugauagacuagauuaagaaaauggggcacauauacaccauggaauacuaugcagccauaaaaaaugaugaguucauguccuuuguagggacauggaugaaauuggaaaccaucauucucaguaaacuauugcaagaacaaaaaaccaaacacugcguauucucacucauaggugggaauuuaacaaugagaucacauggacacaggaaggggaauaucacacucuggggacuguggugggguugggggagggaggagggauagcauugggagauauaccuaaugcuagaugacacguuagugggugcagcgcaccagcauggcacauguauaccuauguaacuaaccugcacaaugugcacauguacccuaaaacuuaaaguauaauaaaaaaaaaaaauuaaaaaaaaaaaaagaaaaaaaaauaauuuucaguuggacuaaauaguuuaaaauaaaauaauaaaaucccuauaagaaaaaccaggggagcauauguaauacauauaaggaaggaauuuuuaaccaacuuauuaaauccagaauacauauguguauauauguauacacauagacguauauauauacacauauauguguguguguauauauacauauauguguauauauaugcauauauauacuuauauacguauauauauauauauguaaaguuagacauuugguuuauaugaagcauuuaaaaguagcuuuguaugagaaaaaacaccauucacaaagccaagaaaagacugacaaauuuggaaaaaauuggaacaugggggacaaacaguuaauguuuaaaauuauacagaugcuucucuaaugauuuaacuagaaaagaauagcgugugcaaaauaaaaauagauggcaucugaagaggcaaugcaaaauaguacaaauauauauguccaacagcauaugaaaaauacccaaacucauuaguggugaguacaaaauaaaaugaggggcauacugcuuuauaucuauuaaaugucuggcaauacuuaauaucuauugcugguggagauguauggagaaguguacucucacauauugcuaguggaaacaggaaaauguuauagccuuuuucaaaagcaacaucuauucaaauuaaaaaauacauagaugucuuuugguccagcaauuccauucccaggaaucuauccaagagaaauaaaaauuucggauuaaaauacaagaauacucagugcaucauuguuuauugugacaucaaauuggaaauagugguaauguucaucagucauagaaugaugauguguuccugccaggaaacauuauggaaccauuaaaaugaaucuacuagagcuauacaaggugcuauggaaggauuucuacgauguguuugcagaauauuaaaaagcaagacacagaaaguauuuauaauguaauccuauuuuuuaaaccaacaaugaccaggacuuauauaaauacaugaguauauguguaaacauguuaguacguuauuaaaaaugcuuagagaaaaauauggaauaauacuauguauuccauuuguuaucauuugaagguagaaaaauauggcuggaggugugaaaaaagagaagaauggggaaaagccaagcagaacaguaaaaauaaugcucuaaaagacaaguguaguuacauuuaugcauuuaugaaaauuacauguguguaaauaccuaauugaagguuuuuguuuuuuaauaagauuuuuugaaagucaaguuuauuaaggccuaauuuauacauagucaaauucauaauuuuuagguauacaguaaagaauacugaauaaaagcccaaauauuuuuguuuuauguuuagaauuuuuaaauaccaucauuaacauauacaguaaaauaauaguuagcuuuugaguccuaugauuuaugaguguauaaguccuaggguauucauaauuacaugcucauaguugcuuugcucuaauaacugauuuauuccuagucaggccaggagggccauugacacaccuuaacuuuaaacugaauaauauguuuacauaaaauuauaauggaagaagauuggaagaaacccaauacacauaaaauuuaugauaaaauugcuagaucuugccaucuguccaucuauauuucccuuucccaaccacuguuaauagguaugugcauauggauucugaaaaaauacuagggagaaaguuugcuuuugaaauuauauuguaaaacaaccuaaauccuaaaauaagugagacauuucuacuuuuauaacagaaaucaauuuuaucucuaguugggcucaccuucaugaacagcauuuguucucauuucucauacuuaaaauucccuaaauggcuguauuauuucuugcccuugguucuuagauauucauuuucuuuugcuuggaguguuuuccuguucaccuuccccucucaguucuacauuuuuuuauuuguauuuuuuuuugagucagacucucucuuugucgcccagguuggagugcagaggcgugaucucagcucacugcagucucuguuuuccggguaaaagugauucuccagccucagccucccaaguagcugggacuauaggcacaugccaccacgcccagcuaauuuuuguauuuuuaguagagaugggguaucaccauguuggccaggcuggucucaaacuccugacccaaagugaucuagcuaccucugccucccaaagagcugggguuacaggcgugagccaccauggccagccucaguucuacuuucuaccauccucucuaacuucuacuaaucuuuucauaacugggaucagcuuagaugucacuuauuccuaaaaauucuccaggaccccaggcuuugguuaguguccccuuauaugauccuaucgcaccuuguauuuacuccuaaagcagcauuuuagcacauugcauuauacuuaccucuuuugacuuuguucuaugccauguaacuguaaacuucugguaggcuggaacugcaugcuuuucaugcuaguaucaucaccucuccuaugucuagcacaaggcccaauauuaucaggaguaggcaagugauaaauacuuuuuguugaagaauuauucacuuucuuucuuucucguggucacaagaccaccauaccuugaacucccuauucauucaacuauuacuauauuccaauucucaaacauugguaauaaggaccaaguaauaacggaauguugugacagaucaaugauauuucuacuauauauagacuauacauaguguuccaucagaauaaagguauuuaaguuaccauuauuaagguaaaccauugugguuuaaguagcauagauaccaaaagauucaaaaaguguagguaugacucagcacaguuucauagaauguuuugaaauguuggcaguguucuaugucuaugcuguccaauauauacccacaagccacauauggcuacugagcacuugaaauguggcuaauaugauugaggaauugaauuuuuaaauuuuauuuaauuuuaacacauuuaaauuuaaauuagucacauggggcuaguggguuaucacauuggacauugcaaauuugaagauauuuguuccuauggaaaaguaugauuuuugccccccagaacuacucaagaacagucauuuuuggcauauaaucauagaugggcuugcauuucaauuagcuccuucauaucuauacauuacuauucccaauuauaggcauaccucagagauacugcagguucaguuccagaccacagcauuaaaacaaauauugcaauaaagugaaucacaugacuuuuugguuucccaguacauauaaagguuaugccuacacuauauugaagucuauuaagugugcaauggcaucauguuuauaaaagccaauguacauacccgaauuaaaaauauuuuauugcuaaaaacugcuaacaaucaucucagccuuuagcaaguuguaaucuuuuugcugguggagggucuugcuuccauguugauggcuacugacugaucagggugguaacugcugaagcuuggagugucuguggcaguuuuuaaaaauaagacaauuaaauuugccacauucaucaaauuuuucuuucacaaaagauuucucuguggcaugugaugcuuuuagacaguauuuuacccagaguagaacuuucaaaauuggagucaguccucucaagcccugcugcugcuuuaccaacuaaguuuauguuauauucuaaauccuuuguuguuauguuaacaauguuuauaacaucuucaccaagaguagauuccaucucaagaaaccauuuccuuugcucuuccauaagaagugacuccuuauucauucaaauuucaucacaagauugcagcaauucagcuacguugucaggcuccaugucuaauuacaguuaugucuaauuacaguucucuuaccguuucuaucacauuuguaguuacuuccucuacuaaaguguuaagccugugaaagucaucuauggggguuggaauggacuuccuccaaauuccuacuaauguugacauuuugacuuccucccaugaacagugaauguucuuacuggcaucuagaaaggugaaugcuuuccagaagguuuucaauuuacuuuguccaaauucaucauaaaaaucacuuacauggcagcuauggccuuauaaaauauauuucucaaauaauaagauuuaaaagucaaaaguacuucuugaucuaugggcugcagaauggaucuuguguuagcaggcaugaaaacauugaucuccuuguacauccccaucggagcucuggagugaccaggugcauugucaaugggcagucauauuuugaaaguuuuuuuuuucugagcaguagaucucaacagugggcuuaaaauauucagugaaccaugcuguaaccagauguggugccauucagacuuuguuguugcauuuauagaacacaggcagaguagauuuagcauaauuuuuaagguccauaguaucuucagaaugguaagugagcacuggcuucaacuucaaaucaccagcugcauuaggcccuaacaagagucagacaguccuuugaagcucugaagccaggcauugacuucucucuagcucugaaaguccuagauggaacuuucuuucaauauaagccuguuuuaucuacguugaaaaucuguuguuuaguguagccaccuccaucaauggaucuucacuagaucuucuggaucaccugccgcagugucugcaucagcaucuguugcuucauuuugcacuuucauuuuauggagacggcuucuuuccuuaaaccgcaagaaccaagcucuuaucuucuaaauuuucuucugcagcuuucucauguuucucauagaggugaauagaauugaaaaaaguuagggccuugcucuggcuuaggcuuuugcuuaagggaauguuguugcagcugguuugaucuucuaacaacaccacuacaacuuucuccauaucagcaaugaggcuguuucacguucuuuucuuuucuuuucuuuucuuuuuuuuugagaugaagucuugcuuuuguccccuaggcuggagugcaauggcacaaucuuggcuaacugcaaccucugccuccugaguucaagcgauuauccugccucagccucccgaguagcugagauuacaggcgccugccaccacgucuggcuaauuuuuauauuuuuaguagagacaggguuucaccauguuggccaggcuggucucgaacuccugaccucaggugauuugcccgccucggccucccaaagugcugggauuacaggcgugagccacugcaccccaccuguuucccugucuuaucauucaugcauucauuggaguagcacauuuaauuuccuucaagaauuuuuccuuugcauuuaacuuggcuaaucaucugacagaagaggccuagcuuuuagccugucuuggcuuucaaccugucuuccucacaugugacucuuccuuucacuugaacacuuagagaccauuguagguuauuaauuggccuaauuucaaaauugcuaugucucagggauuagggaggccugagcagaggaagagaaaugaguaaacugucagucggugaagcagccagaacaaacacauuuacugauuaaguuagccaucauguggguacaguucacagugccucauaacaauugcaauaguaguaucaaauaucacugguaacagaucacuucagcagauauaauaacaaugaaaaaguuagaaacuuugugaucauuaccaaaaugugacagacacuguugggaaaaauggcaucaauagacuugcuugaugcagggcugcugcaaaccuuuaauuuacugaacacacaaucucuguggagugcaauaagccccauaaaacaagguacacucaugcaucaaaagcagcuuuagggcagacaacuuuuuuuagacugacuauacagguaacacuuaacuaaauugauugccuugggcaagagcaacuacauaagaguuaaggaaaaacucagcauuugauuauugcuuaauagugaaaaagaauugcccguauaauaacacaauccucucugaaaagcaaaaugggaagauuuucuuauaaaaugaaguggaaaaugaguaaacuaacucuuaaauuaggacuugguguuggcaauaucacucgcugagcauggcaguuuucaauuacuaaauucagcauuuuuacauuauaacuuugucauguuaugaaaacaugaugacauuuuaaggugaugauaguucacagucuauuacacauuacacaaggucauuaaaaagaaacuauauggugaucaguugucacaauucaguaucucacuaacuucuuggcccagcaaugagaaaauaaagguguaauauaauaguguuauucauaauaacaugguuacuccaaauaaggauagaaugucuuucaaagaagccagagaaucaguauuuuuucucaucaauguggaaaaaauucuauaaaguggcuugaugaaaaaaauuaucauuaucaaaguuuaaagacagaggaacaaaggaagaauagaaauuuuggucagagauuaaacaggacuaaucccaguaaacauuuuacaaguaauauuuuagaagcuucagugaaaccugugucuugguuggcuuaaucuugcauagauucaauuacuaaucuuuuucauggcugaacuuuuggaaauuacuagcuagcaagaauaacucagcuguugguguuaucaggauuccuuaguuaaaaugccccucauugaaugcagcaguucccaauuuauuaaaagaguaaaccccaggaaaaggaaauaauccuaaagaauagaagugaagaauaaggcaugaaaaugggacauguuccaggacacccauguauuuauguuggguaggauaugauguauaggagaggggugagucaggaacuuccuugaguaggcauauacucuauuuucaguucuuaucaucugguuaugcuguauuuaauccaguccaacuguccauccaauccaaaccauaaucaugcuauauuuaauccaaauccaauucaaaucacacaguacaaccauuuguagcaugcaaauuuacuuaucaugaaaagcacagauuuugagucucaaauucaaugaauuuucauuaaaaaauauaccugugaaucuacugccucaguuaagauacagaacauuuccaucacuccagaaauuuuccuugcccucuuccucacccucugggcacuauugcucugauuucucucaccaugacagauuuguuuugcuggcucuugagcuucauagaaaugauaucaaauggcauguacucuucugacucuggcuaguuuugaacagcacaaugcuuuucagauacagccaacugguuuguguaucaguagcucauuauuauuucuugcaguauugaggucugaguagaccacuaugcuuuuccauuuccccauuguuggacguuuggguugcuuccaauaugagucuuuuauggauggaaguuuuccucucuuuuagguaaauaccugagauuggaacugcuaagucauaggcuauauaugccuuuaguuugguaggaaacugcuaaacagauuuccaaaguaguuuuuacgcauuuuacaucaucaauauauguaaguucuagucacuccacauuuuugccaauauuuggugcuauuagucuuucuaauucuagcuauuaugguggaugugaaauguauaucauugugguuucaauuuauauuuucuugguggcuaaugauguuaauuaaguauuuuugaguuuauugguaauuuguauauuuucuuuuaugaaaccacuguuccaaucuuuuguuuauuuuuuauuauacuauuugucuuuucauuauugauuuuaguucuuuauauaugagauacaaggucuuugucagagauauguaugugugguaaauauuuucucccauuguauggcuuaccuuuuuaauuuucuuaauagaauauuugauaaguagaauuuuuuuuguuuuuguaaaauccaauguaucaaguuuguguuuuuguuuaaggaacuuguauuuguacugagacauaguuuuaauccuacagauucauucuggaauuuuaauggaauaccugaugaguuuacucagcccuuuuaauuuggcagggcuugaacuccaaacuuugucuacgcugugguauauggcagcuaaguuacgcuuaaaucuugggccuucuagccguugcuuuuuccagcaugguuucuccccugugcauacacaguucaggguuauccaagaauuuaagggcaguaugaaugccaauuuuaggacucuuccuguucugauucucaucuuucugguauucccucuuaauuuucagaugucuagcaacccuaacuccauccugugacacuccaagccaguaaaacugcaacuuuauucuugaaugcuagcugucuugaucuguguguggacuuggaagugugcucaggggaaaagccauguaacugcgacucuuuccuugugcaguuucuucucucaagggucauaucucuuucagguucuggcugcuuuugugaaaggguuaguuugguauaagauacuaagccaauacuggaaucagaacauaacauuuuucuguguguauauaaucacauuguuuuccaguagauugauggaagcaaauggaagccauaguuuuaggauuauuuuaucucaaacugaaaugacacauuuggaagugaaauuuacuuaggagaaaauuacagaaaguuucaaugaugauaaaauuauuuuugugagacuuucuguaaucaucuaaaagcuuuuuucacuuaaagaaaugccuacaauuuacuuguaaucuauuuaccugaaguacaccugaagaggcuggucuuacucuaaauuguaggugaaacacuuuuaaguuuccuugugcuuagaagugaccacuaaugacagugcuauaaaauuuuucucuucuccagaucugcuucuuuugcauucucuaguggaauagaugcugaaucauuaaacagagugcugcaggugauucacauucaaguccauccaacaacauuuguuggguauggacugugcaccagcacucuauucggugucagaccagaagugaaaggagacaguaucauuuccugguuuuaaauauccuagaaucgaguuggaaguaaaauuuuguggcaauguuuaauucagaauaugauuuucuuagucuagauuauauauguaauuacugaaaaacuuaaaaagaaaaaauuagcauuaacagcauuauuuagugacagauuagaguggguuuuguucuaugccuugaagaaauuauaaauaaaaaauaauuacaguauauacucaauaugaaggcacauuuuauacaauucuugcuucaaucucuucucugcacacagauaugcacaaauuugcauuauuuugucugaauaaaacauagaaacagaaacagaaagcuaugaaagaggauaaagaaagaggcaaaagauaguuuuaguuugcaucuagaggugcauucuccuucaagaagaugcauuuugguagauacaaaaucuguaaauacaaaacauacuaaaaugcaaauauagauaguauuauaacuugcucauauggaaaucuucuuaaaacuggguuaaaucuuagaaaaauaaguaagauuaaucagaauaaauuugguugaaaagaaacgagagcaacaaccuaagagggaaaaguuaacauuuauucucuuugucagcaagaaaccuauuagaaaccucuuagagucagugauuugaagcaaaauucauuggugcuuagcacaguaaaaaaacuuuaaaagagagugagugagaaaggaagcaugagaaggaaugagugaacgagggaaagagagauaaagaaugaaaagaaagagacaguggacuauggggggagggauagcagcuggaagaaauggaauaauuuuaugaaguuguaagauugccuauguggaauggaagcuauaacaauaagugauaucauuuggaucuaagaacacagagucuagagucagaccgcccgggugugaaaugugaaaucugacauuccucuuauuagacuguguuaacuucaacgagcuuaaguuuccacaucccuaacuuggauaguugucauguauguuguaccagagaauguauagaguauaugauaguccauuguucguucacagcaaacugucuauauuuuuagucuuuccuauugauauuauuaaggaauaaggcugcaauccuuuaagucagggcuaucuaacagaaagcuuucaaugcaacaguuuauauuugauccagagguaucaaauauagaguagcaaaaaaugaaauucaguagauggaaguucaagugugaaacacagcuugggaauagaacauaacaggaacuaagugacuaacauuugguuguaagguagguauguaggcaaggauuuucguugaggcagaaagaaauauuuggauucaaaagaaguagaaagaagcagcugaaccugcaagcuaacaaauuugggaggcaaaagaggacaggcaaugaagagugucuugggacuucuggguuuugagauaaggagauucgcuggagugacugcucugauaaggaugaugaacaauagggacagggaugguucugagggaauuauaggaaguucucuccuaggaaagagaaaucacaaaugagcaggagagcauuaaaauucauucuauugguaagucaggcaaaacaaucucauacauaaacuaaaaaguauacugacuccuaacgcauccuaggagaagcugguaagucucuugcauucuguuucccugugaacuagaagacuguaaaacauucaucaugauguuucggagcuguagauuuucaaaacagaaacacauaaaaacuacaaguagaaauauauuuacuucaaguaacagcuuaucaaaauauauaaaauaguuacuaucacaugaggaaagacucaacaaaguaaauuaauuuucaauuuguuaaaaaaauagcugacuuugggaggucuuauaugcuuauuguuuguuguuauuguuuguuuaauugaaugaagcugagaauccaauguuuaccuaaacaaaacuaacacaucuuuuugaaacauauuuucacuuuagauuucugcucuaaaaaugugauuauuucugcauaauuacacaucuguucacugucuacugauaauuuucuuuuacaauuuucuucaugcccaugagcaauauauuucuuaucaaaucauacacuugaacauugcaucaaaaugccgaauaucaaaacaaauacauuaaguauuaagccagauauauuuugaaauuaaauacaccagccauaaaccagauccguauuaaaucaauuauauuguauguagaagaaccucauaaauguccauguaauacauuaaaucugaucuaucaaaaaccaauauccaacaaugagacagaucguguuuucacaaguaauauccaacugauauaucaaaucagacacuuauuaaucaaaacauugagcauuguuaaugcuacaacacaaaacaauguaacguaauuuuuacuugcaucuggaaaaagucuuaauauaauaacuuggucauucucaaguagccuuucuuuucuuuuuuucuuuuucuuuuuuuuuuaagaccgagucucacucugucgcccaggcuggagugcagugacgcgaucucggcucaccgcaugcuccgccucccgaguucaccgcauucuucugccucagccucccgaguagcugggacuacaggcgccugccaccaugcccagcuaauuuuuuguauuuguaguagagacaggguuucaccguguuagccaggaugguuuugaucuucugaccucgugaucgcccuccucggccucccaaagugcugggacugcaggcgugagccaccgcacccagcccucaaguagccuuuauuuucuaagaaagccauauugggguauuagaaauauuauuagcgauagccuaagaagaauuuauuguacauuaaacauauacaauugcaauauuucuagaaauuacaaagguuuacuagggcuaauuuguaucugaauggcucaauagugaacuagauaauaaacacaaggcaauaggaaauuagcaaaaagugcauagccuuuacauauagaucucauuucgaacccaguucugccacacagauguagaauaaacaaauaauuuacuuaacuacucgggaccucaguuuucucagccauaaaauucgugucaaaauacuuuccuuguggaguuuugaacacuagcgacaaggcaagaaaaauaaauaucuagcacagugccugccacauaauaggcgaucaauacaugguagguagaaauuguuauuaaugugguaccugaagagcaaauaacgaucucauuuuauuuguauucuauaugaucuuuacacagaaauuaaaguaauauaaugaugagggaaucuuaaaauauuggaagaauauuuucacgguaauauuauuaccaggaagaauuguggaaaguuaguugugcaaacuucuagggcaauaaaaggccuauagguaagaagaaaucagggauaagucauuuaauagcucucaagagagugacaaugguagagaaauuauaacacaaacauuuuuacugaguucuuacugcaucccugacacugagcaaaaugcuuuucaugcaguguuucauuaaguuuuacaauaacuucaugaguagguauuauucccauuuuacaaauauugggacugagugaagauuagaggggaucaauaauuugcccaaguucccacagcaaguaaauacagggcuggguuuggcuccuaauaacagauaucagaacuuggucuaguugugaaaagauuauguaaugcaugaaaagaaggcauacacacacaauuaugaaauguuaaauacuaauaaaauuaaaucucaauguacccacgauaaggugucauaagagaggccacaacuaaaugcuaaggaauuucaugaacaaucgacauugaagaaagggauauuacaggaggcuuccuaaaaagaugaaagccaaguuggauccuacaagauagaggccuggaggucaccauuguuugaggagagcaggcagcaugucuuaaaaagcaggggaguggagggaggagccaagauggcugaauaggaacagcucuggucuacagcucccagccugagcgaugcagaagaugggugauuucugcauuuccaucugagguaccggguucaucucacuagggagugccagacagugggugcaggucagugggugcgugcaccgugcaugagccgaagcagggcgaggcauugccucacucgggaagcgcaaggggucagggaguucccuuuccuaaucaaagaaaggggugauggacggcaccuggaaaaucgggucacucccacccgaauacugcgcuuuuccgacgggcuuaaaaaacggcgcaccacgagauuauaucccgcaccuggcucagaggguccuaccccacggagucucauugauugcuagcacagcagucugagaucaagcugcaagguggcagcgaggcugggggaggggcgcccgccauugcccaggcuugcuuagguaaacaaagcagccuggaagcucgaacuggguggagcccaccacagcucaaggaggccugccugccucuguaggcuccaccucugggggcagggcacagacaaacaaaaagacagcaguaaccucugcagacuuaaaugucccugucugacagcuuugaagagagcagugguucucccaguacgcagcuggagaucugagaaugggcggacugccuccucaagugggucccugaccccugacccccgagcagccuaacugggaggcacccuccagcaggggcacacugacaccucacacugcaggguacuccaacagaccugcagcugaggguccuguguguuagaaggaaaacuaacaaacagaaaggacauccacaccaaaaacccaucuguacaucaccauaccaaagaccaaaaguagauaaaaccacaaagauggggaaaagacagaacagaaaaacuggaaacucuaaaaagcagagugccucuccuccuccaaaggaaugcagcuccucaccagcaacggaacaaagcuggacggagaacgacuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggaccugaaaaccaaggcucgagaacuacgugaagaaugcagaagccucaggagccgaugcgaucaacuggaagaaaggguaucagcaauggaagaugaaauaaaugaaaugaagcgagaaggaaaguuuagagaaaaaacaauaaaaagaaacgagcaaagccuccaggaaauaugggacuaugugaaaagaccaaaucuacgucugauugguguaccugaaagugauggggagaauggaaccaaguuggaaaacacucugcaggauauuauccuggagaauuuccccaaucuagcaaggcaggccaacguucagauucaggaaauacagagaacgccacaaagauacuccucgagaagagcaacuccaagacacauaauugucagauucaccaaaguugaaaugaaggaaaaaauguuaagggcagccagagagaaaggucggguuacccucaaagggaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuacagacaagcaaaugcugaaagauuuugucaccaccaggccugcccuaaaagagcuccugaaggaagcgcuaaacauggaaaggaacaaccgguaccagcugcugcaaaaucaugccaaaauguaaagcccaucgagacuaggaagaaacugcaacuaacaagcaaaauaaccagcuaacaucauaaugacaggaucaaauucacacauaacacuauuaacuuuaaauguaaauggacuaaauucuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugaugaaacagacuuuaagccaacaaagaucaaaagagacaaagaaggccauuacauaaugguaaaggcaucaauucaacaagaagagcuaacuguccuaaauauguaugcacccaauacaugagcacccagauucauaaagcaaguccugagugaccuacaaagagacuuagacucccacacauuaauagugggagacuuuaacaccccacugucaacauuagacagaucaacgagacagaaagucaacaaggauaccgaggaauugaacucagcucugcaccaagcagaccuaauagacaucuacagaacucuccaccccaaaucaacagaauauacauuuuuuucagcaccacaccacaccuauuccaaaauugaccacauacuuggaaguaaagcacuccucagcaaauguaaaagaacagaaauuauaacaaacuaccucucagaccacagugcaaucaaauuagaacucaggauuaagaaucucacucaaaaucgcucaucuacauggaaacugaacaaccuccuccugaaugacuacuggguacauaacgaaaugaaggcagaaauaaagauguucuuugaaaccaacgagaacaaagacacaacauaccagaaucucugggaugcauucaaagcaguguguagagggaaauuuauagcacuaaaugcccacaagagaaagccggaaagaucuaaaauugacacccuaacaucacaauuaaaagaacuagaaaagcaagaggaaacaaauucaaaagguagcagaaggcaagaaauaacuaaaaucagagcagaacugaaggaaauagagacacaaaauacccuucaaaaaauuaaugaauccaggagcugguuuuuugaaaggaucaacaaaauugauagagcacuagcaagacuaauaaagaaaaaaagagaaaagaaucaaauagacgcaauaaaaaaugauaaaggggauaucaccaccgaucccacagaaauacaaacuaccaucagagaauacuauaaacaccucuacgcaaauaaacuaaaaaaucuagaagaaauggauaaauuccucgacacauacacucucccaagacuaagccaggaagaaguugaaucucugaauacaccaauaacaggaucugaaauuguggcaauaaucaauaccuuaccaaccaaaaagaguccaggaccagauggauucacagccgaauucuaccagagguacaaggaggaacugguaccauuccuucugaaacuauuccaauaaauagaaaaagagggaauccucccuaacucauuuuaugaggccagcaucauucugauaccaaagcccggcagagacagaaccaaaaaagagaauuuuagacccauaucccugaugaacauugaugcaaaaauccucaauaaaauacuggcaaaccgaauccagcagcacaucaaaaagcuuauccaccauggucaagugggcuucaucccugggaugcaaggcugguucaauauacgcaaaucaauaaauguaauccagcauauaaacagagccaaagacaaaaaccacaugauuauaucaauagaugcagaaaaggccuuugacaaaauucaacaacuuuucaugcuaaaaacucucaauaaauuagguauugaugggacauauuucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaaguccaauugucccuguuugcagaugacaugauuguauaucuagaaaaccccaucgucucagcccaaaaucuccuuaagcugauaagcaacuucagcaaagucucaggauacaaaaucaaugugcaaaaaucacaagcauuccuauacaccaacaacagacaaacagagagccaaaucaugagugaacucccauucacaauugcuucaaagagaauaaaauaccuaggaauccaacuuacaagggaugugaaggaccucuucaaggagaacuacaaaccgcugcucacggaaauaaaagaggauacauacaaauggaagaacauuccaugcucauggguaggaagaaucaauaucgugaaaauggccauacugcccaagguaauuuacagauucaaugcuauccccaucaagcuaccaaugccuuucuucagagaauuggaaaaaacuacuuuaaaguucauauggaaccaaaaaagagcccgcaucgccaagucaauccuaagccaaaagaacaaagcuggaggcaucacacuaccugacuucaaacuauacuacaaggcuacaguaaccaaaacagcaugguacugauaccaaaacagagauauagaucaauggaacagaacagagcccucagaaauaacgccaccuaucuacaacuaucugaucuuugacaaaccugacaaaaacaagaaauggggaaaggauucccuauuuaauaaauggugcugggaaaacuggcuagccauauguagaaagcugaaacuggaucccuuccuuacgccuuauacaaaaaucaguucaagauggauuaaagacuuaaaacguuagaccuaaaaccauaaaaacccuagaagaaaaccuaggcauuaccauucaggacauaggcaugggcaaggacuucaugucuaaaacaccaaaagcaaugacaacaaaagacaaaacugacaaaugggaucuaauuaaacuaaagagcuucugcacagcaaaagaaacuaccaucagagugaacaggcaaccuacaaaaugggagaaaauuuucacaaccuacucaucugacaaagggcuaauauccagaaucuacaaugaacucaaacaaauuuacaagaacaaaacaaacaaccccaucaacaagugggcaaaggacaugaacagacacuucucaaaagaagacauuuaugcagccaaaaaacacaugaaaaaaugcucaccaucacuggccaucagagaaaugcaaaucaaaaccacaaggagauaccaucucacaccaguuagaauggcaaucauuaaaaagucaggaaacgacaggugcuggagaggauguggagaaauaggaacacuuuuacacuguuggugggacugucaacuaguucaaccauuguggaagucaguguggcgauuccucagggaucuagaacuagaaauaccauuugacccagccaucccauuacuggguauauacccaaaugacuauaaaucaugcugcuauaaagauacaugcagauguauguuuauugcggcauuauucacaauagcaaagacuuggaaccaacccaaauguccaacaaugauagacuagauuaagaaaauguggcacauauacaccauggaauacuaugcagccauaaaaaaugaugaguucauguccuuuguagggacauggaugaaauuggaaaccaucauucucaguaaacuaucgcaagaacaaaaaaaccaaacaccacauauucucacucauaggugggaauugaacagugagaucacauggacacaggaaagggaacaucacacacuggggacuguugugggguggggggaggggggagggauagcauugggagauauaccuaaugcuagaugacgaguuagugcgugcagcacaccagcauggcacacguauacguauguaacuaaccugcacaaugugcccauguacccuaaaacuuaaaguauaauaauaauaaaauaaauaaauaauaaaaaaaaaagcaggggagugcagaaucaugaacguuguugaauucuacgcugaaaagcuaggacuucauucuggguauaauguauaugaugaaccugcuggagaguucaugccccauugaacuugauggggcaaaauggcaaaaucaggaaccugcugcuuguuguauagcuggaaagcagguccaguguugucaaauguucugauuuguucagagaaauaaaaaaaauccacauuacaaauuuaucuuguugucagggaaugcaaguauuuuuaaacauuucucaggccuuggccuucaggggaccaguacugggagaaggggcagggcucagacuuaguuuacccaucugcuguaggcaauugugagugugacucugcagccuuuaaaggaaguuucucauugacuucaguggagaagcuggguggguaugaaucagaaugagagcauuagcugauggcaacagaaaaacauagacaauaauacugagauuugaugcauuuucuguuugccuucucccuugaauaguuacugcaaaguaaaaggauguaaauaauaaaccauccucauucuuacagaaacacuggugaucgacuguuugcauuggcuuauagguuaucuauaacucugaacccuaauuuuuuguaguccuguaugacauuaauguaaauuaauggagaggaaaacauuuacaacauaaugaauguguauaaaaaaccuauuauuccaacugcaaaaaaaauuuugauuguuuuauaaauguucuuuagcuuauucauuuaaaaauaaugucugucucucccuccuucccucccccuuucuucuuuuuauauucuuuaggugguaguuucuauuuggaaaaaucaccucuuaaaauuuaccauauaacauguaaguacaacuuuacaaguucuugaccauauuuuuuauuuguucauacuuuucaugaagguauuuucauacuaccuuacauguuaacauuuucauuuccaaauugaaagaccacugcauuguuucuagacuaaccauaaaguaacagcaaagguuaauauaggauuauuaucucuggauucuuggaucaucccuggguuuaucuaauuuugcagaaagaaugauuaucugauaaccgcuuuuaauaauaugcaaaauguuucuuaauuauuccuuucaagaaauccacaucaaccuuacuucaauuucucuuuccuuuggaagcuuuucuuugagugauugaaugcauuuauauguaauuuacucauaaaauuauaacagggcuagguagaaaacaaugauuauaauguaauauaauaaauuuucuuuaccauuggaguaaaauaucuaaauagaaaguuaaccuuagaacacaguguaaaagacuagaaaauauuagagaaaguacaagaaauauugaagauaguggaaauccuaaaagcucaguaauacuaaaaugaggccauggauagauuucaaggagccuuuggauagaaaaaagaaauuacauguuuuaaaauauacucuaacuaaaauuuaauaacucccccaaauauggauguaggcaaaaaucacaguaguauuagcaguacaugucacuuugcuaucagcaaaaauuacagguauuuucaugauaguauuauugcugcaaguaucucaaaauacaaucugugcucaucaguagugcagaauuaacauaucuaucaaauacguugcuagauuuuguuauugaugcauucauaauuguauuccuauauuauacuuuuuaauauuuagauaacugcauuuuaauaaaauugguuuccuuuguaauccugugcaucuaauuuuauacaauuuuaaauauaguuauauaggcugugcucagugucucgagcagucuguggcacaaagaaugcuggguagaaguuucagaggcagagaacagagggaauaaagagaaaugauagacagaaagaaacuucauagaggagaagagaucuaagucuuuagauuaaaugaauucagucaacaucagugucugaaagugauuagcucucuugggaggagauuggggcuguguggaggauguauaauuuauucuaauuacuuucacuuuauuugaauuuuuuaacaaccugaauguauucuuccaugaauuuuuuaaaaggguacauauguaugagguuaaaaaagagagaagaaagagaagguaauacuuugguauuacugaagcaacugcccaugcuagggaagaucagcaucugagcauuccagaucaucaacagccuuuguguccugaucuuacaaguuucaauucagcaacagguccaguggaacagaagguuuugcauccagaccaucauccuaggauugaacccuagcuccaucaugaacuggcucaguagucuugaguaaaucaucuaagcuuucugacauucaguuucuucauuuauaaaauuaggguaauaucuaucuuaccagacugauaucagaugagagcuaaugcaaauauauguaugucaagugucuagaauaguguuucacauauaauaggcacaaaaauggcaaucaccauuauuauugaucuuaggcugaaagcuagggcaagcuauuuaaggauuuauaaaacuacuuaauggcagagggguacucauuugaauggagucaagaaucuagggauagagacagauuaggucuuacuguaauguaggugagcagaagaauuggagauaaggugaaggauaugagaaaaguuuaggagacagguaucuccagauuugguggccagauaaguccugaguaugagggaaacaucuggugaccccagaugucugaacugguugaaugauacggguggugguacaucugcagaaaugccagguuuugggcaaaggaugauaugauuaguuuggaauauguggaaauuaagaucucuaggaucacucaaguaguuuaaguagucaagcauaaaaugugcuuggauauagaggucagacacucaggaguagaaucucugcuggagccauagguuuggcugucaucaauuuaacagauauuaacaaacucauggguuuauguaaaaucaccacaggaaagugcaaaacaugagaaugaagggcucgggauaaaguucuagcacacaugaacaauuuaagcaagagcaucuuuuauuuauuuauucaguaacuaaagguggauaugccauguacaagagagucuucaaaaaguucauagaaaauguguguuaugaaaaaacuaugcauagauuucauuuuuuuuguaccaaaauaacuuguauuaacuuguuauaacaugucugggcaggaucuaguuugaagcaugaagaaggauaagauaccaguuugaaaggugccccuauuagcaacaugaacuccccuaaaauugaggcaagagcaaacaucaaauuuauggagaagcugggguggaagaauaaugaaaugauuaaugcuuugcacaaauuuuaugaggacaaugccccacaagaaagcaguuuacaaauggaccucauuuuaagaaggguugagaccauguugugggaugaagcccucagcagcagaccauccacaucacuuugugggaaaaaaaguuaaucuuguugaugcccuaauugaaaaagaccagugaaacaacagucaacaccauagacaucuuaauugacucagcguacacaauucuaacugcaaaauuaaaguugagcaaacuuuccacuugcugggugccaaaaucauugugcccagaucacucacagacaaaaacggagcuuucaaugaaaauauuaaacaaaugagaucaagauccugagggauuucuuugaagaaucguaacaggaggugaaacacagguuugccaguaugauccugaaaauaaacucaaucaaagaaauugcuacuaagaggugaacuuggucuaggcaaagcaaaaguggacugguaauagcaaaggccaagguaacaguuuuuugggaugcucaagguauuuugcuuguugacuuucuggagggccaaagaaugauaaccucugcuuauuaugaaaguguuuugagaaaguuagccaaaguucuagcagaaaaacauccaggaaagcuucaccagagaguccuucuccaccacgacaaugcuccuacucauuccucucaucaaucaagggcaauuuuaugagacauuugaugggaaaucauuaggcauccacuuuauaguccugauuuagcuccuuuugacugauuuuuguuuccuaaucuuaaaaaaaucuguaaaggauacccauuuucuucaguuaauuaugcagaaaagacagcauaaacauaguuaaauucccaggacccucaguucuuuaggaauggagcaaauggaugguaucaucauuuacaaaaaugucuugaacuugauggagcuuauauuaagagcuuauguuaaauuccauuucuaaugaauuuuuugaaauccccaauauauucuuugacucauacuuuuauuguauccucuuacaaaaagagaauaaauuuaagacuagaacacaauaguucaaucaauaagagaaaggaaguaucccucaugucaaaaaacaacauuuucaaccauugagggauaguauaauaaagaaaggaagaaaauuuuuuucaaaagcucuacuuaaauguuuaucaaaaagaauuguuaauguauuuacugauucugucaacauccucaaauacuuauccuauuuaaggaccaguauucaaaauguucauauuauuuuuucccaguuuuauuuauuaaccaauauagugacaauauugcuuucuaguuuguuuguuggcuuauguuuacuuucaaaguuauguuauaagagagccuuuagagggauagcccuucuauuuaaaauauuuuucaagaaauauguuuuuucccaagguaaauucauuuaguaagucaaggaacuucuagauauauuuuacucagaaacaguugugucuuuaugaaacuguuuuuauuucauuugugaucuaagaccggaacccuaaaauucuuuccaauuuaauagaggucauuuuucaaugacucuagagaaauguuucagcauuuuccaucugcuuccugugguucccaaauccaauaggacuguuuagugaugucuuguucauugguuuguuuucucuuuuuucacuacucuucaaacuuuugaaguucuaguuguuguugugcuauuguuguaguuuguuugcaaaaagcuugaaggcuauguauuaguugucaauugcuaguguauaagcuuggaggugaauucaaaagugagaacugaaggagaauggaugugucugaggaacggccuuggacagaauggacccuaagaugagaauacuggaaaauuggaagagagagaaauuuuguuauaucugauucugaccccugccacuuccuagguauauaaugcuggucaaguuacugagccuuuuugaacuucaguuuuuuauguguacuauaauaauauaacuacuugccaggauuguuauggggauuggauguuuguaaaguauccagcacuaugccaagaauauagcaaaaaacauucaaugagaaucauuguuaucuuucuuccucucauuaucauuuagcauugagaaaauucccaagaacuggaucaauauuaauaauaacagaaaaaaacguccacagcaccgaagaagaaagcagcuaaugauuugcuguuauuuauuuuuuaagcaaagagaaguguaacacaaacuagaaaguuaauuauaaagaauaauuccuucauacauaauuauaccuguagcgaguuaaauagugccccccucgaaauucauguccaucuugaaccucagaaugugaccuuguuuggaaauagguuuuugaagacauaacuaaggaucuggaugaagauuaggaugauucuaacuuuaaugaaaguauauuugugagagaccgaaaaggacacauggagacguagagacgaccaugauguaaagauggaggcagagaugggagugaugcucccacaagccaaggaaugccuggagccaccagaagauggaagaggcaggacaggauggaugcuuucuuagagacuucagagagaguguggcccugccaacaccuugauuucgaauuucuagccuccagaacuuugagagaaauuucuguuauuuugagccaggaagcuuguggugacuuguuauggcagcccuaggaaauuaauacaaugucauacaaaaucguuucuauugaaggggcuuuguucucucacccuuuaaagaaccuaaggaauuauuuauuuccccaaucuaaauauaaucucacaauuccguuucuuuuuucuccuuauuuuauuauuaaaaaaaacacaaauacauaacaaguaaggucuccauuauuaaacuggaauaugagagagauaaauacauuuuguaagugucagaaauuauauuuauuuuaggcaaaugucugagaugaucgcuacuucucauucuauuucugauaaaccugaagaaacuguaaaacuaaagcaacgucuagugagaaacaaguuaaaauaauucuuuuaaguuaagagggcaguguggugggcagaauaaugcuuuaucccacuccaauaugucuaccuuccaaucccuaaaaucuguccauaugauaccauagaugacaaaagagacuuugcaaauaugauuagggugagaauuuucagauggggagauuaucugggaugauccaguugggccuaaucuuaaaggacaaggguccuuuuaagagacagucaggagggucagagacagagggagauuggaugauacgaugcuguuggcuuugaaaauggaggaaaaggcuuugaguucagaaauguaggugacuuguaggagcugaaaaagacaagggaaugggcucucuccuaaaaccuccaggaagaaaacagaccugcugacaccuuaauuuuagccaguaagauccauuuugaacaugugacccagagaaguauaaaauagcaaauuuguguuguuuuaagccauguuuguaauaauuuguuacaggagcaacaggaaaucaauacauggagcacaaaauaugcagagacuuucuauaaaauauaaggaaaaauuucaaccacaaaaucuuauguuuuuaagaguugacauuucuaucuucaaugauaaugaacaaaagagaacauggcaucucuuuaaaaacaggaguuccugaggauccaaaguacugcucagucuaauuugcaaacugagugucacaucacauaaaauuauucaauaaugcaggauugauagagaaagaguucuccaucaggauagagauauccugauagagauaugcaggauauuucagugaaagaguucugaguuaauuagcagacauagaauuuagcccugacuaucucuagcagguuguagguuuaggguaaguuacuuaauuuccuuggauaucaauuuucucaucuguacaugaguagguucggcauuugguccuuucuaguuuaaacaagcuauaagacagaaacaaaaacaaaaacaguucagagcagcccucuuaacucugugacucuuggcuucccuaacauuaucaauuuaaaauauuuuauauuuccagauuuacuauaacauauuuacggauauaaaugcuguguaguuuagggauuaauugaugaacauggaggcccuggauauaccuugaguucuguuuuauucuacaaauaacucuuucuacuuuuuucacuuugauuuuuggauaauuaaccauuuauaauaagccccauuucagugagacuuaugaauaagaaaauauucuccuuucaccucuaucacucaggaaauuccaaaaaucuaaacuaacacaagaagagaaaaccaaacaaugcauguucuugcucauaagcgggaguugaacaaugagaacacauggacacagggaggggaacacuacacacggggggcuguuggggggugggggacuaggggagggauagcaugaggagaaauaccuaaugcagaugauggguugaugggugcagcaaaccaccauggcacguguauaccuauauaacaaacccgcauguucugcacauguaucccagaacuuacauuaaauauauaauauauauaaaaugacaauuugcaaauacuguaaucugcacauguaucccagaaguuaaauuguauauauauauauaaugacaauuugcaaaugcuauacaucagguuauuguuauuuugugguauggggguuacugggggggguuguuuugagaacuggauauuaaacgcuuaccaauaccaaaaaaaagaaaaaaaaaaugcucuuugccagggacuggggaagaggaucucacuuuccacuuuccucagugacaguuuucugacaauuaaccauguaaugcuuugcagaguguuucaaaaauaugccaagggaaguggugaugcucauuuagaauauggcaucaugacauacgaaacaaaaaacugccuaaaacauucaugccuggugcaacaaaacaguuaucaagucucuagaugacaaaacagucaacuuucauagcuaucuuguaaguuuuauuccauacugcagucaauuauggauacauguggcugaacuacaagccugaaaacacaggaguucuuucucgaaauauucagaaagaaacaauuuuugugcgucagugggugcuauugcaucaacacaucaguaucucuccccacuugccuacuuuuaugguaggaaacggggaagaauaagauaauaguucaucugucacaguuuaacaaaagcuuccuaucaccuucuccauguucaacugaucuguugauauggcugcauaaugucucauucuagaaguucuagagacugugcagagcaaaugcuggcagcacuucacugaaaaaucucaccccuacacaccaaagaagaaauguuuucaucaauauucacugaagucacuggcacucauucuuuuuuauauuaauuguacaucuguuaugugccuucuacaaaaaugaaaaggcagaauacagaugaaauaucagagauguaaacucaguccauucuucaaaauaauuuuuggagagccuuaauaacaaagaacauagaucagagcauuggagaugauccgaaugacagaugcaugcacaucuucucugccagucagucuuauuuuccuccugaucacucagucuuugguuggauaaagaagugacagggauaaagaaaacgaaagcaagagggaguuggaaagccugagaggaauguuaagcaaaccuuagacauguggacucucuuuagggccagauguaggcuaagggagauuggugugggcaagcguugccucaaugcauccuaaacaaaugcaggcucacugagaagccccuagagcucaaggucagugucccucaguugucuggcaaaauuaacauacuuuaauugcaaucagucaagaccacugucucuuucaacaccaacuaccccucuaucauacuucccauuggucagguggcgauggaauagccuuaaguauuuuuuuugcaugaggguaagaggaauuucacuuggguauauuuuaaauaaguuuaggaaggaaaacuuuaggugauuuggggucauuucccuauaugguuaauuguguggaaaugaccgcagaucaccuaaaguuuugcaguuaccagcugucaggacuggaauauuccuaucaccuauugggcugucaauauugagcuucccgacaaaagguaccagaguuggauuuuguacugugauaugaacguguccucuggugcuugacacuggaacuguguggguaguggaggagaaaaacgguuuggaauguucagagccaaaagcuagucugugaaauauucuuccaaaucugacaguucacauacaaaauaaacuugauagaggauuuccuaaauuuugcaacaauucuaaaaauguacaugucauaaccaauaaugagcugugaagcugaaagaaguuauuucagacugucaagaauaaaaaaaaaauugauuuggaucacuaugcuaguggaaagacauuuucuaauugcucuccagaaaugcuccuacgaaguccuucauaaagaggaaaucaaugaguauacagauauaaaauuauaggaaaaacuauuauggaagaaugucugacaguuaaugaaagcaaggcagccgggugcgguggcucacgccuguaaucccagcacucugggaggccgaggcgggcagaucacgaggucaggagaucgagaccaaccugacuaacauggugaaacccugucucuacuaaaaauacaaaaaauuagcugggcgugguggcggacgccuguagucccagcuacuugggaggcugaggcaggagaauggcgugaaccugggaggcggagcuugcagugacccaagaucgagccacugcacuccagccugggcuacagagugagacuccaacucaaaaaaaaaaaaaaaaaaaaaaaauacaaaaaacaagacaagguucuuuuucuggaguuugugauaccuauauaucagcuuuccgagcuuuguaaugugaugugauugcuuuucucauccuaaguaaauauucauuuuuguaucuaauuuugaauuuguaaauuuguauucuuuucaaaaaacaguauuuccauccccaaccccuccccacuuuuaacaguauaaucuuuagaacccacagaaccuggaucugugucuaugauaaggcuaucaaaauugcucagugggcuaaaaauaucauaaccaucucucaaaauaccuauuuuucuccucaggaaaccguuucuaaaagauauacaucugaugaauugggaaugcucucuaaguggauguaagcgcaaucccgugcagacaagagaagccuucuccugaauguugaugggaggguggaauagcacuguuaguguugcuaugguagcuaagaugaaaccacggaagagcagauaaaacuuuagguguagcagcacuuugcugugaaagaaguucucaacaguggccacccucaaaugaaaccugcugcacacacauccagagagcaauuaugagaaaaaugccaucuccuugcaaaucuuacucugccucuguaauuuucuuggcacaaacacgccucuucuaaauaauugugcccauuuuauuguuauuacccaucacauuuucuuuuuaaagucaaaacagaaaacaauaugaccugaguuaaguagauauuaaaugcaaauuugcuuccuaauaauauuaggccuuuuccagaaagcugacaaaacuacuugcacgcuuuauaaagcacagaacacuucaggccugugccauuucacuuuguaaaggggaguacagaagacuugagggaaacauuugguucauguucacuuucagcuccaugaaggcaaggacuaguuuuaucccuaccauuuuguucccaguaacuccuguggucuggcacauagcauuuguuccaugaauaaauaugcaccaaaauauguaaucuuuuccuccaaaaaauuggcaaacauuuacugauagaauuucaaacagaauuuaauacaugcaugacaauguauuuucaauacucuuucuucauauccuaaaucuugacugaauuuggggaaaauuaucaucuuguuucuucuuuuguuuacuuacacuuucccuuuuauuuuuuauauuuuugaauuagaaggguccuucaaucacugugguuuuuuaguggcugccuuugcauuuaaaaguguuuucucuucuauaaauguuuccaugacaacucccugaugcccacccccuccucuuacaaagcacagacauuuauuaggaaauccauaauuguacuuugaccuuauuccuucauauuucugucugccacacugggcuuuaagauauuugagggcuuuguaugacgcuugaguguaaacacuuaauacaugcuuaauuaaggaagaaauggcagacucuuugucuauauuaaaccaaauggguaaaaaaacacacauuuuuggggaaaggcagaugauuuuuugauuuguauaauuuuccuguuauauuaaaaacauggaccuaggcaauuugaauauacuucuaaacuauuuuuccuggaucaaugagaaaacagaaacaauauuuguucaagcauuuuucuuuuucauccuuccauuuccaggaaaacuguguccucuuucuuuucuucacccuuuuuuaccugaucuccugccccucccaaccaauaugaaucaccugaauauacucugaacacuaaaacacauauguacuuuuauguuccuuuucuucuggaaagcauaucucuuuaaagaaaauucuuggaucaagagaaaaaaaauaaaaggaaaugcacacguaucgaagaaccagcaacacagacucacuaaaacgucaaaaaaguguugugaacuacauaugggcaauauguacuucaugugggcaauauucucuauauuugaaaaauauauagauaauuuaauagcuucuaaugcaaaaaagcaaagugauacuuaucagguuuuuaaauaucuaugaaguuauuguuaaaaugaccaaaaguuaauuaaaauaguguuugcaaaauaaauauauugacuauuucaacuucuacuuguccugacccccaaaaaguagcauuuuguggucuaaucccuucaaucucuucccaaagcaaagcuauuuugucagcggauuuuguuuuuggaugugaagaggagaguaguggagucaaucagaggguacaacuguugcugcccauaaggcaguaaaauucacuggguggaaaagagagaaugugaguagaaaauugauugcuauugaugcugccagaaacauuccuugcucaaaaggaggucuuaaauucuaaaggguagcauaguggcagggauaacuugacuaucauugagugccuauauccacuuuaacauuuucacauguaagcaauaccaaaauauccuuauaucauaggauguuacagguaagugaauucuauauagaaguuucaauaaauaucacaagcuucucaauuaaaauaucuuagcauaacuauuuuaaaauguauuuaacucagauuaccaaauaagacugcccaaacucaaaaagguuaggaauacaaccagaauaguuuccuccuuuuagaauuaaaaacaccaaugcccaaaaauaucaaggccuucacuaacuugugagaaugcagugcuaaaauauagaauuuauuuuauauauaaauacuccaaauuuugaggcuguaaaauauuucugugugaauuacucaagaaaucuauuccuuuaugaaguauuaaacuggggcccauggaugagagaucagauacaaauuaaacaaguacaucaggcuaucuuuauaucaguaaaauauaacacuaacauuuaaaauuuauucuggaccugcacuauucuuuucucauauuauuaacuaauuuaauuuuuauaacaaucaugugaaggaagaaaccauuauuauccucauuuugcaaaugggaaaacugaggcucaaagaggucaaauacuugcucagggccacaauggcuguuaaguggcagauaugggaaggauucggcuucuacaaaaccaucaaagccuacauauuccaauauaucauuaaauauuagcuuugauguuagaaucaagguaacaugauguuagaacagaguccuugccacuagaaaauuuaucaucuugaaacaaggaguacacacgugaaccaaugaagaagacuauggaggcaaaacaaaugccaaaauaugugguauagcaaaguaauagaaaugaaaugggaaugucaauuacugcuuacauuuguguguagacuguuacauugguggccccaaaugaacuacaccuccugggauccaugugacuguguugucaccucacacauuggcugugggauaaguccugugauuugcucuggccaauaaaacauuaacaagcauaauacaagguaagacuugaguuucucuuggaauaggcucuccuaagaucccugaaccacuauguaaaauguucuggcuaugcugccagagaaaacauaugguaauagagaugcccagcuagaaucaguuauucuagccaggucaguuaaggcaccagacgagugagugaagaagccauccuuggacaccauuuugagcagaagagcuacccagcugauccuagacuuuauagaguugagaaauaacccuuauuguguuagcucaccaacuuuuugugauuuauuacacagccacagauaacugagacaacuuauaaagcacuauaaaguuuuugaauaucuuuuauucguuaucuuacuuaauauuugauaugguuuggcuguguccccaccaaaaucuuaucucgaauucccacauguugugggagggaccuggugggagguaauugaaucauggaggcaagucuuuccuguguuguucuugugauagugaauaagucucacaagaucugaagguuuuaaaaagaggaguuccccugcacaagcucucucucucugccugcugccaaccagguaagacaugaguugcuucuccuugccuucugccaugauugugagccuucugcagccacauggaacuguaaguccaauuaaaccucuuucuuuugucaauugcccagucuugggugucuuuaucaguaguaugaaaacagacuaauacaauauucaguacaauuccacagccauuuuaauaagauggaaauugaaccuuggaaauguaaacugacuugcccaaagucauauaaugaaggaagcaaaaauuucauauuuaacacaggcuuucuggcauguguuugcaagcaauuuucacuacaggaaagauaaaugauacuggaagagaucaaugugagauaggcauagcuggaggaaguacaauucaauuugugccuuggaggaaagaugggcauugaauagggacugugaauuuaagucacaaucccaaaccuuuauucugaacauauguugaaauggaaaauacaaauguaaagguaaaauauuacuauuuccuaucucuacccucuaucaaugauuauagcauccuuauugaguaucuacccuucaauuauugcccaugauuucucuaauucuuacaacagugcugaaauaauuuccuguuuuacaaauaaacuaagucucaggaaucuaaguuuagcuaauaaguuguggaguuggaauuugaauccauuuguauuagguuccaacucauaaauuauuucaacaauguuuuaucuacauguggaacucuauuugcagugguccaggguuacaugaagguugcaaagcucccaaaagaacaugauuuuauuaagaaggauaucuaugauucccaauuagcauacuagagauauacuaaaauguuagcaccauaguccuuaaaaauuauguaaagggggaucuggauauacuucauagaauuaaaaaguccagcagcagcaauauuaauagauaguccaugcuuuacuaaggaggaucuggcagaaaaaaucccauagaugucucucucauguuucaaguuaaucugcauuauuaaauugauucacagcuauccaguagcaaucucauuugcagcuguccaaauuauugaaagcacccugaugaagauaaaggcagcauacagucauguugcauuagaccaauuucagucuucuuuguuuaaaaagaugauauacauuaacauguauagcacugugccagacacaugauggacacuccauuagugcuaguuuucugucucuuguuuuaaauagcagggaaauaagaaaagguaccucaaaauucuaaucuuacucaagauacuuuaaaagaguuguacaauaggggccuagugaugaaagauaaugggauaugugcaaagucugacagguagcaaagaacaauaaaaacucaaaguuaacugaacacauuccugccuuggaauagcaggucagccugauauguaauuuauauauucucucuuucucucugucucucuccuguguauuccacgaggugcuaagcacugaucuagguacaugauauacuucagggaacaaaacugauaaagaucugggcccugguggagcuuacauucuagggggaaaugauguacuacuuauauauuucgcaguuaaauuuugccuuaggacucacacuucuuuaaaauauguacaauaauacagaccugagaaaauaagugagaggcugcaauuuaguaaaagcaugugcugcagguugcuguaucuuaggacccaauauggcaaccccucucuccauauucugaccaggaaaggggugauaugaauggguauaaaugcuacuguggguguggucgugugccugagauguagccauggaaacacagguaaugaauaaauaaauucuauuuucaaguuuccuuugcugcaauaagucuaucuaucauauuuaccauacauauuuuauuagaauuguuucauuuuuucgaccuagcuaaaauaagacauucuauauaugucaaucauaagacugacaagcucauuauuauuuuaauauacuguaaucaaauaggaaagauguaacauuuaaaaaguggagaagagaggacaaaauuauaauauaaugaggucucuaaaauuauauuaaauuauauaugugucuaaaaagagaagaaaaugauugaaaaaugaauuucuaccugaaaugcucauaauggaacucaaagcauaucgugcaaaauacuagagcauaugcuuacacaucuaaacuaacuaucuuaggucaccuugauaggcuaaaugaaaugcuucucauacugccuucuaaaugauuaugguucuuugaaagggugaauuacacaauuuuuugcauuuuauaugaaauagacguaucagauaguucaagaguuuugccgaugucuuuauacaauccucuaaaguuugacacaugaauaaguucugaauaaaaugaacacauuccauuucauaggccaaguuagaugaucuuucaagcaaucacuugaccuuuuaccucagaggaaggccaaccagcaaccaucaguuucucauuugcuucugauguuuaauucauuuaaaauuagcuuuaaaaaaccuuucuguauccaaauaucaugaaaccuuuucugcgauuaagccugauccauccacuauccuuuuuuccauuugccagugaucuagaagguuaacagagcuggggaguaaaauucuuagccucuguuucugaaacuucgguucugccuccauauuaucacaaacuuaucuucccuuuucuguaacacacugagucauuccucuuacuuuucauuucauaccuuuccauguugagcuaugcauuacuaugcauuacuuuucccauaaaauaagcauuacuuuuauauauacauuuucuugacuuaaacuuuucuucccuaauagguuuaugauaagcaacaauuuauuacagaugaugugauguugcuaaacuuuauuagucuaaaugacuaaccugaaacugucauaaauuuuucaauuaaaggcuuuaaaauuuuagguugggccuaaaaagggccuaacccuuucuauacucuuucugaaauucaugcccaaguucaguuuaaugugaaacugcacuacucaaaugaaaguuagcuuucaauggcaaucauccacaacugucucuacagauauguuagauauaauacauacuuacauaauuuauguaauaauaugcacaauuauauauacuauauacauuauaugcauuucuuccacauacuucuggggaaaaauaaccucaagaaaguuacuuguauuuauuguuagagaugagauuucaagaugaaacagagaaagaagguauguuucaugagcccuacauuuuuaggaccuucaccccugccaucugcccaaaacauuccuucucuauuugauuucuauuuagcauacuagagauacacuaaguaguagcaauaauuaauuccuagucuucuuucagagcucaguuuaaacuucuucaaagaaacuuaucuugacaucccagacaaaauaauauucucucucacccucuugcucgcucucuauguuuuauaaauagcuguuaaaugaaugaacagggaugaauaaauggaugaaugaaagaaaggcagaaggagagggaaguaguuuucuuuagggauuuuaugccuccauuuaccauuuuguaaauccauaugaagaggcaaugagaggaauucagggccaauuuaccugaugcccagccaucuacagcuagacuaucaaacuaaauccauaagaugucuauaauuauaaauuuuauguaacauaguaaccuuagucuguaauuuucuuuguauuauaauuaauuuuuucaacauauacuuuauugcuuuauuuuuaauguaguucuuagcugacaaauaacaauuguacauauucauggaguucauagaguacgcagugauguucugaaauguacauaauguaagugauuagaucaggguaauuagcaagcuuuaggcuugcuggguguuuaucucauuacccauagcagaaucauuugcaucacuuaauaaagcuuuuuaaaauaaaugauugcuauccucuagaguaguuauuuuccccgacagccccuuaaccaacuuauugucuccaccacuuuuuucuaucuuccuccacuuaucuuacuuagcuuuccuauuuuucuccuuccucaauaucaaccuaagaaguuccauucuagcauuaugugguguaaauacuaagggaaagucugugagucaacagugaggcugaaugaggcugaauuugaucagaguucuugagcagaacaaacuccagaaacaggggaaaaguauaacacaugaccaagagcucagcugagucccagcuccaccacuggcuacugagugaccuugugugacuguggacaaguaauauauaaagccuuauuuuugucaucucuuaaaugagaaucacuuauauuucauuuauuuaaaaaauauuaaugaagcuucuguuaugaucaagguacuauagacauugaugauacauuucacaaggucccuggucucaagaauuuauuaacauauucuaauaacauugagagcaugucaauaaguaagcaguaacaaacaaaagcaaacaaguuaaugugacauaauaacaaauauugugaagaaaauaacugcaguaauuuaugauggaaaguguuggaggauaugggauucuauguuagaucggguagucagguagguuucuuuuuuuaaaguaacauuugaacugagaugaaugaugagaaaaucugagagaacagcacagucagaaucacagugucuuugaggugaaauacacauggaagaaaaaacaaagaccagugcggcugaaggaaaaugggcaaagcuaggauuuguuagcagaugucaguaaagacggagguagggaccugagaauguaaacaacuguagauauaguaagaugucuggaguuuauucuaagagcaaaaggaaguagugguaauauuugaagcauaaaagugacauaauaucauuuacuuuucaaacgaucccucaggaaaaugcagaaaauggauugggguugucaaaaggcaauugcaugaguccagguaaaauuauggaagcuuugaccugaguguagcacuggauuuggugauaaauggguggauuugggauguaauuuggaaggugaaccaaaaggaugcgugaguugaggaaaagagagaaauugaggauguauuagaguaggcuucuccagaagcagaaacuaagauaauguuuuauauacgagugauuuauugaguaaguguucccacaggaaacuguggugggaguaaugaaaggagggcagggaaauagaagggcaaguaaagguaugauuuuaggcauaguccagaagacaguagcuugaacuaaauucugcaggggacucuggauaagugaugccucagaguuuguccugauuuggcaaaggaauugagguuucauacucucauaccagcuagucauuaacucaaguucucccuagagagaucuaaacuuccaggcauuuacaacuuuauaucggauuuuggcaaagcagcuccaguagccacagugccugcccaggggaaucacagguacagguguuggaaguaaaucuugcgcaggguugaggugggcgcagaaagcacaaaaaugguaacaggugucucaggggguuuggccacaauaccaacaguguucccuacgauuauacauaacaugccaacucaguguggcccccugaugaguuguuuaaaguacaguuauugaaucagaugcuucauuuuaacaagauccccauuugguucuuacacacaugaaaauugugaagcacagauauauagugcacucccugaugguuuguugcaaaggauuaaaugaaaugaugcaaacugucuuguaaaggacuauugucuuauuacaaugaugguuaugauguuguuaaugaugugcuuacugcaucuaucuauuaugaaauuuguuuuguuuucuauccauuauuauagucgauucauuucagcuuccucuacuacgguguuucucaauuggggugcuauuggcauuuuggguaggauaauuauuuugcuguugcucaggcugucccaugcauuuuagaaucuuuagaauccaugaacaugaaguaucaauagcaccuccagucuuuguaacauccaauaauaucuccacacaguuuuaggaaucccuagaaggggauuaccaaccacuuugagaaccauggaacuccucagggggaaaaucaugucuuauuuuaauugugugccuuccuuuuccuagggaauacagugccugaagcagauaagacucuuaagauauguucauuaaacaauaaaaaauaauaauuauccuauuaucucagucaauuuucacaaugaccaugcuugcaaggcuauucuaauuccuaccuuauaggugaggaaacagaaccuggaggagguuagguauguugucccaauacacacagauagggcagagcugagauuguaucuauuugugucugacugacuuuuaggcucauacucuuuguaauucuccaagcuacuugaauaaauaaaggauuucauaaguguaugacuucguuucugugaaugccagucuguugugaauacuguaaguugguuuaaugaagcagaguaaaagcuaacuuccagaagguaagugacagacagccuauaaaacauuuaaauccaaaugcauuuucacuguucauggaauuaguuuaggcugccucuaaaauccaucaacaaggcugggagcauggcagugacccuggucacaagguuacuguuccauucucuaagucucaagaggagaauggaccacucagcaagccaugggcaaagcuuacauuaauguucugagcaagucuggcacaacgcaagugaaaauaugucuguuaaauuugugccuuuuauuucccaacacaacacacauauaucuuacauuaucugucuuauuuuagccuuuucuucagaguugguaauuauuucaucuuaaccuagauaaggaaauuuuaagagauaugccuucauguucacaaaucuaagaccaguuaacauuuuauuuuuaaaauuuuaguauuuguaaaauuaaucuaagaucagaagacgccuuucucaauccuuuggcagagaaguuggaaacuuccuugcuuugauuuguacgaguguuacuaaugcauugguaauauagcacaagcucaaauuacaacuuaaauuguuuaaaagguaguuaacaugacaguagaauguuacaaugugaaaaugaaaaugguauuguaaauaggaauguggggggaaauaaccauaucagauuuaaauuuacuauaagugaaguauauguuuauugcuggaaaaauaaucaugauuuguauuuucuuauaaaccaucauugcuuuuaaaacuuuggcaugacccaaggagcuuguuagcacacagauuccuaggcuccacaacuagacauccugauucaaaaggucugcaaagggaagguggagaagggggcaaaagaguguuucuaaauagcucccagagcugcugcugcugcugcucugcugaccaccccuuacaguggcacagaagggaggauacuuuugcagacauuuaaaaaauauguuucuccuggucuaaccuugaaaguugagauaaaaaguauaaagcauguauuaaacuuuuaaagagucagguguguuaauauauaaugcauauauaaaaaaauucauucuuuguaaucacacaacuugaugaguuuuuuuuuugacauuuguuuguuuguuuuugagacagucuggcacugucacucaggcuggagggcagaggggcaagcuuggcucacugcaacccccaucuccuggguucaggcgauucucauaccucagccucccaaguagcuaggauuauagcugcgcaccacuaugcccggcuaauuuuugaauuuuuaguagagacaggguuuugccauuuugcccaggcuggucucaaacuccuggccucaagcaauccacccgccucagccuugcaaaguguugggauuacaggcaggcaugagccacugcucccagccucaacuugaugaguuuugaaaaguguauauaaucauauaaucaugaccauaaucaaaauauacacaucucuaaaaccuucaaaaauccccucaucuccuugcagucaaucccuuccccagcuccuagucuuggcaacuacucauuugucccuuugguuuuauuuucucuagaaugcccuauauaaauaaaauuauagaguuuguaaccuuuugagucugggcuucuugcacuuaguuuaauccacaauacugcacauugcgugcaucaaucauuuguuucuuuucauuguugaguaguauccuguauccugauagugucacaauuugcuuuuccauucucuaaauaauggguguuuggguucuucgcuugugccagucagguguagaaauaugguagaggacauugacgucuuagaaaaaugauaaaucacccgcagaaaaaauccuuguucccugaaugacuguguggagcaaaucccccaccacugcauugaacuuucagaugagugucaaauaaaccuuuguuggguuaagccaccaaaguuuucauacucuaauauagugccucuaaauuauacuaucaguucuaaaaagggcaagauaaugugcaugugcgugauugugugaaacuguaucuuuuccuugaugcuauauauaacucuucagagauaaacugauuccuaagaauuuuuagacucuaaaugcgaagaaagcuuagauuuaaaccuggagaaugagaaugaagaaagagguuagacguaugcuaggauuuaaagaaggaauaacuauuugcuuaaaaagauuuuucuucuuuucugcaugugaaccauacuuuuuauggaauaauuugcuuacucauugcauuucucuauugacuuuauuagagauugauucguucuuaaauuauguuugcauuuagaauguauuuucuuuuauuuuuuaauacaauagguuuuuucgugcaacagaaauaagauugauuauauucuccugccugaaaauuuaaacuucuguccauaaaaauguaggguuuuuccuuuuuuuauugaaacuuuuauagauaauuguagauucauuugcagugguaagaaaggcaccuuguacacuuugccuaguuucuccaauggugacauuuugcaaaaccauagggcaauauucacaaucaagauauugauaugaaugaaauccaccaauguuauucagauuuucucaguuuuacugguaaucucaugugugugguguauuaaguuucauaauauuuuauuaccugugguagauuuuuaaaaugaaugacucacuucuuaaagguauuuauaaucuuuauugcuauuguuauacuuuuaagagaucauuuaugaaauaaaaucuuuuaguaaggaaauauuuauauaaaguucuauaauuaagcuaauuugacaguucaauugcaacuagauauguuuuauauuaagauuuccucuuuauuucaaaagccauauaauauuucuuuuuguaaaaugcauuuaauaaguguuuucucauucuaauugaaaauguagaauauuuauuugacaaguauuuuugugggaugcuaaaaucuauuaucaggugaguaguuacaaauuauuucagauauaaauugaguaaacagugacguauauuuguaauauggugcuguauuuuccugaaauucuacuguaugaauuucacaaacccuucuuuaucuuucucucccugcuuuuauuuuuggcaaaagcuagcucaucucuguuaugcagagggauacugacuuauaagaccaguauuuucaaaccagacaacuguggugucuacuucuaauacauaaaguacagcauggcagguuaaauaaagagaagaugccccaaaauguacacucauuauucuuuagccuagggguaccauccacuuauuaaaaagcagauuuugagcuuuugugugcugucaacauguuaagagaauaaagucagugcuacugucaauuaccuugccaaaugucauacuacuuuugacaaauaucuaaguugacuacuggaaagugcacucagugcgaccuuaacuucaugucuuaccuaaguucuuucuggucuaaagaagaccacugaaccuauggaauaaaccuuucaagcuaagaacaucugagaaauaggaaaggaaaaugaaacaaaauaaauaaauaaauaaauaaaaggacauccauuaggcagauugcaccagaaaacucccuuugucccuugaagaaugccaaucacgcaaaaucaagucagggaaguucagacuuugacauauuucuaugaaacaguuucaaacuuauagauuuuuaaaaagcccuuucucuggcauuuaucugacuuaauaauaucuucuaccuuuuuuauuaauuucugaaaggauaguacugaggaggccaaguuucuauauauuuauuuuccacuguaaaauuuuacauauaauuuauuuucuuggucaauagcagaccucagaaaauuuuccucaauuaauauuaacaucuuuuucuucucauuuauuuuuuucauuauuuaauuuacagauuugaaaucaguguuacucuauuaaaauguaguaacauuuagcuauguuuguugauagcauaagaaacacuacaauaaauaguaaaugugagcaaacuaaaucugauaaauaaaaauguauucauagaauccaacaaaaacuuuucuucauggcacauauuucuucaaauguuuaagcuaaucuauguaccaaggcacugaaaagauaaaauaaaacaagccuacagagaacuucauggccacuuuuccuuuuagaucugacuuugcuuugugggaaugagauuuuuuuaaaaaacacacuauuguuaugcuucauuuaauuuauaauaaauuguaggcuuuuucuuggaacucuaauacaaucuuuaagaaauaaaguuacaugauacauaucuucaacaguggggcuuuugggccaauuuuauuuuugguacaaaucuauacgauacauucagaaaagauaagcuuauuuaguuuguccuuaggacugaauguuuacuuucauaaaagacaauagucacaacucaugaccaaaaugagaaaaugaauugcuacaauacguucaacagaaagaaacauguuuaagugaggggaccagugguucaggucaacaagauauacaccauuuagagagcuaagaaaauauaaaggauauuauaaauggaaacaaugacguuuuaaaaaacucaacagauguuuagacagauagggauauaaauggugcuuuuuaaaauauagauuuagaaacuugcauuuacuuaccuaagacugacaguuugcuuuuaauaauucaguguauuucaucauaaccaccaaauuuuauuucacuagucaugaacaaaugguuggacauuuacauuauuugcauuuuucacugcuauaaaacuauccugcacaauacugaagaagaauaaaguuggaaaacugacauuaccugacuugaaggcuuacaauaaagcuaccauaggauacaauuugacuuuaagacuuaccauaaagcuacagcaaucuaggaagugugguacuggcaaaagaacgcacagagagaucaauagaacagaauagagagcccagauauagacucacauaaauauaguaauuugaucuuugacaaaggagcaaaggcaauacaauagagaaaagauagucuuuucaacaaauggugcuagaacagcuggacaugcacagagaaaaaaagaaaucuagguaguaaccuugcucccuucacaaaauuuaacucauaauggaucacagaccuaaaugcaaaacacacacuauaaaaguccuagaagaugacauaggagaaaaucuagaugaccuuggcuuuugccaugacuuuuuagauaugcuaccaaaggcauaauccaaaaaauugauaaacuggacuucauuaaaauuaaaagcuucugcucuauaaaagacacuuucaaggggauaaaaauguaagccacagccuuggaaaaauauuugcaaaagacacaucugauaaagacuguuauccaaaauauagaaagaacuuaaaauucaaugcuaagaaaauuaaugaccugauuaaaaaaaugggccaaagaccuuaccagauaccucaccaaaaaagauauauagaugguaaguaggcauaugacaucuuauuauuauuauaugaugcuccacaucguauaucaucagggaaaugcaaauuaaaacaauaaugagcuaucacuacacacuauuagaauggccaaaauaaaaaaaaaaacucugacaaaaccaaaugcugaugagaauuuaaagcacuagacacucauucauggcugguggaaaugcaaaauaguacaauuauguuggaagacaguuugguggugucuuacuaaacauauuguuaccauaugauucagcaauugcacuccuugguguuuacccagaggaguugaaaacucgugucuguacaaaagcuugcacaugaauguuuauaccagcuuuauucauaauuuccaaaacuuggaagcaaccaagauguacuucaguaggcuaauagauaaauaaacuguuguacauccagauaauggaacauuauucagagcuuaaaaaaugagcuaucaaguuaugaaaagacauggaggaaacuuagaugcauauuacuaagugaaagaagccaaucccaagaggcuaaauucugugacucuaauugcaugauauucugggaaagacaaaaguauggaagcaguaauaagaucagugguugccaggguuuaggggauagggaguaaguaggugaagugcagaggauuuuuagagcagugaaacaauucuguaugguaguauaacaguggauacaugucauauauuuguccaaagucagaauguacaacaccaagagugaacccuaacaugaacuguggacuuuggacgauaaugaugugccauuguagaugcauuaauuacgacaaauauaccauuuugaugggggauguuaauaauaagggaggcuauacauguuuaggggcaaaugguauacggaaaaucucuauaccuuccuuucaauuuugccguaaaccuaaaacuacccugagaauuaaaagcuuuuaaaauuaugauaaacacaauuuaagaaaaauugguggugugcauuauuagggcucuguuaguacucucuaaaaagcugguacuaacauacaaucucuuuuauuuuuaauuuuucauugaggaaaauuucaaacuuacguauaaauggagaaagcaauauaaugagcuagcaugcacucauuauacucaucuccaacaaucagcaaccgauaaccaauauuauuuuguccauuccauuaucugacucccccuacugccuguugcagguuauuuugaaguaaaucucaaacaucauaucauuuaaaaaauaaacaccaaaaaggauauauuuaaaugcucagagaaaaccuaaguauaaauguaaggucauaaccauaugaaggaagcucacucaagagaaauaaauauuuaucaaauaaauauuaaauauaaauauuuaucaaauaaauauuaaauaaaaauauuuauugcuaaaauacaaacacaaaagcauugaaauuaaaaauagaaaccguggguaaaauaucuaaagaaaacaauuuuauugcauagaaugauccaugaugucuguauaaaauauauagguaggcuaggcaucccuauggcucaugccuguaaucucaguacuuugggaggccaaguugggaggacugcuugaggccaggaaucugagaccagccugggaaacccagcaaaauccugucucuacauaaauaaaaauaaaaacauuagccaggugcuaggguuuggaucugugucccaccaaaucacaauaaaauauuauccccaguguuuaagguggggccuggucggagguguuuggaucaugggcuuuucccucaugaauggcuuagcuagcaccauccucuuggugaugagugaguucacaugagaucugguuguuuaaaaguguguggcagcuccccgccacacuugcuccagcuuccaccaugugaugugccugcuuucucuucuccuucuaccacgaguaaaagcucccugaagcuccccagaagauaagcaguugugagugccauguuuguauagccugcagaaccaugagccaauuaaaccucuuuccuuuauaaaucacucagucuuagguauuucuuucuguuuuuuuuuuuuuuuuuuuuuuuuuuuuuuuacuuuaaguucuggaauacaugcguagaacaugcagguuuguuacguagguacacacuugccauggcgguuugcugcacccaucaacccaucaucugcauuagauaguucuccuaaugcuauccauccccuagccccccaccuucugacaggccccagugugugauguuccccucccuguguccauguguuuucauugcucagcucccacuuaugagugagaacaugugguguuugguuuucuguuccuguguuaguuugcugagaaugaugguuuccagcuucaucuaugucccugcaaagauaugaacucauccuuuuuuauggcugcauuguauuccauggugcauaugugccacauuuucuuuaucuagucuauaauugaugcgcauuuggguugguuccaagucauugcuacugugaauagugcugcaauaaacauacuugugcaugugucuuuauaguagaaugauucauaauacuuuggguauauacccaguaaugggauggcugggucaaaugguauuucuggcucuagauccuugaggaaucacuacacugucuuccacaaugguugaacgaauuuacacucccaccaacaguguaaaaguguuccuauuuuuccacauccucucccgcaucuguuguuuccugacuuuuuaaugauugccauucuaacuagcaugagaugguaucucauugugguuuugauuugcauuucuccaaugaccaacgaugaugagcuuuuuuucauauuuuuguuguccacauaaaugucuucuuuugagaagugucuguucauauccuuuaccuacuuuuugaugggguuuuuuccuguaaauuuguuuaaacuccuuguagauucuguauauuagccuuuugucagauggauagauugcaaaaauuuucucccauucuguagguugccuguucacucugaugauaguuuauuuugcuguacagaagcucuuuaguuuaauuagaucauauuugucaauuuuggcuucuguugccauugcuuuugguguuuuagucaugaagucuuugcacaugccuauguccugaaugcuauugccuagguuuuauggguuggucauaugguuuuauggguuggucauaaauaguucuuacuauuuugagaugcauuccaucaauaccuaguuuauugagaguuuuuagcaugaagggguguugaauuuugucaaaggccuuuucugcaucuauugagauuaucauguaguuuuugucauugguucuguuuaugugauggauuacgucuauugauuugcauaugcugaaccagcuuugcaauccagggaugaagcugacuugaucauggugaauaagcuuuuugaugugcugcuggauucauuuuaccaguauuuuauugaggauuuucacauugauguucauuaggauauuggucugaaauuuucuuuuuuuuguuguguuucugccagguuuugguuucaggaugaugcuggccucauaaaaugagucagggaggauucccucguuuucuauuguuuggaauaguuucagaaagaaugguaccagcuccucuuuguaccucugguagaauucggcuaugagucuuucugguucugggcauuuuucgguugguaggccauuaauaacugccucaauuucagaacuuacuauuggccuauucagggauuugacuucuuccugauuuagucuugggaggguguauguccaggaauuuauccauuuauucuagauuuucuaguuuauuugcauagaggugugcauaguauucucugaugguaguuuguauuucugugggaucaguggugauauccccuuuaucauuuuuuauugugucuauuugauucuucucucuuuuuuucuuuauuagucuggcuaguagucuaucuauuuuguucaucuuuucaaaaaaccaucuccuggauucauugauuuuugaaggguuuuucgugucucuuucuccuucaguugugcucugaucuuaguuauuucuugcccucugcuagcuuuugaauuuguuugcucuugccucucuaguucuuuuaauuucauuguuagggcgucgauuuuagaucuuugcugcuuucuccugugggcauuuagugcuauaaauuucccucuaaacacugcuuuagcuguguccuacguauucugguacauuaugaauuuuucuuauugaugucaaagaacuuauuuaucucugccuuaauuucauuauuuacccaguaguuauucaggagcagguuguucaauuuccauguaguuguguaguuuugagugaguuucuuaauccugaguucuaauuugauugcacuguugucugagagacuguuuguuaugauuuccauucuuuugcauuugcugaggaguguuuuacuuccaauuauguggucaauuuuagaauaagugugauguggugcugggaagaauguauguucuguugauuugggguggaaaguucuguagaugacuauuaggucugcuugguccagaacugacuucaaguccuaaauauccuuguuaacuuucuguccuguugaugugucuaauacugacagugggguguuaaagucucccaauauuauugugugggagucuaagucucuuuguagucucuaagaacuugcuuuaugaaucuaggugcuccuguauugggugcauauauauguaggauaguuagcucuucuuguugcauugauuccuuuaccauuauguaaugccuuucuuugucuuuuuugaucuuuguugguuuaaagucucuuaauaucagagaccagggcugcaaccccugcuuucuuuuucuuuccauuugcuugguaaauauuccuccaucccuuuauuuugagccuaugugugucugcaugggagacgggucuccugaauacagcacacugaugggucuugacucuauccaauuugccaggcugugucuuuuaauuggggcauuuagcccauuuacauuuaagguuaauauuguuaugugugaauuugacccugucauuaugaugcuagcugguuacuuugccuguuaguugaugcaguuucuucauagugucgauggucuuuacaauuugguauguuuuugcaguggcugguaccguuuuuuccucuccauauguagugcuuccuucaggagcucuuguaaggcaggccuggcugugacaaaaucccucagcauuugcuugucuguaaaaaauuuuauuucuucuucgcugaugaagcuuaguuuggcuggauaugaaguucuggguugaaauucuuuucuuuaacaauguuaaauauuggcccccacucucuucuggcugguaggauuucugcagagagaucugcuguuagucugaugggcuucccuuuguggguaacccaaccuuucucucuggcugcccuuaacaguuuguccuucuaccuugguggaucucaugaguaugugucuugggguuguuuuucucgaggcguaucauugugguguucucuauauuuccugaauuugaauguuggccucucuugcuagguuggggaaguucuggauaauauccuaaagaguguuuuucaacuugguuccauucucccugucacauugagguacaccagucaaacguagguuuggucuuuucacauagucccauauuucuuggaggcuuccuuuuuauuccuuuuuucucuaaucuugucuucacacuuauuucauuaaguugaucuucaaucucugauaucuuuucuucuguuugauugauucagcuauugauacuuguguaugcugcacaaaguuuucaugauguguuuugcagcuccaucagguaauuuauguucuucucuaaacugguuauucugguuagcaauuccucuaacguuuacucaacguucuuaguuuccuugcauuggguuagaacauguuccuucagcucaggugaauuuauuacccacuuucugaagccuacuucuaucaauuugucagacucauucuccaucuaguuuuguucccuugcuggcgaggaguugugauccuuuggaggagaagaggcauucugguuuuugaaauuuucagccuuuucaugcugguuuuuccucaucuuaguggacuuaacuaccuuuggucuuugaugcuggugaccuucagauggggauuuuguguggacauccuuuuuguugauguugaugcuauucuuuucuguuuguuaguuuuccuucuaacagucaggcccuucugcugcaggucugcuggaguuugcuggagguccacuccagacuccguuugccuggguaucaccaguggaggcugcagaacagcaaagacugcugccuguuccuuccucuggaagcuuugucccagagggacaccugccagaugccagguggagugcuccuauacgaggugucugucaaucccugcugggaggugucucccaggcaggaggcacaagggucagggacccacuugaggaggaagucugucccuuagcagagcucgagcgcugugcugggagaucuguugcugucuucagagccagcaggcaggaacauuuacgucugcugaagcugacuucacagccgccccuucccccaggugcucugucccagggagaugggaguuuuaucuauaagccccugacugggguugcugccuuucuuucagaugcccugcccaagaggaggaaucuggagaggcagucuggcuauagcaccuuugaggagcuguggugggcuccgcccaguucgaacuuccaggaagcuuuguuuacacugugaggggaaaacccccuacucaagccucaguaauggcagacucccuuccccgcaccaagcucgagcaucccaggucgacuugagacuucugugcuggcagcaagaauuucaagccaguggaucucagcuugcugggcuccaugggagugggauccacugagcuagaccacuuggcucccuggcuucagcccccuuuccaggggauggaaagguucugucucgcuggcauuccaguugccacugggguaugaaaaaaaaguccugaagcuagcuugguaucugcccaaguggccacccaguuuugugcuugaaacccagggcccuggugguguaggcacccgagggaaucuccuggucugcagguugcgaagaccgugggaaaagcauaguaucugggccacagugcaccguucuuuauggcacagucccucaaagcuucccuuggcuaggugagggaguucuccgaucucuuguguuuccugggugaggugaugcccaacccugcuucagcuugcacucuguacgcuagacccacugucuaaccagucccaaugauaugagccgaguaccucaguuggaaaugcagaagucacccgccuucugcauugauuuugcugggagcugaagaccagagcuguuccuauucagccaucuugccagccaccucccgucucagguauuucuuucugguaauguaagaauggccuaacucaccagccauggggucauauaccugcagucauaacugaggcugaggcaggaggauugcuugggcucaggagauugagguuagaguaagcuaggauugcaucacugcacuccagccugggugucagagugagacuccuaucucuaauuuggaaaauauguaugugugucuguuuguaccaaagaaaugauaaaugcuugaggugauggcuucaccaauugcccugauuucaucauuacacauuauaucuugugucagaauaucacaaguaccccauaaacauguacauuuauuauauaucuguaaccaaaaauuuaaaaaaauaaaaaaauuuaugugcagaaaaaagagauaaauggacaauuuaauuaaggacagagggaaaagaagauucaagcuucuacgaauaguaucaagaggguuaaauccaaaguguaaugagaauugggauaaaagcuaaagaaaaaaaggcuuuuauaaccagguuugcagucaagagaacaaagagggaugaggcucaguuuauggcagaugaugucaugaugaaaagaaaaaguaauuggguaaaguuccaauuccuuuuuauuuuuuguauauauuauccauucauagugguaauuuucuucaacauacuaauaguagaccaaaaugguuucaagguacuagagagauagugagacugaaucucacuacuguaacagaguugauaucuuagguccaaacacauuuuguuuagagauaaagucacagaaucacugucaguaauauuucaggaauuuguauuaauuaguaugggcuccauaagucauaagauagauaaauguugauucauuuuucaaacagauaauaacuauaaucuacaguugaguaaguauaauauccauggcaaaaaauuaggacacaugauuaagaagauuaacaucuuagaaacauagauaguaaaaauuaguagucuuccuguguuugauaaauauaugcuaaacuaauuuccgauuuucuuuuucucauaaauguacuagguuagaaauuaaugugaauuauauagaaccuuagacaaaucuuccuuaauaaacuuguggauuaacuuuuaaaaguuaaaaguagguucauaacuuguuguacaaguguaucuuagagauaauuuaaugaacucaugcaagccugcagguauuuguagcagucagaacaaacuauuuuauccucuauucuaguccacucuuuuuauuaggauuugaaaugaaaauguagcaggcaaguuuaucagaauacacacagcugagaggaauaauugagcaagaugaacuauaauacguauaaaccucuuccaaaaucaguuacagauauacaagaggaauuagaaccaaguuagcaagaguucccauaaaaaaacacaguuaauccaaaucaaaaccacaaugagauaccaccucucaccaguuagaauggcaauccuuaaaaggucaggaaaccacagaugcuggagaggauguggagaauuaggagugcuuuuacacuguuggugggagugcaaauucguucaaccacuguccacaguguggugauuccucaaggaucuagaacuagaaguaccacuugacucaggaaucccauuacuggguauauacccuaaggauuauaaaucauucuaccguaaagacacaugcacacgcauguuuauugcggcacuauucacaauagcaaagacuuggaaccaacccaaauguccaucaauaauagacuggauaaagaaaacguggcacauguacaccauggaauacuaugcagccauaaaaaggaugaguucauguccuuugcagggacauauaugaagcuggaaaccaucacucucagcaaaauauuacaaggacagaaaaccaaacaccauauguucucacucauaaaugggaguugaacaaugagaacacauggacacagggaggggaacaucacacacuggggccuauugggggguggggggcugggggagggguagcauuaggagaaauaccuaaaguaaaugaagaguugaugggugccgcaaaccaacauggcacauguauaccuauguaacaaaccugcacguugugcacauguacccuagaacuuaaaguauaauuaaaugcucaucaucacuggccaucagagaaaugcaaauaaaaaccacaaugagauaucaucucacaccaguuagaauggcgaccacuaaaaagucaggaaacaacaggugcuggagaggauguggagaaauaggaacacuuuuacacuguuggugggacugucaacuaguucaaccauuguggaagucaguguggcgauucuucagggaucuagaacuagaaauaccauuugacccagccaucccauuacuggguauauacccaaaggauuauaaaacaugcugcuauaaagacacaggcacauguauguuuauugcagcacgauucacaauagcaaagacuugugaccaacccgaauguccaacaaugauagacuggauuaagaaaauguggcacauauacaccauggaauacuaugcagccauaaaaaaugaugaguucauguccuuuguagggacauggaugaagcuggaaaccaucauucucagcaaacuaucacaaggacaaaaaaccaaacaccgcauguucucacucauaggugggaauugaauaaagagaacacauggacacaggaaggggaacaucacacacuggggccuguuguggggugggggaggggggagggauagcauuaggagauauaccuaauguuaaaugaagaguuaaugggugcagcacaccaacauggcacaugcauacauauguaacaaaccugcacguugugcauauguacccuaaaacuuaaagcauaauaaaaaaauuaaaaaacacauuuaaauauuucagcugacaagggcacaauguaagccaucagugugucuugacuuccaaaaaaucugauggaauuuuaauaugaguaaaguuuagguuggugcaaaagcaauugcaguuuuggccauuauuuucaguggcaaaaaccacaauaacuuuugcaccaaucuaauauauuguucaugucaagggcagcaaugugauuaagaguuacaggcuuuagagucaaagaaaauagguaucagucugucaacuuagauaagagguuuuaucucuaugugcuuucuuuccauuaccuaugaaacacuacaucauauggccccugcuaacuuucugauucaccuccuaacuugcuuauucuucucuagccacacuggauggcuugcuuucccuaaauaucacuaucucugccaagcucaucucacuucagggccuuuucugcuagccuuucccucuucugggcagacugucccacuaggcaguuauuuggcucacuccuuuauuucauucagguuuuuucaaaugcugccucccuauggcagccuucuuacaccuacauaucuaaccuccauccccaaaaccuuccagcuuagcacuuccugucuccuucuaugcuuuauuuuuaaacaguacuuauuucaauguugaguuauauuauuucuuguucaguuguccauuuccuccacaugguuaccuggucucuacaguacuaauaaugguaacuauuaacauuccugacaauugcuaugcacuaggcgcucuucuaaauguuucacauagauagcuugauauuaaaacaaaucuuaaaaucucauuugcaauagaagaaacugaggcauagaaagucuaaguuauuuucccccaggucacagacuaguaaauaguagucugcauucaaauccaguaaguguggcucugaagacugaauccuuaaccguuauucuauagugccucacuguaggugccagcuaacauuuuacuggaugacuaaauacaaaauuugaaaaaauuacuacacuaaaaaauauaugcaucucaaauauuuagggcauauaauaaguaugcaauaaauguucauaauauuagcauuauuacuauucugugcugguaaaaacauugcuggaauaugauguucagcuuuauuuaaggauuauucaacauauuggaauauaucuuuuaaagagggcucaaaaugaugaaaauuugagaaauuaugucacuugacagaagguuuguagugguuaggaauauuaggcuagugaauagucuuaaugcaggcaucuaauagucuucaaaucuaugaaugccuucagaaggaagaacagugaugugugaaugcaaguuauaaggaaauagauuuuucacaucuauaaggaugacuuuuucauaaauguugcugaucaaagggucaugggcagccuuuguaaacaguuaucucuucuguaauagccaagcauuggguuaauauuaguggaaguucucugaaauucugcucuaacaaugucuacuuuuauagucucucccuuagaucuaccagauuauuaaacuacuuugucaugagagguguguuuguaucuuucucuuauuuaugaaauauaguuuaaaaaauuagauuuaaaaaccucagaaaaagccagguguggcuggcaucuauagucccagcuacuugggaggcugaggcaggaggaucgcuuaagcccaggaguucagagccagucuagguaggugaccagacuagugacaccccugucucuaaaaauaaauaaaauaaaauauaauaaaaauaucagaaagagucaaggaacuaaaggauaagugaagagagaaaacuaccagguuagucauuuccucauuauauucuuacagcagucucugagguaagugcuauucugauuucaugccuaagguucagggacagugaguaauuuauucaggugaguugcaggguaagcaagaagcagaguaguaguuugacuacaaguuaguguaguuaaaaaccuguucucagucuaccacauuguauuauuaugauuuuuuccuucuggaaggaauuccuuguaguuuuuacucaacucugcuguaguuucaacauaggcugacacauuugguuuccuuaauuauauuaauuugcuuggcagaaaaguucucuccuuuuuaugaacaagaacuucaacaauccagugugauaaaacaugccuuggaaggaauaaaauacuguggaauuuuauggauauguuuauccucagucaaauuucucuccaugguguaggucugaccacugggcauuggacacuuauauuuaaagucugauaguuugaauuugaauuuugaacauuucccuuauuacuuuuguauaugaaguaugccauaugaaacacgaugaauuugcuucaaacacacgaccucgauaggcguuugaaauauuuaagcuuguugaaaauguguuuuaguagugccacugacaauaggugauucuguuuuuucauucuuacaacauguuuuacaguuguaaauucuuguuccuuuaucugaaggccuuuccagcuuaucauauacuaauuuuaucaaagaguauucucuacauccuacuuuuugguauaaguaaaugcaagcacaacuuuuacucucccuuggaugaguuuuugacucuuucauuuuuccugauaaaaauagugcgaucuugguuugacauguuuuggugaaaugauagcucaguuauuuuccaaggcaacuaacuguauuugaucgagagagaaaaaaauuuuuuuaaaaugcugcauuguuuaagcuauagauuuuuaguugaucuuugauuugauaaagagauauuuuaaaaguucaaaugaauuucaagggacuuggcauuucauauuuauauuaacuuauuucuucuacaccuugauuuuaugaaaaauguguauuuuuuuuuuuacuucucuaaaucaagaaaucaaggucacaauccagaucugguccuuuggugaugugauucacuguugaucauggcaaagguuauuaagaaaauaaaugaaagccauguuccaguacauuaguucuacuccaucugucuaaaggaauauuagcaguaggcagaauauaugccacaaaaugggcauacugugacuuuagaaaugggauucaaugcacuauuagaauuggauaguucugcccuuucuuaaaaaaauaugacuaugaccaggacagucaaucuuacugagaacuaugguauauaaguguacagacucuucugauuauggcuuugauuauuuuauauacuaugacugucuuaccuucauugaguacuguucucaaguagcucaaaauauuaccacuauaacaucuuuuccacaaugauuaugcccuuugcacaaaggaacugcuauaucugacucuaucucauagaugagaaauagauuugaaaaaaguaaaaagccuuguucaaagucaagaaaaaaauuuaccgucagaauugggacucaacuucccaugagaugguucccuguccggugcuauuuccguucaagugccucuaguuuuaaaacauuuucuaguauguacuucuugugggucaguucauucuuuggauaagacauuguuuucuucaaagaguuuaugcuucacuaguauuuuuaagccuugaaauugcuacuaaauuuaaaaugaagagagcuuuuuccuuuuuuucuuuuuuuuuaauugagauggugucucacucugucacccaggcugaagggcaguggcaccaucucggcucaccgcaaccuccgucucccggguugaagugauucuccugccucacccucccaaguagcugggauuacaggugcgcaccaccgugcccagcuaauuuuuguauuuuuaguagagaccagguuucgccaucuuggucaggcuggucuggaacuccugaccucaggugaucuggccaccucgggcucccaaagugcugagauuacaggcaugagccacugcgccuggcccucuuuacuuaaaauaaauuuaguagucucuguauuuagaaaaaccaucauaugcuaguuauugguccuauaauggcauuucagacaguucuacuauagcugccuaaaagacaagcuccuacuuaggucagguacguggcugagaggucaaacugcauggguuugaaucucagaucuaccacuuucuggauguaagagucugagaaauucccaaggcucucacaaacuucacguucauaauugggugacagaaguacuuaaugcauaacuguguuuugugaauacuaugaaauguaacuuagagauaauaauuagcauguggcccgagagagaaacacaaaaaaggguaaauuaucacuguuuuacauucgugaagucacaucucacuaagagcauacauuucagaggaaugguccuucugugaauuauacaaugcuuggccacuuggugaaagcacaucacuuaaggacucuaauuacauuuuuaaaaauuggucaaaauuuacuggauuaaauguagugccaaguuaaaaacaccuuugaguauauaaucggggaauauuaagacuuuuuagaaacuucaguccucaggaucuuagaugaaagcagggagaugauccuuccaucccccauuccccaucacuaggaaaaaaauauuuuuguaauaauauucacccagauuagaaaucccuagucuauuauaggaguuuuauuuacuguugagaaacucuaaaauaguaaacagagaaaaauguauauaauaagcaaaaguauuaguuuucucuaucaacucuaggagcugaauuuugagaacaggguugccuuggcuagguaggcuggcugugugcuauggcaaagcccugugucuuucaccuuugaugggcuuuguugacggcaaaauuagaaagacccuagacaucaugacuuugaauuaauuucuucugauuaggauuauucacccuccagcuuuuucuaugauauaccuaaaguaagacaaguccuuuagccaacuagaacagaaaagaguagguaccaggaccucaagaugguucaccaaguauauuaauauuacucuuuaaagaauauaaaaaaaaauuagaauagagccauuuucaacaugguccucuaagaguauucugauagaaaagccaggacaugacuccgcugcaucuuuagauuacaaagcauaccuacuuucauaaauucuguggauccucauguguauccuauuaaauugacugaaaaagagucauuacuuucauuuuacagauagaaaaauuguucacagagcacuuuuauaauuuaacuaagcaggaucuagguuucuguuauauugaguucuuguacagguuacuuuuuaguacaccauacuaacagcaucacugagaaaugaaauaugcaacauacaggcccuccuugguccucuuugcuaggucuccuucucuauccagucuggaaacuuugaagucaccuggcucagcccuauguccuuuugucucuagcugcauuuucuccucaggguaucucauccacaaauauggcuguaaauaccaucuguauucugauaauucccaaauucuuuucacugcgcacaccuugagcucuagauucuucuaauugccgcuuuacuuuuacacuuggcgcucgaauaagcaucuuaaacaacuacaacacaggucuuaguucacuccuccaaaccuauuucuuucccauuuuuucccaugucaauuagaaccuagaaguaauccuugagcucucauuuugcaucauucuucauaugcaauucacuaucaggucuuucuuagagcaaucuccaaauuauauccugaaugaaacaugaagcacauuugaauaugagaauuugugauuucauucuauuuggaaauuuguaaccacaucucuuuagguauagucugucauauuuuccuuucuugccuuuuuaaaaacacuauuauuuuauauucucuuucaaaucgcugcuuuauuaaaguccuuguguugcuaauccugguuuuugucacuacugacucacuaauagugaauugcuucuuuauguaauuuuucacuguaagcuccucucucuuuuuucugaaaaauauuuuuuugugguauaauagcauaggguaaaguguacugauauuugcuuuauaguccaacuaauuuuuacauaugcauacaguuauguaaccaccaccuagauaaagaccaccauagcugauuuuaagcuaccaaugugaugucacugaacauggagcugggaagagaugccuagaaucggcucccauggacaggugguaacugguucuagcacaucauuaggaaauuauuuccaauuccuuuggauaagauucaaacuccuaaucacgaucugcuucuugucuaccucuucaacuucauuguauaccagucugccauuaccuacucauauuauagcaacacuggccucuuccugccccuagcauaugacaaacucauucuugucucugggucuugaacuuguuggucucucugacccagcucuucccauagcuacuaaaucuuauccuccccaauucagcaguacaacgucauauacaguacuuagaaagacucugccaggucaucuaaucuaaauuaguuccucccagucuuaucuuaaaauuucuauuuccuucuuccauagcacaaauuggaaucugccguuuucauuuuuucuaguucuuuguuaucugccucugcaccugaauuuaggcugcaugaaggcagagaccuugacugucuuauucaccacuguaucacaaggccuggcucagggucugacaaggagaaggugcuuaaugcaugugcugagugaaugaauggacacauggaugguagaguuauaaagaagugagugauuaauucacuuaggggguguaaaaugguaucauaaaauugaaaugcaucauuuuagauguaaaauagcacauuuuaagaaugaggcagucaccucuaaagggauagcauuagaguagguguuuuggggucagauagccacgaguuuaaauaccagguaugccacuuacuuaacaucucugagccuaagucuuucuuaaucuauuuauuucuuuuuuuuucuuuuuuucuuuuuuuuuuuuuccagagggaguuuugcucuuguugcccaggcugaagugcaauggugugaucucgacucacugcagucuccgccucccgaguucaagcaauuaucuugccucagccucccgagugacugggauuacagguaugugccaccaugcccagcuaauuuuguauuuuuaguagagacgggguuucuccauguuggucaggcuggucucgaacucccgaccucaggugauccaccugccuuggccucucaaaguacugggauuacaggugucagccaccguaccuggugucuuucuuaauuucuaaaaugaagguaguauuuauggcuaaauuuuagaauauauaaaauagggcuggcagagcauaucuguucaauaauugguaauuauuauuaucacuauaauuaucaugauguauaauuugugguggaucaggacauaucauaaauacagaauaauucucauauuuguuuuuauacuugcuuauuuuaaaugcuaacccauuuaaauuuuuacaaauuauuucccagagaucucaaaggaguuccauauuaucuauuccacacauuugagaacaagugucauuaguuuuauuuuacuaaugaggaaaacaaaaauauucuguuaccagugguuacaaagcaaaucucugggagagcuggucucagaacuaaggcaaucuauauccaauuuccugcacuuuccucugaaaugugucuagcaugaaaacaucacaguaguauuugauguaauauagagagugugcaaaaauuaauccagagccaaauauucaggagucaauagauaaaagcauugauaauaauugccgaauaauauaaaaagcaaguuuauaguucuuacauugguugcauuuuugugguuuguucuuauaacagcaucugcacaacuuguucucuugguaauaagaagcuuucuuuuucaaggucgcccaaaggccaugccagugcaguuacugugacuuuaggaugcugugcugccauaaguuucugggugcccugugauccagugagugcugcuucucucucucucucucucucucucucucucucucucuaucucucacucacucucacucuugcucuuguuuucauucucuugcucucacucccuugcccuuacucccaggccguuugauauucucacacauugaaguuauugucuacugagacauuaauacauucuauuuuauugccaacuggcuuaacugaauaaacaaauauuuccagcaauuuuauuuucacucauucaugcugacaauccaguuuauaacaauaccuaacauaacauuuucuucuuguuuccucagggcuuuguguauaauguguuaaugcacagcaaucagagagaaauaauugagacauaccuccaaaguuuacuaauguuuacucuguuggcaacucagaaaaauuuauuuuuuaaaaaucagcuuuuaaaauguauuuauuaaguuugacagucaaguacuucauauuuuuuuucucuccuuucuuuccccuuauaccaaagcuacagauuacuuugccuucaaacugucugagaguugaaaagcuuacaaucacagacauagagcauccaaauucaauuugaacuuuaggaaauauugguagcaaaaguaggguguuuuucauuuuauuuaaaucauauuucuucuguucaguuuccagaagagaacuuggggaagggaugcagugcgaaucagugaccuguuauuaggagaccacucgcauuuuggcaaaugcccaauaucaaggcuugagguagaaaugaguguguaaccccuuaaaauuguuggcuuguaaccucagugauggcuuucaugaccuguaagcucauauaugaccaggaucuacgcaagcauggcuucaggaagaaagaugguuaagaucacugcuucuaggaaaggagaagaugcugggcagagaggaauuuaaauuuuaccagaagaaggaaaauggucgggacaggacaguaggggaauaagauaaggucuuucugcaucccuaaguuaugaauaagaaggcagaggcugggugcccuggucuccuccugccuucugagcauugcgaccagacccaccucuucucagguaggugauguuuccagcccuccucacacuuuuucagcaucuuccuugggggaaagugaagcuaaaagaaaucauggcuucccguaucuuauugacuuuaugaucccacccauccucugcucuuuucugcucuuuuuacuuccagugaaaaaaggcagaaacaaugaaacuguacuuucuuauucuaugaugugguuauguuacaaauuugugguuuaauacuggcgaucagaauuguuggcuauuuguuggaguuauggcuagcuucaguaauucuuuccacauuuucucuuucaguagaauccaaaagaaaaauuauugaaaccaaggagaaaagguacuuuuuucuggggcucaguucuggcaagucaucaaaggcuggguacaggauaguaaaauauuuuacucaauaaacauuaauucagugccacuacgcauuauuuuagguggguagaaacacagcaaugaauacaacagaggagacagacaaggucuuugaagauugucuacugcccacacuuugccccagucuagugagaggaaacagacaaucugaaguuaaaauaaaaucaaguuaacuuuagguagugguaugugaacugaagaacauuaaagagggcuaugugagggguagugacccaaguugggcaaaguaaggaaucauuucagccuaaauggcaagcuaaaguaaaauaguucaauuuaggaaaauauaauauucccaggaaauucacaugaaaugguccuuucaagucuuccauaacuuauuguccauacaucuuugcaaagagaggccagaaugaugaggguucccaaguuaagggcgauauugaguaauuaaucauuacuugcugauuaugcauuagugauaucaugaaacgcaaaauuaggauaauuuuuucaaguuacuguguaaaagucugccauuugguauuucagaucaagugucacauuguauagagcaacucccaaaccguacugcauaaaguuuuccuucuagugguuuuagaaaaaugagacacagcucacaaggcugccccugcaagaccauguauaaauggcaugagagucuguaaaugacuacaaaauguuugaaauauauaucagauauuuuuuggcaagauuuuuacaauuaaguggaaccaagauagagagagaauucuuauucucacaccgggguuguauuuauuuuucuuuuccugacaaaugggacccacagcuugcauuugaagagaagaauaccccaagaaucacuuaacucucacucucuccaugacaagaguagaauacacuuguacccuaaaaguguugaauccuuacaauuaaagagcugucuuguaggguguuuugcugggaaacauuauagucauguuguuaacuuuuauaauucuacagcucucaagaaaauuucugcgcacuuugaacaaaaagcacacugacacugugggauuuacuguccgcauguacuaagugccuuuugggaaaaugucucuuagauuucauugucuuccuucugccuuuuaaaaucuaauauacuucaauuucacugaguuaggcuguuuucuccauagugucucucaacgacauuuccucgaguuagguaaacaaauucugucgggcugucauauucuuuuucauuuggguuuugggaacuuuaaaugaugcuaggaguagcauauuuauagucucucaauauaauuguaaauuccaauagagaauuuuuagugauaaaaauguuaauauguuuaagaaagggccucacuuucuucaccaguaaaaugaggaaguugauauuuaaugaaccaaaauuucuacaguucaguggaagacaaagcuacaugugacuuauaaauacagcauucauaaaaaggagcucuuguuauuuucuuggaguuugcagaagacagcuguagcuggacuccugccuggacagauugugugcuuuccauuuuccagguguaaaucaugaaacucuuuggccuuugcccugagcuuuuggucuaagccucagccuaaaacuuucucucuggaaugcaaaauuaagaucucuuacauuucuacccuuccucaccauaguccagcucuucugucccauuuguaacccuauuuugccaaugaaacaagcucaacccugccuuaggucuuucacaaccugcuuuucuuuuuacuugggguaugcuuuucucucucuuuuuaugccuaguuguuuuucagagcugccaauuaacuucuugguucuuaauuuuaaaauaugggccuccauucaaacuuuaccagauaucaaaagucucuauugcaauagugacuaaaacaauuagaaaagaaaaagcaacuugaaagcaacagacgaugcauggagaagaaaauguuaaaggccaauccauacaaccaagacaacaacaaaagcacuauccuuauauauauauuuagaguuaaaaaacaucgcaauaaggaaauauugaauucuaaagaaaauacaacauucaaaggacaauaaagugcuguugaaguuaaaaaaugcuaguagacaugaaaaacaggaguuuugaaagauaagaauagaaaauuuccaaggaaaaaaucacacaaauauugaauaauuacauaaauaagaaagaaucaaucagaaggcuuuaaauauaaauacuaggaacuccagaaagaaacuaaaaauagauaauugaaguaaaguauccaucaguaaaauaauuuuuuaaaacuuucagaacugaagaacaugaguuuauagauuaaaugggccucucaggugcccagcacaaaugauagaaauggacauaucaguaaaauuucagaacacaaggaaccaagaagagauaccacaaacuuccagagcacacaaacaaacaaacaaaaaaaacccaucagacauauuucugacaucucaacugaaauauuagauaccauggaacaaugcauucaaacuucugaaggaagaaaggauucucccaaccaauacugcaaauaaaaugcaagcaggauagugauguguucaggcaugcaagucucacaauuuuaucuccaacucauuuuuccuaagaagguuaugagauacuguguuaccaaaaucaaagaguaaaccaaggaaaaaaagcaugaaauacaugaaacaagagaccuaacacaugcuaagggaaaacagaauauuggugaaggaacaguuugugaagacaucuuuuaccauaucgauagaaaugaauagaauacugggcacauuugaacauuaugaaaggagacuuagacaauggagaaaagcuugagguugaauaagugcuaaggacauauacauuaaacaaaugaacaaaaugagauaauugcuaaauccaguuuaacaagaggauaggcaacaaggaaaaguaauuacaguuuguuaaaugggucagcugugaauagaaauauacaauauauugauaugaguacaauuauaauggggauuugguagaugggaagguuguacauguaugguagaagcaagagaaggacagaaacuaaauucuugucuuccacagucagaaauaacaguucaugccuaaaauagaaaaaucuagauauguuucuauagcuuuuaaguaaacuauuuauucuggaauaacuuuagauucacaaguauuacaaagguaacacagaguucucuuauacuccuuaacccauuuuccccuaauauuaauaucuuacauuacuaugguacauuuguaaaaacugagaaaccaucaaugggacauuacuauuaacuggaccucagauuuuauuaggauuucaacaguuuugcuguuaaugucuuuuuuuuuucuguucccaacccuaucaaacauuacauuuaguuguuaugucuuguuaguuuccucuggacugugacaguuucucuaucuugacuuguuuuucauaaccuugacaguguugaggaguacugguguaguauuuuggaguaugucccuuaauuuugguuuaucugauuucuuuucucaugauuagacuuggguuaugaauuuuuuugaaagaauaccaugguaguggaaugccucucccaucuauagaucaagauaucuauauaucacugauaucuugaucaagguaguguuugucagauaucucuauuuuuuccuguuccguacucuuuucuuuggaaaccaaucacuaaguccaguccacauuaaagcgugaauggaggaguauaaagcuccuguaggaacgcaguaucuacacguauuauuuaaaauucucuguaagaaauauuuguuucuucucccacuuuuuuuauucaauaauuuuuuucauaucacuaugaacuuguauauuuagaguuuggguuguaauccaauauucaauucuucaucuuucuuguguuauuucuguucuggccaugagaaaguguuuccacuuggccccuuugucccucagcauucccuacuugcuccuuuuguuauuugagcacuuucuuauuuucuggaaugaaaaaauuuuccagauucaccuucuauuuuuccugcaccagucuuaacaucagccauuucucuaaggauuccugguacuuuuuauuaaagaacaguguucagagaaaggauuugaguauacaauuuuuaauaaacgaauaaaaauuuuaaaaagagaauacagguaauuccugaaauuuuuuauguaacaaaauauuuauuuguauaguuucacguugcagaaauauuucaggauagaaaaccuuauguagccuuaccuagaaauuauugauuugugaaaauuuguuuaguaacugcauuauggagguaaaaacgagauaaaaagaaccuauauaacaaaaggaaaaaaugaacauauucugauaugaaguaaagggguguaacaaagggggaaauauuuagaauuaaaaaauaauuuuaugggguuguucugcauuuugcuuagucaauagagguuaaggaucaaacaucucuaaugaggaccacaaggcuaauggagaaacaaguuguaauguugacagaaagcaucaacucuccaaauaucuuucugcaauuuccuuucaaucaaauguaauuugugaaugaaguugucauuugccuucuagccaauuuuaucucacaggaaccaaagggauaaugagaaaaacugcuacuuuagauuuaauucugaaaauaguaaaauaagaaaagaauuaucuuuuccucugucaauucacauagaacuuaauuugugccuuucuuugaugguaauuaucacuuuuuaccauguuuuauagccauuuguuuuuauaaaauugauuugucuuauuuauuagaaggcaaaauuccuuguaggcaaaaucucugugucuuacuucucaucuuaauauaucucucaaaaaccugcuuaauucaaggcagaaaauaggagcuauguaaacacuaaaagaaggcauaaaauaauaaaucgagagacuacuugauggggugaaaaugaaaauagccuuagagaaugaaauguugccauuaguaaguuuaacuaacuaaggaaaguuauguuaggaugaguuauauaaacacuuuagcuuucagaaaagcaaacuuuuucaagucagaaaauaauuauacauaaucucauggccagagauacaaccaaaaaaguagaagcuuauaagauuucaaggauuuuuuuagauauugaguguuauuuauaaaggggagauugcaaagaagucuaauuaaaaaaaugcagagacaucaaaaauuaacaaugcgagguaugucaccaaugacaaaggaagaaaagauauauggaauacaucaaaauuuaaaacuucuauccuuuaaaggacagaacacauuucugucaaaauuuuaucaaaaaacuuugcaugacugaauuauguuggaaaauuuaaaucauuuauaagcacaaauaugucccuuauuuauuugauuuauuaaucauuguguggucucuuuuucagccaugaccagcauuaaaaacacaagucaaaguagauugaauuuaaaagcugacaauugaaucucuaaaucaacaaguguuaaaaaaaaaaaaaaaagaagucaaaaauaucaagucauugucaagaccaauggcauggcucuuccuccacuauauuuucuuucaggagguuuagaguuucacaucuuacaauaaagucuuuauugugaauuaauuuauauaaggauucaguuucauucucuugcguguggauauccaguucuccuaacacuauuaaagagacuuucccuucuccauuguguauucuugauuuccgugucaaaaauuaguugacuguauaugcauugguuuauuucuggggucccuauucuguuccuuuagccuaugugucuguuuuuaugccaguaucauacuauguugauuaccacagcuuugcaauacaguuuccaaucaggaugugugaugccuccagcuuugugcuucuuuguuaaaauugcuuuggcuauuuguagucuuucguaguuucauuugcauuuuaggauuguucuuucuauuuacguaaaauagucauuggaaucaugauaaggauuucauugaaucuauagaucccucuggguacuacgggcauuuaaacaauauuuauucuuccaauccaccaauauggguuaacuuuucauuuauuugugucuucuucauuuuaucaucaauguuuuacaguauucuuuguauagauauguuacucucuuaguuaaauuuaucuuggcauaaauuuauguuaagauauuuuuggcuauuacaccaaaaguauaggcaacaaacgcaaaaguaaacaaaugggauuacaucaaaauagaaagcucugcacgucaaaggaaacaaucaacagagugaagcuacagcuuaggaaaugguagaaaauauuugcaaaccauacaucugaugaaggguuaauauccaaaauauauaaggaacucaaacaacuaaauuaaaagaaaacaauuaacccaaauaaaaaaugggcaaagggacugaauagauuuucucaaaagaggguauacaaauggccaacagguauaagaaaaaaugccaacaucauuaaucaauagggaaaugcaaaucaaaaccacaaugaguuauuacugcauagcugugagaauugguauuauuaaauagacaaaagauaguaaguguuggugaguauguggagaaaaaagaacccuuguuacccuguuggugggaaugucaauuuuuacagccauuaugggaaaaaguacggagcuuccaugaaaaauuaaaaaugaaacuaccauaugaguuagcaaucccauuucuggauauauauccaaaagaaaugaaaucagcaucucaaagauacaucuguguucuuauguucaugguggcauucuuuauaaaagccaagauacggaaacaaccaaaaugucugucaguguaugaauagauaaagaaaaugugguguguguguguguguguguguguguguguguguguguguauguguauguguguguauaaaauggaauguauuuaacuacuaaaaagaagaaaaucccaccauuugugacaacauggauagaccuagaggaaagcagccagacauaaaaagacauacugcaugaucucauuuacauguggaaucuaaaaaaaauuaaacucauagaagcagagaguagaauggucguuaccagagccugggguggaggugaggaaugggaagauguuggucaaaggaucaacauauuuuacuuucauuuaaaagaugaauaaguucuggaaaugugauguacagcauggugacuaugauuaauaacaacauacuguauacuagaaauuugcucagcgaguagaucuuaaguguucuuaccaaaaaaaaaaaaaaaguaaccaugugaggugauggguguguuaguuagcuugguugugguaaucauuucccaauguauacauacaucaaaucaucaaacucuaaaacuuaagaauuguuaauuuaauauacuuugacuauuuuguccaaauaauuucuuacuguagaaaaggaaaucauagaggcauuugcuuuuuaucaauucacuuuuguuuaauuuuuuggggguuauuuugggggccaaauuuauuuuucaacaauuaguuauugagaaucuucuaucuuuuaggcaccuauaaggugcuugggaucuaucagugagugaaaaaggcaaaaauucuugcccucauaaaguuuacauucuagugcaggguauacuagaacaguuaauuaagaaaaugguauacugaaaauuugcuaagagaauagauuuuagguguucuuacuauaaaaaaagauggcuauacaaggugguagacauguuaauuucuugacuguagcaaccauuucacugaguauauguauaucaaaacaccauguuguaaaccuuaaauacauauaauaaaaaaucuauaagguaauuaaaaauaaaauugcaaguaaauuauauauuaguaagugacauaugcuauggaaacagaauaaaagcaggaaagaaguguaggaagugcugagguaucagggguauugcauuuagaaauagggaagucagggaaaguuucuggaaaagguaacauugaacuaagacucaaauauggugagaaaguaggucacgaagcuaccuaggggaaggaaagauaggaagaacagaaaacagccagugaaaaggggagugugguugguacaaccaagaaacagcaaagaaaccagauaagccaagccagaaagauaaugaggugggugaacauagaucauauucagccuugcaagcuauuguaagaguuuuuggccuugaauggaguggggagccaaugaacaauuuugagcagaagaaugaccuguucgcuuauauugcaauauugaaagcagacuauggcaaaguagaguaaaaucaggaagacuugguagaaagcuauugcaauaauccaggaaagagacagugauggcuuggaccaggguaauaaugguggagguggugaaaauuuguauguuuuuaaauaaaaaaccuacaggggccaggcaugguugcugacaccuggaaucccagcauuuugggaggccgagguggguggaucacuugaggucaggaguucaagaccagccuggccaaccuggugaaaccccaucucuacuaaaaauaccaaaaaaaaaaaaaaaaaaaaaaagcugggugugguggcaugcuccuguagucccagcuauucaggaggcagaggugggagaaucacuuuaacucaggaggcagagguugcagugagcugagaucaugccacugcauggguaacugagugagacuuugucaaaaaagaaagaaagaaagaaagaaagagagagagaaguaaggaagggagggagggagggcaagaaagaaaggaagaaaggaaagaaggaaggaaggaaggaaggaaggaaggaaggaaggaaggaaggaaggaaggaaggaaggaaggaaggaagagagaaagaaagggcccuacaagauuuacugaugaauuagacaugagguguaagagaaagacaagagucaaucuaagaagaaugaauuugcuaucaagugaaaaagaaaaaaauaaaaggugggacaacuguuggguuuuggauauauuaaguuugaaauugcuggaugacuaauagagaauaucaaauggguaaauauuuuugguccaauacaucauuugguggcucucccagcacacgcaacugaaaaaaugugcacauuaguagacaaacaccaagacaaaacuuaaagcaauucuaugacucuggauaagauuccugauucaaacaguauauuaucaaauaauaugcaaaauacugugaaauguuguuaggagugcaggguuagaaaaugagauuugagucuuuuauuauuguguauaauauguggagcaauuucuaaaaaacagcuagauugacaaacuaaauuagauucccuaaagcagaaaggaaauuuguccaaauuugcauauaauuauuauauccaaagugccaaauggagaaaugguaagaccaucucuguugcuggaauugcauaaauguauuuguguuaacauggugcaggagaauauugauauuuugaguugauaagcugauaaaagcuucuugagcuucacaauucaagcacagcauuucacuugacuguaauucacaacucuccugcaggcugaauauuuuauacacagaguuaaauacacaaaguauuaaaugcaauauauuucugacaguauaauuugaggcagaaaccuuccaucacauuuacauacugcugagcagauggggugcucaagcuuaagguauuagaugagaaucaguaaaugaaagcauauuguuggccuugucauggaaggcgaaagcaauaauuugugaguagcuacucuuuccuggaagucuccugugcucuuucaaaacaaacacuacaucuuuacacuacagagcacuuaauuuuuaaauguuaaaaaaccccagacacucaggagauuaaaauacauguauucauugaauuagcccaaguuuauugaucccauucuuuuacauuuuccauauuuuaacacacauuaucccucuguugggguaaauuacaaauuaugugcaacguuuaggcaaauuuaccuggugauuucucagaacaaugacuaggccucauaaccaguuaguagggaauuucagauucaaacuccuuuuuuaucuuccucuuuagcccaaacaacaaaaguuuaagucaaauauuaucuuugauucuuaaagaaauauuuaaguaugauuuggaaauugucagagauuaacagguaaauucuucuaaaaugugguaaaauuguaacuaauucuaauagggaaaaauaaacauaaauaugaaaaauaaaaauaauucagaaucaaccuuccugaguuaauacaaugaacauaauguauuguaauaugcagaaauaaaauaugcaaucuguaauauguauauauauuguaguaauguacaucugucuaugguauauacauauuguauacaaauaaacaacauugcuuacaccaauguuggcagaaucuuucaucauacuuguuuuuguuuaucuauuaucaacuuaauauaauauuuacacuuaaagauuaagaguauuuaauaaagacugucugucucccuucaugccuuucaucuuaucuauuuuuccuuccuuuuuucuuccccauuuuguuuucugcuuccuucucauggccuccucuaggauaaggugaguaaagcaccuguccugugugcauaauugaagggugcaccaaacucaguaaucaaauaaauaauacucuaugcaauauuuuaagaaaagaacaaaauucaugcaaaaauccauuauaaaauaucaaaauuucaaauaaagacuagguuugccaguaccauguggagccauauuggugccuggggcaaaagggaagauaagcaaugcugaucccaucugauuauucuguuuguuuagugcccccuuaauuuaugcaccugagggaaaugccaaauuuguuugagccuagccuucgucuuacucugucuuuccugccuuauuucccagcuuucuagacaaaaaaugcaaaacaaauacauacaacugaucauuuugccacacuugaaacauaauucuacauggcauccuucccuaaucaaagugauaagucucaguuacauaaacauaccagacaagacugauagcauuuaaacugaauugaaaaguacugaaaucuguucuuauaaauuauuuuacugggagccuuuaaagauagugaauaaguuguacuacucagaacauaaggaaaauauauaaauaucuagucuguuuaagaggaacacuaugaggaaucaggcuuagacauuuugggaucuaaauucaugaauaaucugauauugauuucuguuaaauauuuuagucacucaaguuggaaagaaagauuaagaaucaagcucaaugcuguagagauagagggauacacugaugaaucagguauguguucuggcccaaaauaguauaugaucuagaaggauagacaagcaaagacaauuacaguauuaaaaggaaaccauuuguggagauggauacauuguuaagaaaguuuaauggaggaagaaaauauuuuaggaaagacaucauaguacaacugagguagaccuugaaaaugaagaacgaauagacagaaaaagaaggcaggcagaggagugcauuccugauggagggaaagaaaugagcaauaccugauauguaagaacauugcagaguauaagacaaagccagcaacuugguuugauaguaauguauggcaugugaaagggaagauacccaaaucaauacagaauaggcguuauuuaaguaaugaaugaguaaaugaauacugaaaaacagaauaauaccaaccuauagagacuuuugaaugcuagcauaaacaauuugcacuagagauaaaguggaacacuuacaggcuuuugagcaaagauggaucacuuucagugcuaugcugagggaagaugaauuugcaggagggggccaauuaguuaguuauuucuguaguccaggaggaugguaauaaugacaugaauuacuaaauuggaaguagaaagugaaaggagagaauaaauuggagagaugugucagaggcaggauugauaguuaaagcaauuauuuggcucugguaacaaagaugaaggcaaugaaaaugauuccucaauuuucagccugaugauagggagggcagugaugcuuuuaacagaaauaaagaacacagaaagauaagcgucaacuugcaaagaaagguaauuaguugaguguuagacauauggcuggcaggagcacugacaggacauccaggugaagauuugcagcaagcagauaaguauuguuuuguuccuaaaauguaaacgaugucacaaggcgggaagcaacauuugccacuugauaugccccucacuuaaccucuacuuuucaaucaauugcauguaaggagcaaagacagggaagguuuuguuccuuaguguugaaacauucaacacacacacacacgcacacucuuggcaguaucaguuagggugaucaaauauuuuggauuacuuugaugcacccgaagcccuggguuccuaaauccucuaguuggaaggcaacauaauaaagugaguggcuugcuuggacuaaaauugagccuaggccacuggaucucaaauguuagaugcauuggaaucacuugaagagcuuauuaaucuacaauguucuagucucuccccaagagucucugauuagguaguucugccgugggcucuaagacuuuacauuucucuuagguuaccaaguggugcugaugcagcuggaccagggcccaugccuugaagaucacuggcuuaagaccagggcuuuuaaauaguacccagaagagugauucucagaagauaaucugugaacaauguuuaucagaaucaucuguauugcucauuaauuuaauucuugggucccaccccagacuccgugaaucuugauaucuggguuuggagguuuaagaauaagcauuuuggacagccucacuaggcaauucuuaauagcauauaaaguuugagaaccacucaaauugugaugugaauuuuaauuaguuuugagaggacauuacagacuuaaguuuuuuaacugugauggaaagagcaagugaccagaauuaagagaugugggcugcagauauaaauauugacacuaaucagcuguguggccuuggguaaaucacuuaaccuuuuuagguauaauuuucucauccauaaaacaaaaugauuaaucuagaaggucccugcagucucuuucagcuccauaacugugaugaguucuaggaaucgcaauggcagagauaaacauucccagaguuuaggaaaacaaauuauucucaauuggauguguccgaauaacaugaguuuuuguucuguugaacuauacauacuuccuucccccauucugacuugcuucuuuugcugggggcugguuaauagguuauuggucucuucugucuuugagaaucacuacugggaugagccauauuugugggauagauugagucuuaccucucaggaaugcugagcuuuauaugauaagcaagcacaauccaauuuuuauuggagcauaaugugaagaagauaguuauugaaguuuauuagccaaaauagugccucuuaaaaaugcauacuaaaauagaauuuagauuuacaugauuucuaucccauacccauuaggauggcuacuaucaaaaaaacaaaauaaauguuggugagaauguaaaaaaaaaaaaaaaauggaacucuugugcauuauuugugugaagguaaaauggugcaaccauuauggaaaacaguauggcaguuccuuaaauaauuaaaacuagaauugccauuucgucuagcaguuccacuucuggauauauacccaagauaauugagagccauuauucauaacagccaaaagguagaagcaacccaugucuguugauaaugaacagauaaacaaaaugcaggauauauauguguguguguguauauguauauacauauauauauagcauauauauaaaaugcaggauauauauacacacacauauauacacauauauacacauauauacacauacacauauacacaacagaauauuauuuagccuuaaaauugaaggaaauucugacacaugcugcaauguagaugaaccuagaggacauuaugcuaagugaagaaagcccgucaaaaaaggacaacuacuaugugauuacauuuauaugagauaccuagaauguucaaauucguagagacauaauugauugcuaaggccuuggggggaagagggaaugggaggagggaauuuuuaguggguacagaguuuuaguuuugcaagaaaaagggcuguggagauggaugguggcgaugguugcacaauaauguaaauguauuuaaugcuacuaaacuguacaccuaaaaugguuaagauggugaauuuuauguuacauguauuuuauaauuuuaaaaaauaaauaaaauuuaaaauuucaauaaaaauuugcauugaaaaaaugaacuuuaaauaugaaagcuaugaaugugaugugcuuagauuauauuacaagccaauuuuuaucacauaaaaagagaagcuuuaucuuuaguuauggaguuuuuuaaaauguauugugcacuuuuggacuccaguauuuaauguuagguauaauaggagaaauaaaggaauaauggaagaagccaguuauuuucuguaaaacauaagcaugguuuuauacuguaauauauuuauuucccccaaacacuaucaagacauucaaauuuuauuuauuuuauuaucuccuaggcaaagcuggcgccagauagcagagcccuaaaggauuuugcaagacauauugauuuaaaauaagaaaaauaauagaguuauggauauuuaacaagaaaggaggaauuuauaaucagaagcuuuagugccuaagaugacaauuaaucugagaaacauaaaaacagaaagauaugcuaauagucauggcauuuauguuuagucagagaauugaauuuagcaguugagaaggagaaaauuguagaacacugaacacauaaaucagaaugagaggagagggagggcccuuuugaggauguaaaagaacagccagggacugggagccacagaaagcgaaugaaacuuacauauguauaauauacauacacacuaaccugaaagauguuuuugacaaaggaauugaaaaagacaagggcaugaaaacauuuuauuuuuuaaaaagucaaaauggaaauuaaacaaaaauuguauucauaugugugacuauuugcguaugugugauuuuugcagaugucuccuguuuauuuuauuuuuauauuuauuuuuuauuuuugagauggaguuucacucuuguugcccaggcuggagugcaauggcgcaaucucagcucacugcaaccuccgccucccagguucaagugauucuucugccucagcuucccgaguagcugggauuacaggcaugcgccaccacaccuggcuaauuuuauauuuuuaauagagacgggguuuccccauauuggucaggcuggucucgaacuccugaccucaggugaucuguccgccucagccucccaaagugcugggauuacaggcgugagccacagcgcccggccuguuuaaauaaagaaggaagucauaaagauguauacucugcuauuaauggagguaaacucugaggguaaaauuggagacuaaaauaauuuuuaaauuaugguagguguaauaguucauuuucucacagcuauaaagaaaugccugagacuggguaauugauaaagaaaagagguuuaacugacucacaguucugcauggcugaggaggccucaggaaacuuacaaucaugguggaaggugaaggggaagcaggcaccuucuucacaaggcagcagaauagaaugagugugaaaucgaggaaauaucacuuuaaaaccacuagcucggcaagaacucacucacuauugugagaacagcacgggagaaacuacgcccaugauccagucaccuccuaucuggucccuacccugacacauggggauuacaauuugaaaugagauuuggaugggaacacagagccaaaugguaucaguaggauuauaauuuuuaauuuuugguauuuacccaacagaaaauuuuuaaaaaauauauaugcauuuuccaauuugggaaguaacuuugagaguaagaacuaaaccaaggcaauaccuuggauauuuauuggaauaagaaguuugagaauauaaugcaaccagcaggaaacaaagaugcaucaaucuauucuuuuuucauccuggggaacuagaaagcuggaaaauccuuuggagaauuuuuucacuuggguaugaggcuguguuuuaagucaggacuaacaacauaggcuugauguuagggucucuguguuagggacucccacuacaguccucugaaguuuccuaggaagcauuuucucucauaagcuauuaaacaguuugaaauuaguguccaaagacucacugaauauucauuccagaaaaaaucuuagaauuaauaaauucuguuuccacaauuuuaaaauauggaagaaaacuaaguccaaaguggcucucuauucuucacaaucgagaaacugauuucaaauacuccugcuauucuuuuuacaucuuauugcucaucuaguuugaauuauuauauuaauguccaauuagcaaguuccagugauacauggcccaguaggugucuuuguuccacaagcaccuuccucccccaccacuuuauugcagcaccuucucuucuaacuggaauugcuuuuuguuucuugcacauacuaugcucugcucaccuucaugccuuugcucaggcccucuccucccuaucccauuuuuuuguuauuucuguuaccuaauuaaauacuacucauucuaaguuuaauaucacuuccuuuaggaagucuucacugaucugaaguagccucauccuucaggcuaugcuagguucccuuucccuguguucucacaaugucuuguacaaaucucugugggguaccugcuguucugcauuuuacuuagcagccacugaauaaauguuuguugauuaaaggaaugagugaaugaauagaugaauuagaauugaauguagcuaauuaaaagaagaauuggagcagaucuggcuuucaucaugaauuaaaucacuguggaaaaaagcaauuuuaaaagaacauacucugucaacagcagguugguaguaucaucuuuauguacauaagacaguacuucacuguugcaucagcauccaguauaauucacagaauuuguauacauauauauauauauauauauauauauacauacauacauauauauauauauauauauauauauauacacauacauacauauauuuuuucuuggcaucuagaaaaacauguuuguuuguaguauuuguaguaugauuugucugcuauaaaacuugacacauuguaacuuauguaaaauuccuggugaugaccuaagaagucuucauaagcaacuuuacaugugucacaaugauucuagguuucuccuuuucuuuuugagaaaacaucuaaucgagucugauuuugauuucaaauauccaugaggauuguuaaaaacaaaaauaagucuuaauaauaauuuaaaaaaauccaacucuacuauuaaaaaugcauuagcacggcugcuggaaaugaucucuacaucuuuuuuauucucccacugugcaguucucuucuuucuuugugugaugacugacacagaccuaaaaacucugauuucuagagagcagaaaauaugccagugguaucggagcucucagcugcaggguguaguacugaagugaaucauguauuuguuggaaucauuuggcaaaagggcaaaugcagcaaauacacugcucccuccaaguccagugguaugacagcccaggcuuggcguuuucguagaaccaaagcuguugaguuuguugucuuguuuuaccccaagccauuuucaguuuguuuauuucuguaauaagggccuaacccagauuuugaggucauauaccuaguuaauauauuagcaaguugcucacuaaagcuccaauuagcccucacccuccuucugcugauggcucauuaauugucaucuacuuuggcauuuuuacucaaugacaaaugaugcuuauagcucuaggaggaaggggaauggaacaagcagaaaagaggauauggccgacaugcaaggucaggacgaaguauagaugaagcuguguaacagcugaaaucuguuuucuacucacagccuuuuuuccuuugugcaacauggugcagagcugcuucauccuuaagucuagcaugcaucagcugcuaucuuucccagccucacucagcugugggaagcaaugcccucaagacuuucagcugcuggugagauugcuguuagccaagcuuccacugccacugucagggaugaagaggggccccacaccucaguaagcaccuggcaauaugcucaccccuccugccaaccuacacucaucuuaucaacauaauuugccuagagucuguguugguccuggauuccuaaaugcugcccucauggaaagucugaaauuuccagauuacuguuuaaaucucacugauauggaucugcgcaucccuugauuuugaccaguuuuccuauuccucuacaacucuccagguucuucuacucugcucuaugaaacuuuauuaucagcaggauguguguaucuagggaggucacauaauuuguugucauaaugguaauacucuugagagugagugggaauacaguuaauaacacugggacaaguggcaaaaucgagacugucccaagcaaacuaggaaaaauaaucaccuuaccuauaaccuccauuuguuuuuugaaauuuccuuuuacuuuauuuugcuaaguagaauguacuuaucuucuggggauacugcauugccuguggucuuguggugauuauuuuucucugcuacaacacucauaccacugggacaggauccaguguugguauccucuuugccccucaaaccauuucuagacccuugucccgaaaauucuccagcuuugaagcuuauguuaucagacuuuacuaccugccacucaguguuacugaguggucacuaacugacccugcaacacuccuccaacauuauuugaauauuuuuaucacuuggcuuucugucacucucucaaauaggaguucugcguuucuucuuggcgauuugauuauucacauaagcaucucuuuccaguacuuucuuuuucagucucaagucuuccucuucuccaaagauuuugucuuuucuacuaccugagcuaccaaaucccuugucaucaauuucaauaacuguauucucuucaucauuucaacuucaaacgugucaucucagaacaagcuucauguuacuuccaauuuuauccuucuuguuugcugauuccaagaauuccagucccaucuaggcccgcaaugcauuguuccugccacccuuuucauauccucaauucccuuguaucaucacuuuccuuuuauauagcacagauuccaugauucauaacaauaauuauguuuuuuuugcaugugcucuuaauuuccuuucuugcuccuauuaucuucuaucauacuuuucuggaaacacuaauucuggugaaauauacucuuuguggacuuugcacuuaugcucagucagcugaagaugauggcuagacaaauacucacaaucaugcugacuggucccaauuuauagucaugaccaccgauuacaaaccccuucagucuugucuagaaaguuuauuauauuuuaguaguuuacuaucucuuugauucuccaggacagccauuccuauuuucucuuucuucaaaucuccagaaucucugcccugcugcuuacacuuuggugaugacuuugguuuaaauauaauacaagcagucaaggaugaacuuccuuaugcucccaccaccacaucuucuaacuuauguccuucucuccucuuacuauggauggacugugcuucuaaguccaaaccgucuaccugugcacuaagaugccauaacuuaucuccuaaucaaagaaaguucuccagcaauacugcagucuuuuuccuguauuauggguuuccuucucuuuauugcauacucccaucaauauacagauacuguauaugucuucuuucguaaaaaauuuccccaaaccugacauccuacuccagaaacuccucucauuacucagcauuuucuuucagcaaaauuucuuuaaaaaggaguuacuccuuuaaaaagagcuauaguaucuccuuguaguuuuacuacaguuaccagugucacuccuccaacguggcuugaagauuuuaucacuuggcucucugucacucucucaaauauuaguucuguguuuauucuuggugauucgauuauuuguacaggcauuuuuuuuccaguaccugguucucauaaucucuucuuucuagucucauaaucuccacauccucucuuuuacuucuuuucuuuucucuaaucuuucccuaaucucuucuucuacucuaccaggccuguuguugucaggucaccagugacugcugguuuccaaaacuaaaauuaauuuuuagcauucaucacccuuuaucaugagcaucauuugacagacaguugauccucugaacuucuugaaauucuucuuuucuuuugguuuuuaaaccaccacuuacucucucuuguuuuccaucuuaccucacuagcugauaguuuccugaugcuuuguuaugcccucucugucucugccuccucuaaauauuaaauuguguuuauauguuuuucuuuuccagauauacucauauccucagugaccacauccagccuuguggccuuaaauauaaacuuugccugcguaaugaguaagcauuucauauuaacuaccaugccagagacaaauucucauuugacuuaucaaaccuacucuugucaugguuuucucaaucucaauaaauggcaacuccaucccuccaccuacguaagccaaagauauugaagucaucccuaacuccucuuuuucaccccacauuuacucuuuuagaaaaucuugucagugcuaccuucaaaauauguuuaaauuuaaucccuucucaucacuuucaccauaaucacucugguccacccccgccucaugucacacuuggauuauuacaguggccuccucacuaagcuccccgcucccacccuugagcccccuggucuccacacagcaucuagagcggaccuuuaaaaaguuauguugcgucacucuucugcucaaaacucugcacugguuucucaucucagaguaacuaaggucauuaaaaucacucauagaauauuauaucagugauugucaacccuuauugugaaucagaaucacuuggaggaaugugagaaauuuagcugccuuccauuuaccaauuaagauacaauuuggacuuuaguggggcccaagcaucagccuuuucaauggccuccauccugcccaccucccacucugaucauauccaucugccucuccauccccuaacccccucucugugcaaccugcuccaaccucacugaucuucuugacauuucucuccaguaugccaagcuagcuucugccucaggaauuuuguaaugagcauucccucugccuggagcacuuccuguccccucucuccaaacuauaugcaugguucacccccuguccucuuucaggucuccauucaaacaucaguuucucagagaaguauuucccaaccucccaaugugggauggcaacauccucuucaugaucugcuuuuuuuuuuccauucuuacccuuccaguuuuucuuuagagcacacauuuaugcuugucuguuaucuucucuucacuacaauauaaucuccauuuaggcaggaacuuuaccuguucuauuacaccuucuaaugccuagaacagagacuuggaaacaauagguauucacugaauauguguugaaugaguauguaaaauagcagguucaaguccacugaauuuuucagccagagcugaauaaaacugggguaagcuuacucacuaguucuuagggucugggauuugucuuccuuccucagucuucuaaaacccaugacacuggcccauauuguuaugacuaaucuuuugccuuggcuuccauuuuaauacuucaguuuuccagcuaggauuagagcuaggcccugaaguccaguggcuugguugcagcccugaugcccaguuuggagcuugugaguuccccccaguaauagcaccccuuuccccauauugcucuuggacuucuguggacagacagccuauacauuaaugcuaucuuuaugaaugaauacugcuggugcuggcaccaccaccgacuucccuguuacuaugguauccauuugaguguacauccccuuggaacuucauagucugaaguauuauucacuuacaaauccuaccaauccugguuuuauuuacuucucuaguggucuucuaugcugagauucuagaaugauuuguuuuuccccaagaguuauaauagauuaaugggaagugaauauggcccucauaauaaucagggacuucccuauuuuagugcugcacaugauccuugauuucuggucagauccuuaccugccaccuggaaguuucuacaacugcucucagaagcuguaucuguuuauguccuaggcccaucuaaaauaaucuaauagacuaaauuccacuaaggugcuaaugccaguaacuacucaaagucauagucuuuuaagauguauuugcguuuuaagagaaaugaacuucccaugguguaauuucagaauguugcugagucaccaucauggccuccuaacuggcuuccagcuuccauguugccaucuuccguuuguuucagcacaauagucauaugauuugccaaaauauguuaucauguugcucuucaguucaaaacucuccugagguuugauaucccaccagagaaaaagccaacuuaggauguucuagacagccuguguuagcacaacucaaacuuuaauaugcauaugaaccaccuauggauauuguuaaaaugagauucacguuuagaaaggcugggauaggggcauaagagucuauauuuuuaggaagcucucacgugaugcagacacugcuaguccacaggaccauacuuugcauugcuagacccuacaugauucaucugcucucuaccuccagaucuuuuaccucuugaccuuguugcacuucugauauuaucccuuauuucugaauccauacuggcccccuucauauucuuggaacaucuaggcaugcuucuaccucagggccuuuguacuggcugacccucuuucuaaaaacacuuuacucagacguacacauacucuccccucuccaaccugcuuaaaguuuguauucaaauguuauuuucuuagugaagccuucccuggcuaccugauuuaauaaagcagauuaccuugcuucucgguauuucccauccucuucuccuacuuuauuuuuucuccuuaacaauucucacuacugaacauaccacagagcuuguuuauuuuguuuauuguuuauacccacuauaaugcaaacuccaugaaggcauuuguuuucauuucuguccaucccagugacuaauguacugcuugacaaauagaaggugcucaauaaauaauuguugaaugaaugcauaaaaaauucagcugcauuuuaaaaaucauauuuuuucuacuuaugcaaaagaucuugguuaaagcaaggcagaaaaaaaaauuugucuaguuuacuuaggguaguuugcuaccaaguuuagcaaaucagaacucaucgacuuaaugcucauuuacacagauuucuuugguacaagccgaaacaagaugguagaugagaucgguaucuaccuucgaguaagagaaacuuaaugagacuaguagcacaauuaagaacaaauacagacugagacauuaauggaaucuauuuaaaguuauagauugugaggacuguuuuucucagugaugcaggccuuccuggaaggcaguuacuauauauauauccauauauaguguguguauauauauauguauauacuauauacauauauaguauaugcguauauauacauacauguacauguauguauauacauacauauacauguauguauauacauacauguacauguauguauauacauacauauacauguauguauauacauacauauauaguauauacauacacacacacauacauauauauauauauggauucuugcccaagauauuauagaagaaguguggccuuuugugaaauguugaccuaaaagaccucugaugucuuaucugccuguauaaauuagaaaucaaugacagagaauaaaaagcugcugugugaaauguucaagacuaguuucuugaauaagaauccacaaccacauuccaugugucauaguucucaauuucaugaaacuccaaugaacuuuaucaggugaaaagguuauuauuuguuuguugguuguuuuuuuaauagaagcuggccaagaccuuguaagcuugaaccaaaauacaucguauuauuauuagcugcucucugucuaaucaauugucagcuguuucuaauuuggguugaaagaaauauauaguacaaacaaauuucacuuagauauuuucuauuauaaauucauucagaagagcauuuucacuagcccucuaguaaaucagaaaacugaaucaacaugguauaauaaauauuugaggacuugauuugcaguuucgaacucauuagcccuccuuaucaacagacuaacaaagaauagaaauuauuaucuaccucuuuuauuguuucuucuuuuuauuaugucacaacuuuacauuaagauuaggaaauauuaaacaauaaagcuuuaaauuacaaaucccucacauauaaauugucucagguaaucuucagggccaucuuaugagaaagguuuauggcucuacucauacuacuuauugaugcuuuauauauauuaucuuauuuaaucuugacaaaaacugugugagguagaauucuuaucuucaugaugcaacucucaaggcccagagauuuugaguagcuaguuauguuuauacauuuuauuuaaaaaaaugagcuggauucaaacccggauugaugugcccauuaacaccaggcuggugggagaaaauaaaaugaaauuucucugcaauaauacuguauagaaugagguuauaaggcagggggagcuuuggcuccuaaaauggaauagaaauaugaacuauaaauuucuauuuauauuaaucaucaaaaaacaaauucauuuuuaacagaugauauaaaggaaaauaacucauccucaaagccauaguguauacuuauucugaacacaaauucauuaacaugcuaugaguacccaguaagccuuaaaauguccacccuccuccucccuuccccaaaaauacauguucauucacccacuuggauccaucucucaacccgaaccccauuaacugggagaaccauguugaaacuccaggagccaaugguucuuuggagaaagccaagaaauauuuuagaaucaauaacugagccccagaaaaugggguauaauaagggcaaagaggauagaggccauugcuaacaucuccaggacauucacuuccuuaaagacaucauuaauacuugaagaaagguuuauguuagcaucaccagcucucagaagaaugauaucaauauguugacugcaagaauuacuaggcugacucuagggaccauaguaguagcaguggcagauaaagggugccagaugaaaaagcagagaauaaugcuggaaccugucacagaauaauuuuuauagucaucaaaauauccucuaggaugacauuagugaguuugccuuuagaacaggaaacacagacuuggaguccaaauuauucugcaguggaaggucagagagaaaaaguguauaccacuauugcugcuauuacugacguucauuccugcauuccauaauuauuuauuaaaugucaacaaugauuuucacuaggcuagucacuagagauaauuuuaagaaaaaacagucagaucucucauagagguugauaggguuugaauugcuuccguauauauguuuauaagcuacagcucagaguaaaaauagccuuaagauuuucacauaaaagaaaaacagucuuucuaugccuuuuuaauauagauaguuauagaaaaaguaagauguaaauaaagauuuucacauuuggaauagaaacagacauccauaggaaccuuauuuguugacaagauuaacuuuuacuuccagauagcuucacauaaucacaacuaaagaugacgguuuaauccaaaaacaaguguaguguagaaaauacccugagucauuuaaaagaaucagauaacuugaaugauauuuggaaugggauuuauaaaaacuuuuuuaaacuucauguuuguuaaguccuuaacccuuuucugaacaaaauaccaguguguguauuugauuuuggaauucaaauggaaacugaucuguuagacacacuacagaggacuuugaauucccuaaaaaaucuucuuuaaaucaauauaagaugcauuguaacaggaaauuugccgucagcauuaaagauaaaaaacaaaaaacaaaacaaaaaaaacaaaucucaacugcgcaauuccagcaugggacacaaaaugguaaggacuauuaaaggagaaccauggacaguaccuuuugaaugccugccugggacuccagaacauuguucuccgauccauugcuucgguugaucauccgccacauuugggaauacaugcugucccucucaaaaggauucaguccuuucaugcggacaugcucauauaccgcagagucuaggacugugccauaagggauuucuguuugcuuggaaagguccuggagagaccuugauuauugggagagaagagagacacaagagacacauuacugaguauuuucaagugggaauaaaguuaaaagaaaaaaaaaggcaauauguguggaaacauauaucaaauugcuuuucuuauuuuauuguuuucugauauuaggauauaauguguaagaaaaacuucuguuaggguauauggcauuuauacaaauuaugagaacacaaaauuauuauugaaggaaaagugaaaacgucuagugguaaugcaaugcuuucuuugugaagcuucaugggagaaaaagcuagcaauuccaucaaagacaaguuaaauuagacugcuagauaaucacaugcuaauuuaguaauuuaaaaaacuuucaauauguuaucagcauuaguucuacauuccuuuacguagcaaggcuuauuuguauaaaauuauagaauuuacauaaacaacaugcuuugaggucaaauguagucuuaaaaauuaguaguuaugauagucauuauuuauugaauacacacgucagacaauugauauacauuauccucacagaaaugccucacaucaauaauuauuugacccauuuuauagaggaagagacugagguugagagaauaagugacuugaucagugugucauagucagugagugcgagagcuagaauucaaaugugggucuguccagccucaaagaccauaguauuuccaacgcaagacacugguuguuauuucuauauuucguuugcuauauuugcuuuagcauuguguguguguguguguguguguguguguguguguguguacuguggagguggggggagcgauuucuauuuggaugagaauacauuucauguuucuggaaagcugaaaacauauucagaauaaugcuucaagauuuuuaagucaaucuuuuauguuacagauaguaucuauuugucccagguuaucuaucucuaaauugguggucgauuucccuccauuugaguuucugagucucucuauauuuugcagcuuaaagaaccaguuaucauuccacuggaacucauugaauuuguguaggugcccaacucuaaugacugacauuuaagaacaaauacugugccuuugacauacuguuaaaaucagauacuggcacaguuacaacucacuaacuuuugggaaugggagcagaugcuuugaaacacuauacuguacuucaaacaagaacgaaugcgcacagaacucuacaaccauaagccaugaaucucauguaauguauaucucugaucuuuuggucuguuucuagauggaguuugcuaaugauuuccugaggaucuuugcaaccaacaguagcauugggcaaaggcacugggaauacucuugcaguucaccaaucuccaucauguacaaaauuguguuggaaacaauacauuaugggccauguuugucagaagaguauuugugccaauuucuaauaguaacuuucagcaaacuuuuaucugcauuuuauugaguuuuguguuuuugauguauauuauuuacuccauggaaacuaccaugauaauuccuuuuugcucuacacaucuguugcauaaaauaaugcauuuaaaucauccuaucugaagagaaagugcgauucuggaauuuucuggaauauucuaaaauauugaacggauucuaccauuuguaaaagguaaacuaaagcuauaauguaaaugaauaauugagggcaaaagcaagaguaaaaugaguauguagcuaggaugcaacugaauaacaaagugaguggacauuuacuuguaggucauaccauaauuaucuugauauauuauaacaacaaaaauuuuguuucaagagagcaauuuacugcuguuuucaguaguaucaguaaaacuguauuauaaacaugaacauuuuaaacauauaucccccuguuuaguggaggauacccaaaagugguaacacaggaagaaggaauggaauauaucuacacagguuauaacaacaauacucguuuguucaguuucuauaaauacaaaggugaagaccagaugguuguacacagcaucaucuagaaccugcaggucuauaguuggagaaagcccauauugcaggucaccagacacccuaccaguacaagauugggcccuuggcugucuggcaguacuaacaaucaaacucaacuauaaugaucagaagguuuuaaucuaauggaggugagaucacaguuuagugcaguuuuuuuuucagugccuucauuuaaauauauaaauggguugcccaaauagucacccuggcuaaaugcugcuaaauaaauuagugcuccuucuuauccuucuaugaaaagaaaacugaaaucaaauguuaagaucuuuaauaugaucagguuucugugacauagcuucaccuuaaauauuagcuuuacagccugaaaauauagaguuuuaauacaguuuagcuggagaaguuguuuuguacacaaugcauuuuuagaggaauaucuuaauauauugcccaugugaagcuccugguguuacaaaaaaggcaguuuauauucaacauacuucaaguuuagaauagcagagcauuuuguaauuuagaacaaaggcauguucccucuaguaguuucugauaucaacugcaacuuauaaauuugccuugagacauguuugcaauaaaaauuacagguuuucugauucagcauguuccaucauagcacacuaagauagcaccaaagaugacaaaaauaaaacgacugaagcaaaaugaagugaacacaaauagcuuauuaccaaaugaaaaggccauuucaggagcccaaaauagaaagggaguaacuauuacaagcggucacuuuguauuuuucauacuaagaagaguuuagaacaagauuagcagaaaugcuguagccuauauuaugagccuuuaaaggaaauauaguaggucauucaacaaaugguaaucuucaaaaacuuguaucugaaggucaaaaucugaguguauaauauuuagacaugccuaaucauuguuuuaaaauguaaaacaaucauagaaucauuaauaggcaucuaauauauacauuaauauaccaugucaaauacagacauuucuuuuuuaacaauagacauuuucucagaugauaggaggaaugggaaaaucagccaggcaugguggcucaugccuguaaucccagcacuuugggaggccaagguggguggaucacuugaggucaggaguucgagaccagccuggccaacauggcaaaacccugucucuauuaaaaagacaaaaaaaaaauuagcuggaugugguggcaugcaccuguaaucccagauacucaggaggcugagguagaauugcuugaacccgagagauggagguugcagugagcugagauugcaccauugcacucuagccugggcgacaagagcaaaacucauucucagaaaagaaaaaaaaaaaaaaagaagaaggaauggaaaaaucuagaguacuccagagaaguguuaucugugaacauaguauuaguauguauaacucauaguauacucuguuucucuaccuaaccacauaucucacauaaaacucagugaaugcucacucugagaacccauuagaccugaggucucuucucucaaacccacagucuuacucaugcacacaguaaaaaaaugagugucuauagcucuaagugguggaugauaaaagaaagaaaaugcuuugcugcucuaaucagccuuaucuucuugacaccugacugagauuauuuuuuuauuccugcuacuguucucugaucagacuagcaucaaccuguggguacugaacaauacugagagcuuacgaguaaguuauauuuaguuauuuguaugaacaguacauacacugagguacugugugauuuaaggcaauucugugaaaauaaauuuuuaaaauuugaguggcuuuagguuucuguaaaauucuuucaauaaacacugaaacucuuuucaagcauuuaaaauuaauuuggggccaggcgcaguggcucaugucuguaaucccagcacuuugggaggcugaggugggcagaucacuugaggucaggauauugagaccagccuggccaacauggugaaacccugucucuacuaaaaauacaaaacuuagcugggcgugcugguacacaccuguaaucccagcuacucacaaggcugaggcaggggaaucacuugaacccagaaggcggagguugcagugagcugagacugugccaccgcacuccaguuuuggcaacagagcgagacucccucucaaaggaaaauaaaaaauaaaaauaauacaauuaaauuuuuuaaauauuugauagucuauuagauauaucugacagcaauagcuuuaacauugaguagguuagauuuuaaagucaagcauaucugucaaaucaguauuugaucagguuucuacuguuuuuauauaaagauuaugauguugaugauuccuccuuccacaaugccuuauuuaauaauuucuauugguauuuuuuuguggaauuuuuccccccuggcagagucaggugauucuuuauaaauauuguugaagaagaauucaugcacugaaauagaauaaauaaugcaugauuucccuuccaaguaugagauugugugacucuaugauacuaaauggucauaaauuucuucauagcaaacucucugggacauuuauacaauuuuauauuaaugaaauaauguuauauuaaauacguuguuaaaaacacaucucuaaaacugucaacuauuuuuuuaaaaaaucuaaugcguaaccccucugugguaaacuuucacuuauauuuuuuuccuaucuuccuuuaacaagacaguagaugucacuauccacauaaaacuuaaauaacucucauaaaccucucugucccaucuccaucuucuuugucuucuaagauuaaaaacuacauuuagccugguuguguagaacgcucaucaauaacugacaagaguggccugacagcuggcuuuggggaauuuuaagucuaaucccauuuucuaugggguggaacaagucaacuuaaguuaucacaucagaggagauuuuucuucagggggagaaaaauggaacguggcugauaggauaggcaccagaugcuucaggcaaaagggcuaacaguggaaaagagacaaauagggguauaugacaagcauccuccaacucaguuuagguuccccccuauucucuucucaguuuucuccuuuggaugcugauuucagcaacugucaaaggacagauauuguuacagcccugagagcucauuagcaaccauguaaacagccugccuguccauugguuguagcagcugagagcuguccuaugaagugcggugacaaguuuuccagcauaaaaagugauccaaaauguagcauuuaaaggaacaacuaauaugccgugagggugagaauuaauguuguuuagacccaagaagcaagucaaaguguuacaaaauggacuggggugcuuggguaaggcaggccauccccaagagguacugccaacugaccagcacugagcaaacacuuaguuucuaaaagcaugaauugugaaaacauaaauauuuguguuucaaucuuugggaaaauuauuuaaacuucuccaaaaugcaauuucuuucucuauugagcagaggaacuaauacuuuuauauuaagguaucuagagguuugaauuagauauuguuuauaagacacuuuucuuaguaauuagcuaugagcacucaauuaccaguaguuaaaauuauugauguuauuaugaugauuacuauuacuuuguucucuauuaugauuucuggaauugccguauccuuguuuccuaucaauuagauucauucucagcuaauccccuuccuuaccuguggaucuuuaacuuccccaccucaucuacucucaucaaguucuguauauuuuaccuccuaaauuuuguaaaucugucaccaucuuugccuuuccacgucuaauagccuuguuauuucuaccuggacuauuauuuuuaagccuuucccuaucucuguucucacucaccacuaauccauucuuuagcacagcuaaacuguucuuucugauaugcaaucugaucauacugcugccuuguuuaaguacugccuauguacuucacugcccuuagaaaacaguuuaaacuccuuagccuucaaguuccuucaaaaauuuggcuuaagccuuuucuauuuccauucucagaaacaaccuuuugccuuacucauauucacaguauaagccaaacacuguuucuucauuccuggcuguaucacaggugcaugucuugguagaugucuucuuggcauaagaugcuucucugucuaccuggagaauuccuuccuuucaacaugaaacuucacugucucuucagugcucuucuaacacuuggaauauguucacauuucagcauuguguuuaggaauuguauuuguuuauuuaccucacuagaauauagauugcugguucccaugauuuuuaaaaaacuucaucuuugaaauccagaucuagcccagggucuggaaaacagucagcaaucaaugaggcuuacuuguuuuaugguggucuucuucacuagaaggauauuucauuuugggaaguaagcauuccccugaaacuagcauggcauaauaauagcauuuuaacuauauauuauuagccauucuacagcugacuaaucaugaccagaaguauuuguaguuaaaaaaucaaaaacaaggccaggcaugguggcucaugccuguaaucccagcccuuugggaggccaaggcgggcagaucaugagguaaggagauggagaguauccuggccaacauggugaaacccugucucuacuaaaauacaaaaacuuagcugagcaugguggugggugccugcagucccaacuacucgggaggcugaggcaggagaaucgcuugaacccggaggcagagguugcagugagccgauaucacaccacugcaccccagccugggcuacagaccaagacuccgucaaaaaaaaaaaaaaaaaucaaaaacaaaauaaaaaaucuaaaacuuuuuuauuuuauuauauuauacuuuaaguuuuaggguacaugugcacaacgugcagguuuguuacauauguauacaugugccaugcuggugugcugcacucauuaacucgucauuuagcauuagguauaucuccuaaugcuaucccucccaauucccccaccccacagcagucuccggugugugauguuccccuuccuguguccauguguucucauuguucauuuuuaaagaaauauuuggcaauuuccucuguaacacaaucagcugggcaagcuucauugaaccuccagugaauugccugucauaauauuuugccacauauguaaaauaaauaaauucagaggcaaggcaaauaaaaagaaaacacaaacaauuaggaccaaaaaacguauuucaaaaagcugaggguauagucugugauucugguagacauaggaccugguacaaaguagaauauuugcucuugaaaaaguuacuuaucugagcagugcagacagagaagauaagggguacaugaacugagugauuuuuucacugaaauauuggaagcaaacugaaauggugaagaaaauugcuuaauugaaaugcuuauaaauauguaaaagaauucaugauuuuaguagcuaaagaaucuugagauaagcagcagaacaagucgaggacagucaccuuuggcaauguugaggauuacuacagaaaauuauauuucaggauuguuuuucuugguugaauauuuagauaaugaggaggaaggagaguauguacgcucuauguauggacaaauggaauaagccuuccaccuuccuauuuacggcguagccaauggccacuuguucuuugagaagucacauuccuaucuuacuuaguagcuccuuuuccuuagugaaguuuucuuaacuaccucagacucaagcuuguaaagucuggugaaauguaaagguaucaagaguauacggugggauaaaaaggacuccugauguuuucaagguggcuugguccauaauuaagagcucuguaaaagauauuuuuagugccugaagggguguccuuauuuaaugaaaguaggcucaggaaagaguuuuuagcuuaauagcacuaaguuuccuauuuuaaaaaagauuaaugucaaagucauguuaauggaagacauaggguucucucagagaagauuagauuguauagccuaaaaguauuccucacggugugggguaauucaggaggaacccagagacagcaaucucuaaugaaggaauguaccagcaccaaagugcugugucuuccuuccuguuauggugccagagucucuuccuccucaacacagcagaagccuuuggaagagcaagcugaggucugaggccagcacgguagaaugauaccaggcaaggcagaggguuaggacuccauuuugggaaauggagagaacuuuucaaaugaagccuucuggauggagagggugccauaggaggaacaaagaggguuagagauuuacggagggucagaagaugggcaccuccauguggaaugcuugaauaaggucuaaaugaugcagccuuuucuagucgcuccauucugucccuuuccccacuccuguccugagucuuucaucuucccccuaacucuccucauguggcacaacagaauacauuagauaaaagacagccucagguccuucugguuugaacuccuuuagagugucuauuucauuuuaauuuuuuuagaacuguuuaaauagccaccagaauauaagaugcguuuggucuagaaaaagugcgcagcaagauucaugagaagggcacaucuaccuggcagaacacgguccuccugugguagauuagauuacaaaguguggggauuacagaccagcagaugacccugaagucuacccugacagacuugggaauauuuucugcacucugucccgacgaaaguauucugggucagcccuacccaccaugugguacagucagauggucacagguaaaauuguaaguuuauguaaaguagaugcccuugggaaggguagaugucauggacuacuuaggggaacauccccuugcauuaaaaagaucugcacuuuccuuacaaacuuaggaguuaguucagauauguggacacggcaggccauuuuagagaaucuaagggaagauggaaaugcugcacgucuuacugcuguuggcuauaaccaauaaaaaugauuguuaaacucucugugaaaugaugguguuauacagaugcaagagaacagucaucugaaaaucugacuggcuugucugacuuauugacccacauuacaagcuagaaacuaauugugucacaucaugaacccugaaauguggcagacacuguauuuuucuaccacaaaccucaaaacucugacaguguugacagaaauaucauuuaugauccuuuucucuauuuuaaauggcuauuaguuaaauaaacaaauauuugguauauauuaauauuuaauaauaaauacauuauaaaauaaauauacauguauauaccaugaaaggccauuuuagauauauuauauuuaauauauguguaugauaucuaauaaaauauauauuauaauauauaaauuauuaagcaaaucuucacuauaaaagguccuaguauucuguacauucaauuauccugcaguuuuccugugcaugguaaaaagcaugugcaguuucuuuuuuauauaucauaaaaaagcugcaauacuuauuuaucucaagacacuaggaagaaauacaaaauuauccuaaauuuuauggucagcauuuuacaauguuacugcugauuauaggaugauuguaaaauuuauguuaagaugauaucuucaaauaaugcaauagauuucaguagugaaauaggggauuuucauauuccuauauucuugaaaauucaggaaggacuucacuaauucccguuaauuucccuggaaggaucacauuuuuaaaugguguuaacaaaaacauacuaaaauaaucauaauaccagagaguugaaagaguuaccagaggcauuacauaauaugauuagguaccuuaaggcacauaaaccagucccuaaaacugacuucauguuuuuuuuaauaagauacuucagugacuuggaaaacuuaacacaagggaguccuuacuuguacauagccccaaaaucuccuguuucacagaaaacacuauuuuguucucaaugaaaauggacaauaccugcauaccaccucugguacaauauuucucuauguaauaaaacacuucuuuuucauuuuccuccuuuagccuucucuuugucaaauuaaauacuaaauuauuuuaguuguuaucuauaagauauauuacuuccauuuuuagacuguuauuaacuaaaccauuuuuuuuucucuuguauuuuaguuuuugcauaauuugugaaccuucuaaguaggucaugguagucuuuacaaggcuugaacaacuuacaugcugcuagguuacucuggucauuuuaaaaauaaacacuaaugccacauuucagauuuauaauugacagaugguuuauacugaaauuaucauagguauacacaaauauacgcauacaguuuguuuuuuccaucucugagugauuaucacauauucgucccuauuaaacuucaucguacuucuaaucaccuuguuuuauuuguaaagguccuuauacauucuuacaguggaguucuagucaauaaucaccccuacucaauauagaguaaucugcauauuuaauaagcuuacucccuauuccauacuucaaauuaacauugaaaauguuaauuagaaucaagaccaaugcugacuuauggaaaaaaauuauucaauauacccuccaaggcugacauugaaauauuauugaucacuaccuugcauauggccuacuaacaagcucugaaacaauaauacauaauaauacuacaugaaacaaugacccaaaugaaauacagugugaauucaaaugaggaauccauaauaauuugugauuuuuuuccucuauaagaucuuuugaggagcucaaaaacauuaaucauacuaucaaaaauuucauagugggaaauaaaagacuaggagaaauaaguuaccaugaauaaguguaggcuaauuuaguagccuauuuaaagacccagugaaacauuacugucaaaguaagguagaaggucacaguuucagugaaguaucuaaugaauaugacaaaaaccaaaaauccuggcucuuuauaacacaggaacagggggccaaguuucuacugauaacucaacauuuuccaaaugcaaaagauacauuccucuucucaguccaguaggucugugaauuucucaaaauaaauauuuuuuuuaaauuuaucucacaccuuguuuauuaagauaucucauugguauaguugauauaaaaguuuaugccugaagggacauggaaaauaacaucauucaaacuguggaacaaauauuugugcagugagcgaagaauuggaucacuuuuuuaaaagacgaaaaacugaagugcaaagugguuugaguucauguccuuuguagggacaugggugaagcuggaaaccauccuucucagcaaacuauugcaaggacaaaaaaccgaacaccgcauguucucacucauaggugggaauugaacaaugagaacacauggacacaggaaggggaacaucacacaccgaggacuguugugggguggggggaggggagagggauagcauuaggugacauaccuaaugcuaaaugaugaguuaaugggugcagcacaccaacauggcacauguauacauauguaacaaaccugcacguugugcacauguacccuaaaacuuaaaguauaauaauaaaauaaaaagaauuugccuuauuuuuuaguaggagaaaagagacuugaaccuaagucuucagucuccuuuaauaauauucuucugccaaacagcucugccugccaacuccagucuugcugauuuucaucacuacucuucccacauuaauuucacagaaggaugcuccauacucaaacuacguccuccacaaugacugauucagaaugauucagagaaauuauccucuauucucaaguaggugguauuuccuuuuugagaaauuucagcagaaguugauauuaaaugcauaucuugaugccugagagccaggucuuauuaacugcuauuuugagauuauaaaugcccgaacuguuuugcaaaugugcuccacacucccaagacaacagcaaaucuugagaacucuguagcaucccucucagaaaaugacaaucguccucugaauaaaagcagcccaccagccagcuuuagaccuuauuccucgccuuccucaccacuugcuauuagcugggguaucuggcucuuauuuagcaucaucccucuuuagcaucugggcuugagaaauggaggcuguaguacguguguguguguguguguguguggugugcguguguguguggggggggggaguggaggagagagccauuaaaauaaauuaaauaucuuuaggugacaggaacuauggaggaacuaagagcaucagagaauugauggggucaaacagauacuuagcaguagaguguggagggcagcauaccaacaucacuggcaugauggagaggcuagggaaagaaaaauaggacuggaaauagagaacuagaaaaagaaaauaagaagauaugacaaaaaaggauuuuuuuuuucagauuugccuuucaacuuaagauaucuguuauucagguuuucaguugaguaucaguuuuaucucacaccuuguuuauuaagauaucucauugguauaguugauauaaaaguuuaugccugaagggacauggaaaauaacaucauucaaacuguggagcaaauauuugugcagugagcgaagaauuggaucacuuuuuuaaaagacgaaaaacugaagugcaaaguaguuuuagaauuugccuuauucuuuaguaggagaaaagagacuugaaccuaagucuucagucuccuuuaauaguauucuucugccaaacagccccggcugccaacuccagucuugcugauuuucaucacuacucuucccacauuaauuucacaaaaggaugcucuguacucaaacuauguccuccacaaugacuaagcaguauacuccaagcauagguucuuuuuuuaaccauaucuauaaguuugugguggauagaauuuauuuauccagcagacuucaguaaggggaggaaguaacagaaaauggagaagagacaggaauuuauauucuugagcacagcacuuaauagguuucuaggcuuaaaggagcaagauugggaagaaagagaaaaagagaaggauuugauuugucuagaaugauucaucuuguucagaagaagauuauuuuagaagcuguggaagauuauaaaauugguaaaguuuuuguccuggugagcucaguguaaacagagucuauggaaaugcuaacauagcccuguuccugggagccacaaacugugagacaacuuuuaauuaaaugcucacugaaagguggcuuugaaagaccaauauacuucuaggaaguuuuaauuuuuuuccaaaacagagacaaaauucugucuaugacaucgagauagcuguacguuugggaaacauccaucacuguaguacuuaagugcuaggacaaguaagccauuucaacacuaacaauagagaguaaggagaugaaugucuuccucugcugcagugcuuguguguucuggaguuaagccuauacaauucuguacuaaaaugaaacagaaaggcaguaugagccagcccucgcucacuucauccaccuucauuuuggcuccuccuaauaaagugugcaauucccuacugagagcuauaaaaaagacuccuacuggaagacugaagagugagugggugacacaaaggauacuuagagagcauaccauuuuggguuuccucucuuauccuggaauaauaggacaaagaaauggcuuucauauuucuaucuaauuuuuuaaaugggguacacauacaagucauggaguuucacacucucaggucagauucuaaaaaaugucuuucuaguucacucagugagugaauauuuacuuguaacccacuaaguacucacacaauacacuacauaaggcacugaacugguacaaagaugauaaaacaacccucaagaauaugcauuuuaauagggaaguaaaacaaguagaauaguauuccaauacaggguguaagugagguagaugugaagugguucaaaaaagggagacacuaaauauaguuaugaauauguggcaaggacauauuugaguauuugagcuguguauuaugagagggcuaaauaaaggugaguuaggagagaaaacuuaccuggcaaauauauauccugacccaggggucuugccagucucuauuaguagcaaccugaucucagugcuaguuagucacuagcuaaggugagauaacagagugaaucauucuuccaagaccuuauuuaugccuaaauucagauaaggcuugcagaugcaucagauuuuuguuuguuuauuuugcuuuuaucuuuggggaaaaugagaggauuaagcagcagggcaaaaagacaacccucagcaagauagacuguaagguaggauggugacaucugugucagaaacaguagcuccauaagcaagaaacauugagauuuaggugaaucagcucaaaggaacaauuaauauauagaauuguggacaaaaugacaaaaauaccaucaaaaugggggcagagagaaagacaggccaaggaaucuauaugagugccuagagaaaauguagaagaauggaagcaaauguuagguaggugcuguccauggacuguguuauauuauucaugcucuuuuucacuuaaucuuuacacuaaacacuacacuaaaccuaugaaguugaaucuaucccuuuuuuacucuuaggaaaauaugguuuauaauaauuauggaauccugacaaggucauugagcuauuaaguggcaaagaauucgaaugcagauuuguuugaauccagucucccguuacugacuugcauaccacauaacuuagaaauaccuggaaguaacuuagcuaaacauacugcugccauuuauucuuuucugcaaagcucucuuuauuuccuaagaaauuuauaguaacccuuauggaugccauuuauucauuuauuuauuucauacaauaaagguuuagcguauuuguaauuagcauacaauauguuccccugguaaaaaguuauagugcuagauugccuggguuuacuacccuagcuucaguuucaucaucuauaaaauagagaugauaauaacauaucucucauggggcuauuacgaagacuaaaugagaaaacccaugcaaaguauuuagaaaacuagcugucacauagcaagcacucaagaaauauuagcugcucuuauucauacuauuguuagguacucugagaggcacucuagcagugccucucaagauggauauaacauagucuuugcuuuugaagaacuuaaaaucgcaaagagaaggcacauguguaguaauggcuaauucugccugggaaaauggaagauaccggaagagaaggggguuuugagugauuucagggagagagaagagcauguaaagcuccagagaggcaugcaaggucccauaagagucuagcuugacuguagcaugaaaaagugagaaggaauuuguuggugccccuggacagaaaugugggugggaaagaagggcucaauaugcuuugcuaauggaguuguauucaucuuuauuggaugaaguaauaauaaaguuuuucaagccaauuuugaggaugggagaagguaacagucuggacuccacacuccaguggauaaacucuauugggaagagaauggagaaagaggaacaauaguuaagguaagggaaaagaaacuaagaugugaagcagcaggcagggacagucaugauauuuuauugacucgaaucaauaaugggaagaaaaucaaguagaaaaucaagacuuggagaaaaagauggagaagaaauagaagcggggaauauaguuagccucuaccuuguuuuaaaaauaguuguugaaaugaaugauguaauccacuaaacaggcuaauaaagaaaaauuacccgagcauaccaaucaauaaaaaaugaaaucauuugucaaaauccaacaccuauucaugacgaaaaacacauggaaaacuaggaauagaagauaacuuccucaauuugagaaauaauaucuacaauaaaaaacuuuacagauaaugucauaccuaacggucaaagacugcuuuuccagcaagaucaggaacaaagcagagauauucacucucacuacucuuaauuugacauaguauuguaaauucuauccagcaaagaaaaggcaaaauagaaaauaaaagguaucuggaugagaaagaaaaaugauacaaccaccugacuuuguaaauggcauaagcuauaccuagaaaaauccaaagaaucuaccaaaaacuccuaaaacuaauaaaggagcuuaguaaguuuacaaauuauaccuaggaaauccgaaaggaucuaccaaaaaccccuagaaguaagauaugagcuuagcaagauuacaagauaaaaucagcagacaaaaaacaauuguauuucuauauccuaguaaugaauaugugaaaauuaaaauuaaaaauucaauuacuaugauuuuaauacuuggguuccuuccagaguucauauugaaauuuaaucccuaguucaacaauauuaagagggggaccuuuaggagacaaucaggccauaaaggcucugcucucauggcugggauuaguuccuuauaaaaaagcuugauggaaugaguuuggccccuuuugaccuuccaucuuuucugucaugugaggacauagaacagcagucaaaguaccaucuuggaagcagaaaccuggcccucaccagacucucaaccugcuggcaccuugauauuggacuucccagcauccagaacugugaggaaauaaauuucuauucuuuauaaauuacucagaccuagguauuuuguuauagcagcacaaauggaucgagauaccaagaacguuuguaaucacugagaaaaagaaauacuuaggcacaaaucuaacaaaacauguacaggacuuguauaaugaaaauuauaaagugcugauaaaauaaaucaaagaucuaaauaaguggggagacauauguuuacagaucagaagacucaucauauuaaaaaugugaauucucacuccaauuuauuuaaugcaauuacugucaauauuucagcaauauuuuuguagauauagacaagauuauucuauaauuuauaauaaaaagacaaaggaacuaaaauagcuaaaaugauucugaaaaaauaggugggaagaaucacucuacucaaacuacaguaaucaaaacuguguuaccggcagagggauagacaacacagauuaaugaaacaggguaggaacacagaaacagacucacauaguauggccaacagauuuuuuuuuuuguacaaaggugcaaaacaauucaaugaagaaaggauagucuuuucagcaaugcugcuugagcauuugaauauccauagugaaaaauugaaccuaaacguugcacuuuauacaaaauuaacucaaaaugcaucaaauauguaaauguguaauguaaaacuauaaaacuuuuagaagaaauaggagaaaaucuucaugaccuuggacuuauugaagagugcuagacaugaaaccaaaagcacaauccauaaaaugaaaaaauugauacauugcacuucaucaacuucuaaaacuuuuguucuaugaugaacccuauaaagaggaugaaaauacaagcuacagacuaggagaaaauauuugcaaaccaccuauaugacaaagccuuugugucuggacuaugugaagaacucuuaauaguaaacaacccaauuagaaaauaggcaaaaagcaugaaaacaccuuucauggaagaggauaaggauuacaaaugagcccaugaacagauguucaauaccacuacacaauaauaaaauagaaauuaaaaccacaaugagacaucaccacauaccuaucagcaaggcuaaaaaaaaaaaaaugauaccaccaaaugcugacacagaugcagacacccuugaucucucauacaaugcagguggaaacacaaaaugguacagccacucuggaaauuaguagggcaguuucuuaaaaaacaaauauauacuuaacacaugaccgagcaauuguauuccugggcauuuaugccagagaaacaaacaaacaaaaaauccacagaaaacugccauguaaguguucuuagaagcuuuauauguaauagcccaaaacuugaaacaauaaaaaugucauucaguaaguaaauugcuaaaccaacugugguacauccauaccauggauuauuacuuagcaauaaaaagcaaugaacuauuacauacaacaacuuggauagaucucaaggauauuaugcugaaucaauaagaaagccauuuucgaaaggccacauacucugauucaauccuauauuacacucuugaaacgcaaaacuuacagaaauggggaacacaguaaguuaccagagguugggguugguaaggaagggugaaugugacuauaaagggguagaaugagagagaucuuugccgugauggaauaguucuguaucuugauugcaguggugauuauaggagucuacauauguaauaauaugucauagagcaauuugcacacauuguaccaaugucaauuuccugguuuuaauuuuguaguauaaucacuuaauaugcaaaaauucagggaacugagagaagaauacaugacacugcucuguacuauaucuuugaaacuuccuguguauauauaauaauugcaaaauuaaaaguuauaagaaaguuuguccaaauauuaacagaacuuacugccccaugacaguuuauggauuauuaaugcuuuguccuucgacaucuuuuuguacuuuccuauuuucucaaaacagccuguuuuuuuuuuuuuuuacaaucaggaaaaaaaugcauucaaauggaauaaaaauaagucuaacuucuuuguugauggcucaaagcuaaaagugagaggcagauggggcccacgaauaguagaccuugagaugcaacuuuucugcaaaauugcaugugaaacgcagccuaaacagagucauuuccagaauuuccucauuaaucacugucuuccuuuuuacuuaguuagcuaaaacauaguaagccacauccucucuuuaaauaucuuaaacaaaauuaacugaggcaauauucuuacauccacuacauaaguaaauauuagccuagaaauaugaaguuucugaagccaaauuucuaaguuacccuuaauccucuaguauuaucaaauuaaguagcccuugaaaaaaguagagacauauucguaucaaguagagacauacuaguuaauugcuguaaauauacaugcauuagacaccuuuaacggccucccaugcaugccuacauuuucucucucccacauguccuccucuccagagauaaaguugucuuucuacaacgucacucuccauuaccuccaggaaaaauuccaaauuccuuaacaagucuuaccaugcccucgaugauuuagucccacuuuccuuuucuuuacagagcaucugucacuugcuauccuucccucugucuccaggcuuuaguaccagauuuggugaugcuugaauuucuaagcauaauuagaucauacucaccugugaacacuuagaaaaaaauugcucaauaauuauuuucuuuucaaaauguagaccaaggugauggcaaaaauccuguuauugauaugcuagggaaaagggguucuucuuuaguaauagaauauuuauggaucucuuucuguaucaguuuggaaagcaaugcuaucccauauuaguuagauucaguggcagaauuaacucaauauuuuguuuaguccaaccuuaagcauuauggagaaugaaagcacugaacacaaaaauauggugggauguugggaucccuuugaguagguccaaguuuacuugcagcuccugggaaugaaaaaacucaaguuucaucaccaaagaccaguuugauucuaaaguuauuaauaacuauaacuguguaacccugauuuucccauagcuauuuucacuuuuaugugaacuagguagcuuuuggaaguaauaucacaauaaaggcaaacagaacuaauguugaugaugcuauuauccagugcuuacucugaaguaccuucaaagcuucacaugcuccauuucaccauugccacuauuagucuaguuaucaagagaaaaaaaaucauuccaauuucuagguguuugaaaacaauuaacuauauguuguuaccucucaaugggaaugaaaaagcccaaauugucauuagagucuuguggaaauggcauuuuuuuucccuuuaagaacugaacugugucauacucugucucauuauauuauauuaaacauaggacauaguuaugaugugcugcccauaucacugaagggauaugaaauuaaauuuauggguuaucuuuuccagggaaaauucccuuucaaaacuuuuauuaauaacaagugccaguuagauuagaugcccauagauaucuaauuuuaaaaacaagguaaaauuuuaugaaauuauucagcuuccccaaaauaaaucuauuagauugcucccagcaaaguggaagaguuucugucaaccaucaauucaaagaagcugauuucucucccucucucucucucuccccuucacugacauuccucuaaccaccucugcccauuguagucugcagaagcaacgcugaauuuuggaaaugaagcuaugguuggcauguguuugccaauggcacagcaaaauugggcuggaaauaguacauugacaugcacugcagcuucauuuggugaugagcaaaucuuauuaauauaaaugauuaagaagcaugacauugaaugcuacuuugaaaaaaaguuugucuuuucuaagaaaaauuagaauuuucccaagaaacuuuggcauuaguuacaaaugagauuuugaauguuucuaagaaacacugcaggcaauuauguuuaccaacacuguugaggcaugaaauuagaagauaucuuuaaauuucgggagggaaucuggcuucuuuuaacuuauuuggcucugauucucucauuccaaaauuaguccagugauaauauuacaaggaaguagagauuuauuauacccacugaugacuuuuaauaaugccaguuggcauuggaaaggaaugauuuuuuaaaaaaaugaaugcaaaguuacuuugggcaguagaacuacacuugagggaaacaugaugugaaauuacaaucuuuuuccaucagguuuuacuuuuagauaaaccuauggaugaaaaauuugagacaggcuucuccucccacugcuauugcaugaaagucuagauaaaaacuggugcuggcaaaguuaguaauaacuaaauaacucagauuuacagacaccacaaagucugcaaccucagagaaauaccauaucaagcaaacaaauucuaggacccaccacuagauuaaaaaaaagaaaaaaaaaagaauuugacagguaaggccacggauuggugucugauugacauggauuggacucucaacucugacacuuauugaguguguaaucuuaagcauuaucuuccaaacucuguuucuucauccauaaaauggcaauaagaagaguacuuguauuauuaagguuauuuuguggaauaaaugagaugauauuuguaauaugcuuaacuucugguucauuauaaauucucagucaauguuaaccaugauuuuuuguuuacuauaaugacaguuguuguuuacugcauaggaucaguuauuuuauuuaaacuuuuuacgauuuauuuauuuaaaaacacuucaaagucagaugugaacuacauaaauuuugagcuuuaaggauacccaaaaugugacacauucaacauaauugauaagaaauauguuaaugaaauaaaauacucaauuuuauugauuaaaaacuguuuugcuauuugccauuugcaacaacauggaugaacuuggaggauauuacacuaggugaaauaagccaaacacagaaagacaaauauuauaugauaucacuuauauguagaaucuagaaaagucaaacucguagaagcaggaguagaauggugguugccaggggcuagaguauagggaaaauguggagaugucggucaaaggguacgaacuuucagaagaugaaccaguugugggaaucuaaugcacagcauggguggugcauuugauugugucaauuauuucacaauguauauguauauugaaucaucacauuguauaacuuaaauauguacaauuuuuauuugacaauuaagcuauuuuucuuaaaaugacuucuauugauuggauuugccaaagucuuacccugaaugguagauaccaauuauagacauaauuaacucauguugggauauaugccuacaugccuauaacacaaaagucaccuaacuuuugauacucuauuuccucagaccaguugaggauuuggagaauuucauccuuuacaucccuuagcaauggaaaaugcuaugacgaguuucuucuuguguucucuaaaaccuaagauucauacagaaauucaaguucaaguguggugugggaacuaacaugaugcaguuagaauguaggcucaggaaccagauuuaagauuuggucuuuacucagucacuuacuagcugcaggcuuugggugaguuacuuauccucucaacuuuaguuuugucauuuauaaaaugaguuauucauaguauguauuuuugaagaugauaguaaguuuuaaauaagcuaaugcaucacaaaaucuggcuuuuuguaagugaucaauaaauguuuauuauuauuuucauaauuuuacucauuucauugaucuuuuggcugggcuguuguaaucauuuucauauugcuuaaaguaugaugcuuauggggucaccaguauaagcuuuccaucaaugguauaaguuucacucuguaugauuuguaauuuaugucacacauagaucuauuuacauggacaauaaauugggggaauaugaagguucuguaucaaaggaauaauuggaaaacaacuugagcagcaugauuucaugagagaaacuagaaacaucaauuuuaugaauggauaaaauaauugacuacuuauuagcauuacuaguugaauaugggaguuucaauuuguauaaugagcaaauagaaaauaauacccuauuuauuuauagauaauuaauucuuaacuuuuuugguauuaugcuauaauaguuuuguggcuacuaaugaauuuaauuuacauucuuuuuaaaagaaaauaacuacccagauuuucuuuuccaaacaaguuacauuccuaaggaauucccugacauaucuaauuauucugaauuugaauugucagcuuuuugggaaaugaauguccaacuuuaggaaaauucaaacuuaccuuguuuggggaugaauaaaacauuuucaggaaaauuuuucuuaaaacaauauauagaacauuauguucuaauaaggcagaaauuauacugugguguugaucuuauagcaugaaaccacaaaagcaaaacuggcugugguggauaaaaggcccuugggcuccacgggcuuacggaaauggcauuugugaauugagacacuggcuuagguaacuuuuaggauuaaauaagugcaccauaguuaaucacuauuucccagcauuccaacugcaaccaguaaauagcagcaauaaggaccacaugaaguauaagguaaugaagagaaaaacagaaugugguuacugaaauacuauaauuuucuguugauugcuauuccccucccuuuucuuuucuccccaauccccaaucauccgucuaucucucaaacaucuguaucuauucaacuauuuauucugacaguacauaaugggacagacucaaggcaaagauuuccuuuuaaguaugacucuuuuuuuucuuccuuuucacaguguuagucagauauagucauucuuuguggacacuaaaauucugaagauguguuauccuuccaggaaaaugugggaagcaacauugaaaucauagccaaauuuuuacuuuauaaaaaaugcucuaccaauacugcauuuccaggacuuggacuaaucagugauacuuugcaguaacacaaaauugauccuuuacucaaagagaaguuguacauuuauuaugagacaccacauacuuauucucagauagcuuuggccacucuuaucauuucucauauuuuguggcuaauggaaacauuguuuacuuacuggauggaacuuucaaugcguguaauagugaggaaagcagcgagguuugccguguaagaugagauaacaaucaaagcaaauagccaccaagcccccaucaucauucggguagccagagucguguacgggacuuccccgccuguagaaagaagcaaagagauaaaaagaacaucaacuaguauuuauugaggaucugaagucaucuauauucaacaccaaauuaacuugcaaguagugagaauuuuuucugcuuaacaucaacauagaucucuauauuuucaucacuccauauuuaauucucuuuuaugagauuaugaaagacccagccaaaagaagcaugauaaauauuuaguauaacauguuuaaaugauaguucuucccccuuccuguucaacccuauaauuaauuaccuuuuauuauaaucacagguauaugcuuucuuuccaagggcuugauuauucauuaguuaggugacauuaauauugcuaugccuauauuuaauacaaauuuucagauuuccaguuaaauaaauaauauugaaaggauuauuuuuuguuauauucucuagaaacauagcuuguuaaugaucaugggaucacacauauuaguguuggcuucagcaucacauacuugcuuuguucuacuuuuaauugacuuccuacucuuacaaucuuguugcagaauccucuucuccaucuuuuaaauguuggaguguucuugggcucaguccuuagacugcuucucuucucuguccauagucucaccauggacaauaucaacgaguccccugacuuugacuaugaucuacaguauacuuugauaacacuagaauuuacauuucuagcccccuaccuugacucuuucuagagagcuauagauaaaagccuacaugauucucacuugcaauucaauaugcaucucuaacuuaugacaucuaaaacagaacucauuuuauuuuacucccaaauuaacucuccuucaagccaguccacaccaugucagggaauagcaccacuauuuacuuuauuucuuagaccaaaaauaggaauuuucaaacaucuucuucaauagcaaguccugucaccauuacauucaaauuacaucccaaauccuaccucaucucauccugucuacugcugacacccaauucaaagaugacaucuuugacucuacuacugaacuacuuaugugguuuccccauuuacuuacauucuagagaguaccucuccuaagucuauuaccauggugccuuuauaaacgaaaaucagaucaaugggauuccccuaucaaagcuuccaguggcuucccaggacucuuuaaaaaauaaaauaaaaaucucuaccaagguuuacaagacucuauguauacugaucuuaggucaauugucugacuuuauuucuuaccauucucucaauggcuuucuugaaauuuccucuauagagccaugccgauauaugucccagggcccuugcauuugcaaaugguuaugccuaaaauuuucuccucuauaauucauaaauuccgucuuccuucaauuuuuucagguuucugcucagaggauaucuuuuuauaacaaucuuuuaucaccacucuaucuaaaauaacuccccacaacccuauacugccaauuccuuuaucuuuuuaaaaauaacaauguauuaggcuuuaaacauuuuuguuuauuuccguccuuuauaauuuuugauauaggaacaguccuugucccauauuaaguggguaauguuuuuuugaaugaauaugugcuguguuauggacuaaauuauuucucucucaaauucauguccugaaauucuaacccacaaugugauuguuauuuggagauaggaccuuuaacuaaguaaucaagguauagugagauuguaagcauggauucuaauccgauaugacugguguccuuaucagaaaaggaagagacaccagggaugcacaugcauggaagaaaggccaugugaggacacagcaagaaggugaccaucugcaagccaaggggagaggccucaggaggcaccaaacuggcugacaccuugaucuuggacuuccagccucuagaccuuugaggaaauaaauuuccauuguuaagccaccgagucuguguuauuuuuuauggcaauauuauuagacuaauacaugcuauaugugaacuauuaauaggccuucuaaaagaaguuaguuuuauacucacgguggaaauaaagagauacaauacuacuuucauguaguucuaucaauacgugaaugacuuaacaggauucgauuuacuauaauaucaggcauauuuuaauuacaaccacgaguucccacuacguaauaugucuaaauuuuauacgugggguaaguacacccuuugguuauauucuaagcuauuccccugauguauuauauucagaacaggcuaaccucugauaucuggaacccauuuuucaaaauaaguuacaaugcauuuuagauaccuucuucuuaaaagcaaaauaauuauuugcccagcuuuugaaagguaaaagcaaaauaaaauauuuauuuuuacauccauaugaggauuuucuggucaaaauagcuaauugaaaaaauaauaauaaaaugugaacaagaugauagccaaagacuaaaagauguuaauauguauaacaaaauuagaacaauaaauuuaugaaugaaaaugcuaauugggcauucauuucuauuaaaguuuuagccuugauuagaguuguuaucacccacauaaaagcauacuugaguuuuuuaaucuuuguuauaaaaauugcaacucaaggaacucaaauauucuuguagaaugcaaauaaaauguuauuugauaauuacauuuaggaaucaaauauuaaaaguaaugggaaucuugacuuccaauuuugguaaugguugguaaugguugguggaugaagccauucagaacaauccucccacugacaacaacuagaaaaauugaauacauaauguguuuucagagcuaaagaggcaguaaaaauuuauaggcccagaguccuggagaagaaaauaacccagaaagauagcuucauauuuggaaaugguuuucccugaggggcauauaccaauuuaaaaaaagaaagcuaagaaacuaacaaacugaggaacacuuuaaaaguauucaaugguuaggugguaauaaaacugggguccagggcuugccaaaugagggugggacugagacaacaagaaaauccccaaaugagcauaaaugaagucaugggucaaagaaaaucaccagagaaaugaaaaguacuuugaauaggaugauaauaaaaauacuccauaucaaaauuucacaaguuuugaaaguagaugggaugcagcuaaauuguauugaaggaaacugauagccugcaauguauaagaaaaguauucugaguuacucaucaauuuaaagaaguugaaaaaaaucagcaaguuaaaugugaacaaguacaaggaagaaaauaauuaagagcaaaaauuaacaaaauagauaagaaaugcaauuaaaagguugaucugacagaaguuugguucuuuaaaaagaccaaaauaagcuguugaaacuuacaaggaaaauaagugaagacacaaaaauguaacaggaauuuuaaaaguacauuguuacagauguuacagauaauagaaggauaacuuauguacaaauuuaugccaauaaauuugaaaauuaagaugauauggacaaguuccuaaaaaaguuccuccccaaagaaauagaaaauuugaaugguuuuguaacuaucaaagauuucaaauccggaauuaaaaccuacgcaccacaaaauguaaggccaguggucuuacuaacaaaaucuaccaaauauaugagggaguaauuaauuuuaauuguacacaaauucuucaugaaguuagaaaaaagcaagacacuauucaauccauuuuauaaagaaagcacaacuuugauaacaaaaccugacaaaguuauuccaauaaaaggcaauuauaggccaaucuuucacaugauuguagauucaaaagguaaauaaauuagcaaacggagaacugcauaaauaaacagauaggguuuauuauaggacagcaagauugguuuggcauucaaaaaucaaucauuguaauucgcuacuuuaggaccaaaagagaaaaauuauaugaucuuggcagaugaagaaaagguacagauaaaguucaacauccagucuuagaaaaacaaaaccaaaacaaaccuagaaauaaccagcaaauuggaaacuuuaaaaaguguucauuauuuuuauaaagaguacuuuaagaaaaucuauaucaaguaucauacauacuaauaaaauaaaaauuuuugacugucuuaaaggacacaaauugcuaacauuucuauucagcauugaauuggaguugugcuagacucuguaguccaagaaaaaaaaucagaaaaaaguauuuaggaauuggaaagaaugaaacaaaaguuacggauuagugaugauaugaauauguauguagaaaaucuaagagaacaaaggauaaauuacuaaaauuaauaaauuaguuaucagcuugcuauguuacagaaucaguguucaaaaaaagauuuuauuuauauauaacagcaacacugacaacauagaauuaaaaaacauaucauuugcaauagcauuaaaugaucaaauaacuaggaacaaacucauuuaaagauaugagagaccucuacaugaaaaacuauaaaacuauuuuugaguaaaauaaaggaagauucaauaaaugaagauauagcauguucauugauugagagacuuaauacuguaaagauauaaguucuccucaaauugaucuauagauucagucagugaauucccaauuaaaaaucccagguuguguguaugugugugugcacaaguaaaugugcuugaagcugaauguaaaguuuauaugaaguugcaaaaguacaaaaauugccaagauacucuucaggaagaagaaaaaaacuggcucuugaugacuauagauuaauauaguaauuaagacaguugguuaguuguacaaggauaaaccaaauaaauaaaugaaaguuguccaugcauacauaggcacuugauuuauacccagcuggcacuaaaguauguacuauagagaaagggaggucuuuucauuaaguaguucuagguuaauuagauauauguaugaaaaauaaugaaacuugucucuuaacucauacuauacacagaaauuaauaccaugcagccuauagauauaaauauaaaagguaaacaauaaagcuucuagaaaacuauauaggagaauauauccacaaguuuggguagaaaaggauuuauuaaacacagcauaaaaugcauuaacacaaaagaaaagauugauaauuugacugcaauaauacuucauaguuaaaaagauaccauaaagagagugaaaagacaagccacaguagaagauauuuauaauacauauaccuaacaaaaaaucaucaauaaauauuaacuccuauaaaucuauaagaauaaaugagacaacaaucagaaaaauggauaggugguuucauaaaagaagauaaccaauggccaauaaauauaugaaaagguagcaaucuuauuaacuacuggggaaauacaaaauaaaaaaauaccacuccacagccaccagaaugauuaaaauaaaaagauuuacaauagcaaguguuggcaaggacaugggacuaucagaaugcuuguacccuguuguugggauugcaaauugguucagucaaucauucugauaaaugaucucugaaaacuaacguaugcauaucuuagaauacagaaauuucccccauuagguacauacccacuagaugaauguacauaccaagagacagaaauguuuguagaagcauugucauaauagucuaaacuggaaacagcccaaacauacuuugagaguagacuggauaccuccuuacauauuuuaaguuuggccucaagguuucuucaugcguagugaacugugaccuaacuggauguacaaacagacuguaaccuacucuuguaccaaucacagaguuucagccaacuauaggugaccaacuguucaaacuguguucaaauaaggcaaauguggagcuguaaucaauccagcuguuucuguacuucacuuccauuuucuguaugucacuuucuucuuucuguccauaaauauuaucuaaucuuguggcagccccccaguugcucugaaccuaucugguuugaggggcuccucaauuccugaauggcucuuugcucaauucaacucuguuaaauuucauucaucuaaaguuuuuuuuugaacacaaacaauaaaauauugcacaacaaugaaaacaagcaaaucucacuuauaaacaacaccauuaauggguuuuaugaaccuaauguuggguaaaauaauucacacuguauaauaauuguucacaagcaagcaacaugaauggcaguguugaugaucccauggaugguuaccuuugggaagagugaaaaaugauugaggaaaaggaaaugggggcugggucacugguaauguucuaucuuuuccuagguggcaauuauacagguggaccauugcugguaauucauugagcugcacaauauguuacguacuuuucuguaggcaaauaauacuucacaauuaaaaacuaaauaaaagaagaaaauaaggagagagaauagugaauuuaauaaugauauuuguuuucuuucuccuuuuuuuauccacaauuagaaaaaaaauaugcauuuucauagagucaggaugccagaagagagaauuagguaaaggacaaaauaauuaugugccaaauuaaaaaaaaaacauaaucucaccuugcuaaaaaaguauugcaaaaauuaggcugauacuucaugacacuucagagugugcaaaggucugacucugaaguuggguauuuggauuccuauagcccuugauaaguuuaaagugcucugcuaaagcaugaaaaauuuuuauuuuccaaaggaccccucuguuuuaaggaaaauccucuugaccagauuuucauuuugaugugauuguuuuaccacaugaaaaacuacauuaaccuugcuacuguauacauuagcuuacuuaaaaaaguuguuaaaaauaagcaauuucuucaggcaaguuugggaaauuugauaaauccaucugagucaggcaaaaauuuguuauucuaagucuuauucugugugaguauauaugcaucuuuguguuuccaugaaauaugaaaaagcaauuaauuguugaagagucuccaauuugguuguuugguaaauccacuucuuauagguuuaaacacucacaacauuuuuaauuuguaaucuggaauggugggauuauuuuauaaauuauaauuagaaaaaaaugggagaaaacuaauaccuuuuuuaaaaaaauaaacauuccuuuuucaagaguuggaucuuuauuggaaacagguuacuaacaaaauggcuaaaaacucauaguaaauagaaaauuuucauuauucaagcugacugaauaguucauguaagcugaucaauuaaaauguaaauaaauauuagcguguuuuacacuuacagaaucacaauguagaaaaacaaagaaagaugauauuguuggaauuuguguggaagucauugccagcauaagcauauucuacauuuaaagauaggaggagauaauguauauaucaucucugaaaugcuucauuuaugccagucaccuuuauauaaguauugcuuaaaguuuauugauagucaaauugagagauacugugaccagaucuguaaguguuuuauuuuuuugacagaagauguggggguaauaaggaagugaacaagagauacaagugcgguuuccuguuguccacaggauaauggguucacuauauugaacccauuugcaagcuaggguagauuuucuacaacaugacaugucuaucauggguauaagagauggcuuuuugugguagggagagagagcacaaaaaucacaucauguuacagugaguaaguuguuccauuuacaauuaccuuuuagaauuuauuuauuuauuuauuuauuauacuuuaaguucugggauacacgugcagaaugugcagguuuguuacauagguauacaugugcuauggugguuugcuguaaacaucaacccgucauuuagguuuuaagccccucauccauuagguauauguccuaaugcucucccuucccuugccccacaacccucgacacgccccgcugugugauguuucccuccguguccauguguucucauucuucaacucccacuuaugagugagaacaugugguguuugguuuucuguuccuguguuaguuuucugagaaugauguuuuccaguuucauccauguccuugcaaaggacaugaacucauucuuuucuaaggcugcauaguauuucaugguauaaaugugccacauuuucuuuauccagucuaucauugaugggcauuuggguugguuucaagucuuugcuauugugaauagugcugcgauaaccauauguguaugugucuuuauaguaaaaugauuuauaauccuuuggguauauacccaguaauaucaugguaagaacaaagccucagauaauaagguucugaaauuuugauuuuacuuuuacaaagaaaauucaaaucucaaacuccuuuuggcauucaauggaacuaauuuguauucaauguuucauuuacauuaaauguauuuuauaguuauuuucuauugaaugcaaugacauuccuuuuaaguugcauuagugaauauuaccauuauuaagaauaauauaaacccuucuguaaucugaauuucaagcauuccaaucuccuaugccaucuucaaucuuuugaccuuccucccuccaucaagccugcaaucccucugggaucuaagaugcacugacccugcucauuuuugcugucccucuccacccuccuagaaacacuuccuucuuaaauuuaguaauugaaacagaaccauaaaaaugagauucugagauuggauugcucccauaucucuguagcacauauugaugggaaauggaacugugacaauuuacagccugugguuacauuacaauuguuuaaauaaccaccagaguuggcauggaaugaagugcagguggaaugcaaggccauggcaauaauagugauuuugaagauuaugguuccagcuaacugcucugaagucuccgaaugaauacagagugcaaaugagaaacuuaaggccaugaaugccuagcucagaaauaagguaaaauuuuaauaucuugauggcaguuuugaagaacucucuuuauccuguaguuuuaggguagauacugcugaggacaagauuaaggcuugacuguagcacagcuuaauugcugauuaaaucuucugccauauaagauaucucaugcauugauaagaaauuugaacuuucaaauucuucugaaccuucuuguuauuggaagcaaccucucaccacuucugagggaaucagccuucuucugcacaaaugcuuuucaauaacuugacauaggaaauuucacggaucucuucuggacucaccacguuacuccuuauugacuccaugcuacaaauuaggucccaaaauaauugagucaaagaaguauaaagcccacuuauaaaaguuuacaccaaauaguaugacauuaaguaucuauuagggcaaauauauugucaugggugguaagauuucagauuugggauuuaaugugcugacuugauacuugggcagggggugguaguaauucauuagauuggcuaauuaaagaaugaaccaaaaaugcaugaaauuugaaaauaaccuauauacaaccucccuggccuacuguagagauucagggaggugggaauguuggaaugaaucuguuccaagaaacuuggucaccucucuuacaugagaaggccaaucccuacacaaagacauuaaaaaaugcauggaagggggcagaacacaaguaucucugaagaguucugugugcuucuccucugaagucucagauaacacuggggaauccugcaauaaauugcauuucuugauccaaaaugaaagcaguaucccagguaaaggcgugguguggaugacuaacuauaagagaugagguaaaauuaccacagugagucauggcuguuucucagugauaauugaaguguauuaucuucagagaacuauaguaauagcuuauugaucacagugacccuaaaaauaaaauaggugccucuauuuacauaauuuacauaauauacaaucuauuaauuacagguuauacuuuauaaaccauuaaggugcuucuugauauguauggauagaaaaauuccacaucugaaggcagaaaucuagccucaauugcugagugggaauuuggaaccucuuaucuaguucccagaacuaacccaguguauauauucagaagcccaauacugaagaaggggucaagguagcauuuuuugauauguccuuuuuuggcauuuuuaaugugauuuuucaguaguaauggucaggucaaacauacaauuuuguauccuauuuacuacaucuucaauggcugaaugauauugcucagucaguucuacuauagcuuauuuaaguauucuccuaguuuagaaaaguuggagauuuuuauucuaucacauauuacauugcuauaaacaucuucaaacauguaauguuuuaaauauuuugacuuauuuucuuuugacagaauccaugaagaaaagcuauuuugugaaugaaguuaguuuuuuauaucuuauacaaguaaagagaauuuucaagcacauuuuauaacaugauuuauugaaaaaauagugauagguaaugucauuucucuauuuuugcuauggcucauuuuaggugucaacuggauucaggaacagacaacugguaaaacguuacuucuggcuguaucagugggggcuuccagagaagacuggugugugacucaguggacugagugaggaagauucaccuucaauguagguggguaccauccaguuagcuggcggcccagauagaacaaaaaaggagagaaaaggauuucuucucucuaugucuccuggagcuaaaacacaguuuuuccccugccccuggacaucaggaucccugguuuucuggccuagggacuccaggacuuaugcuaguuccccgccccauccccacucccagguucucaggccuuuggccugggacugagaauuacaucaucagcuucccugguuuugaggcuuuucuuaguguuucagaaucucuagguugcagacagccugucaugagaauucucagccuccauaaucaugugagccaauuucucuaauaaauccccacucaaauaucuauaucuacaucucuaucuaucuauauauaggcauaccucauuuuauugaauuucacuuuauugcacuucacacauuuuuuuacaaacuuauuuuuacaaauugaggcuuugugguaaccccguguugcaaagcaccauuuuuccagcaguacaugcuuacuucaugucucuccaucagcauuuuuuagcaauaaaguauuuuuaaaaugaagguauguauauugcuuuuuagguauaaugcuauuggacacuuaaaagaauacaguauaguguaaaccuaacuuuuauaugcacuggaaaauuaaaaaaaauugugugacucacuuucuugggauauuugcuuuacugugguggcaaaaacugaaccugcaauauccucaaugcacgccucuauguauccuauugggucugucucucuugauaaucugacuaauauaauuguuauuucaguugguuuuaaaugacuaaauauuguuauggacuggcuauaggucuauuugcaaauaagcaaaagaaggcuacaagacauuagaucauguaauugaaaugaaaauuuccuguagacuucucugacuuaauauuuacaugucauaggcauuaugauacuuguaaagcuuauaaauagcaguuccuucuuuccaccacuuuuauauuauuugugcuuuucuaguuugaagaguuccauguugguugaauaaugcguuucaguuuuuaauauauuuuaauguuaacaguuaaaauauaaaauguuuauacuuaacauuaacauaauguuaauuuaauauguaguuaguuaauuuuauguuauguaguuaauuauauaauuuaauauuuuaucauauuuaaucuauuaaaauuaauagaauucuuuuauacauacaaaugccaucuauacauauuuacuuaaaauaagaauguucugagcaaauaaaaauauguuauuucaaauuagaacuuccuacagaaggagacgaucuuuauaauuuuugaaacuucagacuuaauaccagcaguuaaguuuauuuuaccagacccaauaccauaaaauauuucugaugagcagauaugaaaaaugcuaaauuaaaaauuaaaaucaaauuaaacgggugcugguuaccacacauaaaccuuacaugcugauuuuaacuuaacuuuuaagugccaauugcuauaacucauauuagaacuaaauugaauuuuauuacacaaaaacauauuacuuggcaguuucuuacuuucacaauguuuuuguuacucuagccuguauaaaauucccacuguuucuaaagagcuagggaaaaaaagagcccauugaacaucaaucacagauuucagguuuccaguuuguaaggugggcuacauuacaauuugacacaguuguauguuaaguaacaguaaaaaauacugagguaagugcugcauugaaauauaaacucucuuaagugcaauguuaagaacauaugggugaguaauacacauaauguuuaucauuaauuccccaccgcaaauugauuaacuuuccugucuccaagcauaguggcagugauagcauuuagaaacccuuucuguaaauucuaucucuaggucucauuuaauaaagccuuuuauuccuccauugcacuaauugcuuugcauucaguucuacuggacagucugaucauaguaugaaugaaaugcacuaauauccacugaaaguagcuuguuauacaagaacuuuauugggucaggcaaauaaauuuuccagaacauuaauuagcaaaguucuuuuuuaugggacugcuaaauccauuuugaauugguaaguuuacuuuuuuauagauucugaaaugacauugaaauuagaaguucuuuuaucuguuuuaagagaguguuucuaaacaagcuucuaaauaucugaaauugaauguuuuggucgaaaggcuugguaguauuuguggcuguucauugaaauuuccacuaauucauagguuugcaucucacaauauuaauggauaaucaaagcagguuuagcacaaagcagaacgggucagugcuauggcugaaugaccuuccgaacauucauacugaaauuuaacugucauugugauagucuuaacagauguaaucuuuaaggggcgauuaggcuauacaggcagaacacucaugaauagauuaauaucauuauuuuaggagcaggcucauugucacaagugcagguuuuuacaaaagugaguucagcuuucuauuguucucuggcuacuucuggaaaguucucuggcucucucacauucucuugccccucugcccuccaccaugggaugaugcagcaugaaggcccucacaagauaucagcaccuugauauuggacuucccagccuccagaacuauaaaauaaauuucauuuauuauaucaugcccacucugugauauuuucuuauagugaaacaaaauggauuaagacagccagucugccacaugucuuccuuaaauuucccauuauuuuuauaugcaacaaaaauguauuuguuuauuucuuuuucuguucucauuuccaguaucugucaaaacuaccuuuguaaauguuaaugauaaaaauaagacuauaucuucagaacauugauauaaguuucaaaaacaauggaggaauaugucccaaacacuuauugacucccagaauacuucccaucacauguauuguuucuacuacguagcauuuugucaaaaccacacacauauauuuagaaauaucuucagcuuuuguauucacgcucuuauaucuguuccauuuugauauuuuagaaguuuuguuaaaaaauaaaaaggagaaaccaaguagccucauucuuucuuuccugguuuggcuuuagauaugcuagauauuuuauaaggguguaaggcuaagauucuggaaaaaggcuuaaauguaucguaaaaagcauuuuccuaucuaauacuacaaaauuaaaacauuugaaaguuuagaaauucaauugaaaagagggaaagauauucaaacaaaucccuuaauaucuucagaaagcuuucagauaguaugauugagggauacacugcaauuuuaaaagacaauuuauauaucaucccuguguuuuucucacuuccaccauauuuaacauuucauguauuuuuuauuuauuuucuguguauuaaauuacuugauuuacacuguagguguuuuguuuucuacuuuuaacacaucauuguauaccaauugccuauuugcucaccaauaaaguaaacaaccaaccaaaagaagaacacaaugcaugguuugaauaaggaauauaguaugauucuuuacauauauacaaaugcuacuuuccagaaggucucaaaaauuauucucuuuucuuuuuauacuuuuuuuuaaccuacugauuuuaccacagaccuggcaaugaaaugagggcugggaaaggcaccgaaacaguaaauauugucuagaugacuagucguuugucaaacagcaugaagcaagacugcaguugagucagaaccugccacucuguagugauccauuagcuuuuaauguuuuaaaauaauuauagugaggccuaagccacuauauaaaaccacuauauaaauucuagugccauuagcaaccccauuuuucagagauucaaucaaucaguaguucugaggaaaauugcacccauuuugccagucccagaagcaugaaaguucaaaggguaagcagcaguugucaacaggaaucaaagugaaauggaucucaaagugaaguuuuuaauuuggaauuucugagguugguuacuaaacuaggccuuaugcauaaguaugucauuaguucuaaaaggucagagaaugccaauacauuuucaaucaguuuuaaugauaaaagagccaaaaguaagucuaaaauacauuuuuaagccuccaaaaugucauuuaaaaccagcaaccuguuaaccaccacuggagauuaguuuuaaauuaaaaugacuuuauugagcauacauuagauuuauaauuugauagagaaaaagggaaucauuuaacauuaugaaucuagucuuacaaaacaauaucagcuuuccuaauuuugaauuuucuuccguaauuuucaguuuuacagagcucuuaugcuuaaguucuuaggagaguauuuuaaagaguugaagagaaaaauugauucuauucugauuucuuuuccacauauucuuuugaauaagagauuuaaaaaugguuaaaauaauuuuuccaggaaguucuuacacuuucaacuuacagccucuggagucacugaguuagggacuugaauugaugagcaguaggaaaaucaggaaacaagguuauuguacugggcugaagcaguaaaucaaaaccauggauguaacaaagaggaaguaggcucagggaggaaggggaucagggugaaguugcaaaacaaaacaaaaaacuuauuaaacucaggucaagaucagagaguaggagguuacaaagcaaaggucaggaaacaaaauaugaaagccucuauuuguuaaguauuuacuaaggcauuaugcauuguuuuaaguguuuuagaacuguauucuuauuuaaucuucacaacaggcuuaugguaugacuagaaaagcaauauugggcuuccuaacccaaggugaauaucauagaggaguggggaaauaauacaauauaugaucacaggcuaucauagggaagggagaaaaccaggcagggagugacauaugucagagaauuuaggaagccuccuggugucuccgccuccaaguacaugcgccauuucuuccaccaaggguucugauuuauuauuuccauuucguuuucucccucuauucuccucaaugacuagaauaaauagguuuagaucaugggcuuccuacacuaaaaauuuagggcagguucaagcaaauaaauuuaaaacaaacagaauaagaguuugucuauaagacucagaaaaacuccccauuauuuugaguuggaaauaauuuacuuagaccaaguuauuuagaugauucuaaaaagcagucaacuuaaaacauaaccaauauaaugaauugaugauccuggaagauguaaagaaaauagauggaaggugauauugcaaugacaagagauucuaaugacaaguaagagaaguaauaggugaauaauucuguccucagaguuguucuaggaggcaggcugugauucuacauaucuuaacuucauguucuagugauaacucaacaaaugcauuugucguuucucuauuuuaguaguaguauauaaacuuuuaauugaaucauaagaaaauucuaagcacccaguauuggaauuauaaauuguuuuuauauuuucuuuuuuaauuacuuaggcaaauaacuuuuuauguaaucuuagauauaauagauuauaugcuagugaauagcacuuucaauguauaaauuguacaugcaaacaaaauggugaguuauauuuuugcuuuccuuuucccaaaaggcauucauucacccuacuucucugcauaaauuuauugaaaauagaaaaaaauauguauuugcugcuuuuuccaaguuucacagacuuagaaauuuuuuaugcacauauggcaauacacaagagacucuuacaauauuugaaaauucaagcugcuauucaaaaaauagacaucucggguaguuuuuaugugaagacauuaacugaggaagcaauaugaauuaguuauagccuucuugcauuacaugguauuauuuuauaccuuuauaaacaccaacaauacacauauaaagguuugagcuaaauuucaguuugccuuuugccuacguuuuuaacauuuacauuaucagcaacaaauuucaaacacuuuuguccaaaugauuuagguaauuuuuaaggugugcagaguugucauguuuuauguccaaguaguuucaacuguuugaauguacuuaagcuucuucucaauaucuagugggacacaguaauguaaagcugaauuuuacauuauuuuaauugacuauuacuuuucuaaauaaauauuuuuaaagucuauuaaaacuuaugugauuuuaauuguugaaauguucaaauaugaaguaugguacaauguuaagcugaaaguaucaagucuuagaugcauacauaucauuuaacucagaagcugcauaucuaggauaauuucuucagaaaaugaccauggaugugcacaaagauugaaccacuagaaugauuuuuuaaaauuguauaaacauauaauaaaagggaaguuggcaaagaaguuauauuuauguacacacauacaaauaauauagucuuauauagacaguaaauaauguuacaggaaaaaauaguuaaaggaaaaaauagaugucaaggauguacuaguaauuuaauuuuaauagcauuacaugcaguaugaaacuacuguugcauacauauuaauauauuuacuguuuuuugacacuccaucaggcacuaagcccugucguguggguuucugguuuauucucucuuuucuauuccuucuucuguuuuuguugugguaguggugguggcugauuuucuucagcuuugcauuacuucagcuauucuauuucaagucucauaaccuucaaaucaugcuucauacugucugcaaagagcccaguuuuaaaacauaaauuuuauugggccaguuugaugaugaaacaucuuuaaugaauaucuaucuucuguaacauaaagucgauuuucuuuguguucuaccugagcaugucugcaaucuggccccuaacauuuucucuagucuuaucuccaaccuuuguuccauucauaugcaaaaaugggauccucacacuguuuaccagcuuaaacuuugaaaugucuggaauauucuuuuuccuuauuuuuaucugauaaguuuacuuuuuaaacuccugauaaauacggagaauauccaccacauugaucauuuagcuaugugaaugaaaugcucuuguuguggcuuuaaauaaaggaacuauauauucaguaguauuucauauuuuuaauguauauggauaaagucuaaucuaacauuucuuuaauuaugguuaaaaguuauacccugagagaucaucugcugauaaaauuauaacuuuuuuuuugagauggaguuuugcucuuguugcccagguuagagugcaauggcgugaucuugguucacugcaaccuccgccuucuggguucaaugauucuccugccucagccucccuuguagcugggauuacaggcaugcgccaccaugcuuggcuaauuuuguauuuauaguagagaugggguuucuucauguuggucaggcuggucuugaacucccaaccucaggugauccgcccgccucagucucccaaagugcugggauuacaggugugagccaccgcgccuggccaaaauucuaacuucaaucagcauaaauaaaauauuaaauucaaggcuaggcaagguggcucaagccuauaauuccagcacuuugggaggccaaggcaggcggaccaccugaggucgggaguucgagaccagccugaccaacauggggaaaccccgucucuccuaaaaauacaaaaauuagcuggcgugguggugugugccuguaaucccagcuacuuuggaggcuaaggaaggagaaucacuugaacccaggaggcggagguugcagugagccgagaucacgccauugcacuccagccugggcaacaagagcaaaaacuccgucuccaaaaaaaaaaaaaaaaauugaauucaggagaagaaauaacaaugaauuaaguaaugaauaaggaauaugucuuaaacuugaaaaguauguauaaucuugagaauuguuucaagcuaaaauuuccacauuucucuguguuaaggguaaauuuucuagcaaacaaauccugauaaccaauuacacaccaaaucaaagaucaaaaguacuagaucauccgguuaggaucucuguaagcuucauuugagucuucagaccccucagaccuauuauagaauuugccccaucacuuuuguuuuugguaauuuagucaacuaaaaacugagggauaaaaacuagaaggggaguuacggaauacaauuuuugaaaugcuuaucuuaugaagagacaguuuaagaguugaaagauaauggguuuccccuccuugcagccuaucuauaagaagcagcacagccucaguuacuuucagaggaaauuaucaaaauaucaucugcacagaagcaaaagaaggaaggaaaagaguuuuaauaacaaaguuuuauccgugagguuuguuucauuuuauuucacucaugccagaugcucccauuuaaaaauuaaaucuauauuuuaauaucuuauuuauaauaucuuuauuccacuaggcuuuucucauuccuuuacuuccuuugaauucccugauuucaaauauuuuuaauuauauugcuaaaagauuuguaaaauagauuagacaaaaaugcacgucuaacaaacauuguguuacuuguuuguuuuaauaucacuaagaaugagccacauuuuacaauaucauaacagaaaagaaaauauaacaauguacuauuuuauaugaaaauggcucuuaauaagacuguuuagcuaauacuuaaaauuuaaaaauaaauugauaagaauauaucuguagauuuuuguuuuugaaaucauacacuuuugcuuacuuucugccaucugugcauuacacaauauuuguuuuuaauuuugucaauuaguguuagaaaguuuaugaaacuacauugaaaaaucagggagagaucguccccuaaaggagaaauaagauauaugugugcguauacacacacguauguaauauguuaacuuauaaacucacaacacaucacgauaauauuuauuugguauauggaauuaucuacaccugagcuauaaacuaguacaauuauuuuuaauuuucuuaguugauaagcucccucaauucaaugauagucucagguagucacagauuugaggauuaaauugcaucgcugucaagucuuggagugaaacaaguaaguauagccagcuuacaaguuugaccucugcaauuacuguucauuuucuaaguuuccuggggguaaaugcauguuaaauugccuuuuagugcugggaaugacuuuuacuuagccaaauuacucucuuuugguucaucaguuaaauauguacuguauauaauuuaguagcaagaaaguuacucauuccgacuuaaaaguguccauccuggacauuguuuguggccagauucaauaucuuacauuauuauaaaaaauguguuuguguuacuaaaguaggcuuuuauaugcuuauccuuuuuaaugaauuauucaggucaucaaauguaauuuucaacuugcuuaaccuaauuuaagucagcauuuguagaaugucacuugggucaauacaagcucagaaggaaaaauuaaaaaucaaugaacaucauagugaacauuuuaauuuucacuuuuuaaccuaauccuuuuucuguauuuggaggacugaauauuaaagacccauuuaaaaauauuuaguuuuucagaaacgucacuaaucuauacaacuauuugcaauaacuacaggggaccgguugcacuauuuccugugucaacagaagaucugaccuuguuuuccgauagcuuagagauuaagugcagcccuaauagaagaacuguacaucauuuucaaaggaagguuuucuggaggauaaugcugaguuuacagauuccuacugugguugaaccuagugucuauuuaaucuuauacuccagauggccuuuuguggccaaaugacugcaaauuuaaaaaucaagaaauguuuaaauggaaagaguuggccuugguaaggaagauuggagauagaagguuauucauuuuuuuuucugugagugaagcaaaagaaugcacugcuauuaugaauguuagcagauuuuaagaucuuuauggauaaauagaagguauauauacauuuuaaauaaauaaaaauaauaaaaauauucaauuuaauuucuuuucaggaagaauuuucuaaaaagaaagccuuauuuaauucuacucugaaaggcauuauuaguagauugauuugauguagcaaagaauuuuuuaccauauauauguauauuucuuuccaaauacauuucaaguaaacugguaaacugauuuugugaaauagcauuuauucuucccagaaagaaacuagguugauugagaagaaaaaaauaaacuaagaaugccuguacuuuugcuuucucucuguaccuucucuaccaaaagcaccagggaagauuuaucagaaaagaauggccuucuucaggagucaucaccacaaauacagcugggaaugagacguaucucuugauuuacuuguuaacauguguuccaaaauggauaaccauaugugucugaucugcagaguagaaaacauuauggcuagaucuuggaguuaaaguuuuuuaaaauguacgauggcuggguauauuuugcaaccagcauguaucuaccuaaacauguauacauuuguauaccuauaaaauauaaucaugacuccuuuagauacaaaucuacauuuuuugaaacaaauauuaaauccucaaauaugccagauguggaaaauagaauagcucuagaaaaguuugucaaugccucccauuacaauuacauauauuugucuuaauguuuguccugucacuucucugcuuaaaguacuccauaauucuccauuccucucagaguaaaugugaaagucuacaaaggucaaucucaucugaacucauggaccucucuguccucaccuccuacuaaacuaugcuuccggccucuucaagcagaaccuuugcauuuugaacuucccuauaccugaucaucuuuccuccagauaucuaucuauaaaguauauuccuuccuauccuucaggauuuuguucaacaucaaauucucaaagaggcuuacugcaacaaauugaaaauuguaacaguuccauacauacuuccaauucuccuuacucugaacuacuccuucuauagcauuugaguucugauauauguaguuuauuuauuuauuuauuuauuauggcuguuauuuguugccagucucccucuacuagaagaugagcuccaugaaggcaugaauauauguguguuuuucucaugaauacagccccaacagcuugaauagugccuggcacauuacauacacuaacuguugaaugaucuuuaauuuagacccaaaaugcuugguucuaagauagguaagacaugcuuaaucugaaaaaaaugcuuuucucaauuuaugaaacuguacauaaaauuuguucaaaugacugaagggauauguaucacagaggaauucagacauauauuuuggggcucuuauauauuauuaagaugucuaaugaguuuagaagaaaugaugcaauaugauucuauaaguacaaacuuguuuucucagcagaauaaacuggucuucuggaaagguaacaaagacauuucacuuauuucaaaacauguuaugaugaugcagguaugacaaguuuaacacuuccuuuguuuaagauagcauuaaauaaaggaaguuuguuuccaauguaaaaauuaguguaguuaauuaagagaaaaugucaauagaacuuaacauugucauaggauaaugguuccugcugcuagcuauaugucaagagaaagauaaauaagauggagugauuuauuaagcagugccacacugcaggcaaugcauuucuagaggauuauagcacuccuuggguggugauguaaggcagaggacuaaaggcuaaguggccuuaacccuuuaaucaguacaacaauagcacagaagcgugguacuuguagacagucccugcugauauagcaaaaugacuuuuauauuuagaagagacuauaaugauaucaaagaggaucuaaguuagaagagaaugccaucaacaauuccuuauagcuuuguagauaauuaugugaagaagucauacuauuucaaaauuuaaaagccaacaaaguuugaaucaccuuuauauaaaauacagacuucuuaaaaauuacuuuaggcaaaaauugguugcugauuuaggaacuuggucauuguucucagcaaaaucgguauuaaaacaguauuuggaaaaaacaucuaaagauaauuuuccuuuucaauaauuuuaauaguauaaauuauuuucagauuguuuauauuaaauaaugucaaagaugguuuaaauccagaaccaacuuuugcaaucuggcauggcauguucuucacuucaaacugaacucagaauacuaucaugaacuuugauuuucucagaucaaagaaacaaauuucacugguuacugagaauuuguuuucagauccggcaugguauauuuuaguguugcaauaacauaaaauagugggaauagauacuuagcaagauucuuuauaucuuucuuacauguuaaauuguauuucauagguauuuacaauauguauuacauuuaaguuuacaaugaaaccagaguucaguaauucuguuaagcuuaaaggcuuucuuucaaucuauauuuaacauagguuauguuucuauauaauugacaagacugcuuucaguuucauuaacauauuaaacuaucaaauaguuauuaacauguuuuaaaauuauaaaacauuuuaguuuuuaguauugauacugagguaggaggugggauucaauuccagaggcagggcucagacagugaaccagauuaggcacuggcuaaaacagggccggggcagaagcagcuugucaucagacaugcccaccagccugucaagucaauuuaccacugccauggcaacacucgggaguuacugccccuuuccaugguaaugacccaaugauccaaaaguuacuaccccuucccuagaaauuucugcauaaacugcccccuaaucugcaugcaguuaaaaguggguuauaaauaugacugcaaaacugcccugagcugcuacucuuugcccauaggguagcccugcucuacaggggcagucauggagcuguaacaacacugccucuucaauaaagcuguuuucuucuaccucugucuugcccuugaauucuucccugagcaaagccaagaacccagcaggcuaagcuccacuucggggcuugccugcccugcaucaauacuaugagaauaucaaaauaaaaaaugaaauuucagcaucaucaucaucauuuuagcuggaaaaagcccauaugguuucagacugccaucaguggcaguuugugaacauugcuuaguuuagaaacuagccuuccuguaauguuuauacuuaauauugugcuauuuuaguugcagaucucgagauauaauucccaaaacaaaacccuaaguguacuguuuuuauaggacauuaauccccccaaaaccuaagucuuuaugagccccaaagaauuuacuauauaaauugcaaacaucuugaaucacaacuuauaauuccacucaauuuggguucauuaauuuguuguauuccuggcuauagucuauuauaaaaacauguaguaaugacaugcuuaaauagggaaaaauguuuuuguaguuuuucauauuuacuugaaugacauaaaguuauugugaguuuauuagcauauggcuuuuacuauaaacauuuucauuagcuaaacaaguuuuccuaauauauuuccuuaugcuugauuacacuaugcuuuuuuaaacuaaugcuuauuuucuggaaguuaaugaugaauauugaaggauuaaacaauauggcugauucuaucucuugccguggccuuuggaaacagugaggaaaaaauaacuauaauguucugugccgacuuugugucaugaauacaguucuaauaguuuuauauccaugaguucuuuuaauuuucucaaacaccugaugaagucaguaauuauuaucuggugaacugagucaccuagagguuaaaaaacuugucaaaugucacauagcuaguaagugguaaaaaacaggauuguaaacugagcugucucuuaaggaaacacaaagacaugaaaagaguaguuuaguuagauauuuauguuacugaaucuuacauuuuuauagauaaaagaaaauuuuaaauaaucugacacucuauugaagcaaagaucaagugaguuauuugaacaauuucuuucuuccuuugugacuagguaaaaaauuggcucauggucuguguuccucucuuucaguaucacaacuuaguauguauuugacccaguugcaguacgcuaaauagcaggauaucugugaauuccauguucguggugucuuguguuuccucagcaugacaauugugauucuaugauggagcugcaugcuuccuaguuugugucacuuguguauucuaagcuccaugaaaacagccaucaugcugucuuauucaccucugugacuaguuaaauaauucuuguuuaauauccaaguugguguuuacuagagaaugaagaauuuaaaauaguaaaggcagaagauauacuuuuaggacaugcuaaaguagagcuuaaacaacggauauaaacacuaacugcuagaaaacaacugaagcagauagaauacacugugcagcaaucccaaauggauuguuaauuuggagucuaagauaaagagcuguaaauauaaagagacucuauaaauuuugggcacagucaaaaucaaagaacaauuuuaugugucuacagugcauuggugggucaugcauuuaucuuuuguuaaauuuugacacaaaaaagaaaaaaauugccauaaaaauguaguucacuagugacauugauauauauaaugagauacauaauguguauuuauacuucucuauuaaacauugaauuuuucugccuuauaaaugugaaaaacaaucaaguaaagcuuguaccacuuucaaggguauuuaacaaaaugucacaaggacuuuaugaccaacaauuuuuuuaaaguugaagauggggauuuuaaauacaguauuauguccaugauaauuggguuuuaaggaugcauucuagagcuaggcuaaaugcuaacagucuuaauuuucaaaacauguugacuuuguuuuugaaggcucuggucaguuucccaugcuuuaaaaaauauagccaucauuauuaaaccucuaauuacauauucauagacaaagggggaaauggauucagguuugggcaugucaaacagaaauugaauuuucaaauuuauauucuaaauaauuuaaaugauguucucuaccaccaccugcuuucccuugagcccaauacuuuaacuuagaccaauccuaaaucagcuuuaggauaaguuuauguugaggauguuuguucccauuuuuacuacuuaagcugaaaaaauuguaauaugguacuguaaaaacacugaguucuacucagauuucagacaauacuauuuuaaagaaucuauagcaccugcuuguuuuuguuuuuguuuuugagauggagucuugcugugucgcccaggcuggagugcaguggcacaaucucggcucacugcaagcuccaccucccagguucacgccauucuccugccucagccucccgaguagcugggacuacaggugcccgccaccacgccuggcuaauuuuuuguauuuuuaguagagacaggguuucaccauguuagccaggauggucucgaucuccugaccuccugauccacccaccuuggccucccaaaaugcugggauuacaggcgugagccaccgcgcccagccagcaccugcuuguucuaucauuuaaauuuagauuuaaaaauauuuucucaaaaucacccuucaauuuuuuagugucucuuaggaaacagcuucuuucuuuuguuaaauacuaaaauaguaauuuuaauuauggaacauauucacagguaguucaaaggagucaaagaagauguugauuguacuaguucuuguuuuauaaguagaaauaugauuucugccucauguucuuugauuucuuuuaacucuucaaaagcccaguugagcaugagaaagaauuuucugacucacgucaugaggagucgguaucaagcuaaauaauuuucagggccauauaguaugcauauaguucauagcauaauugcuuaggaguucaucacaguucauuaggaauguaaaccaaugcauucacagcuuaaaaucauggcacuguuuucuaguacacaaauuacuccucacuauugguagaauuugaacauucacuuucagcaugaaaguucaacuuuuuuuuuauuaguugugaagaauugugcgauaaaaagaaagaaaaugggcaccucgucauguuuuaaaucagcauggggcaauucucaaguggaugugacagcacucagaaugcauuuuggucccuuuguuaaggacugccaaucauaauuaacaacaacagagauguuguuugagccuaaauaaaaauuauggagagcuguuuuaauuuaauaccuguaagaacacaauguagaaaaaaaccugucuuuguagucgaguuaaccugucauggggaauuacucucauuuuuccucuguucacuagggucaguaaacaacagagcuagucaaugucauuuuuauuauauucaaauugaaugugaaauauuagguaacaauauaaagaaauggcuuuagcuacugcauuccaaggcuugaauccuuugagaguuuguaaauaggacauugguaaguuucauauauuugauaucuacacuauuaaaauugaugucuuuuugaguuauccuucugugcaaaguuuuaaagagauggucucccaucaacaaucucuucuguugccuaauucaauagaaaagaaugucugacucuucuuuuuguggauaugagaaaguuggauucuguauaauagugugauccaucugacaguaggaagaacucuuuauuuucuuccaaaaauugucuugggauuucaaaaucaguggguugucucuuauguuaacucuugugcaacagcaucaaauuauuuucaguauuucuaacacuccuaaaggcacacuuucuauucaucauuagcaucuguggagcuauuugaucuuuaagaaaacuaccaaaggaauuuuccuucuuuauucuuuucaauaauucuggcugcuccucucaucagaaaugguuuauuuugaucucaauuugguuaagauccaucggcgugauguugaacacuccugcaagaacuguuuuucuuauuuagcaucauacucaaagcacauaggccaggcauggcacauaguauacucgugaaauauuuauuaaacccuaguuaagaguuauuccuuauuuuccuuuugcuacucauguuccuggcacauuguuggugcuuaauaaaugcuugcugcuaaauaaacauauaugugguugcuucaaauauuuuacaugacuauaaauauuucuauuucccauaaucagacacaaacaucugaagauaauucugaaauuucccuuugcauguaaacagaaagcaaauuacauacaacuacauuugcaaagucauugaaguccucuggagaccagaugauagagucacugccaauaaacuaaacauaagagacuucuaaaaaucaaauccaguuucacuuaagaauauuaauugaaaggagauguauguagacauggagauaacggaggacauaaaaugacaacaaaaguuguauaaaauuggucucucauucgugcauuuuacaaccuaauucacaagcucuuaauguuccagccaaacagauguacugaguuuaucucuauaauggaccauacugcuuuugcacaguuggauucccugagcuauuuuuccagaaugcuuugaaguuacagauuuuuuaaaaugucaggauuaguaaacaacucacauauauuuaacauuuuucugcuuuuggcuguccgugaacucuuuuuuuagaaaucugucugauaacacaugaaaugccucuuuaucccuauucaaucugguauaguggcucaaugaagacugcaauucugaaauaacagcuguacuuccucuuaaaagacuguauuuuuauuggaaauaucaccaguuccaagucaauugccuauacauggacacugucauugauuuauucucuuuuucauaggguuuauaagccuuuucuucauuuauuuuuaaucagagcauaaagaugcucucagugucuuuuaaugaauucaccuuuucauuguuagcaaguggaagaauagcagcuuuucaaagaugaaguagcuaaucauaugcgauucagcauuaucugucauuauaaauuuguauaaauguacaaucaaccugcaggcugugcaacucauuuaagggagcagugggauagaaagguauuuaacauauuuauaacuuuuguuaucuguugcauguuuauagaacuagaaaagcaugcuaaccauauggguaauucuauuuaucuuuuuuccugggugugcuccaaaacuuauugaaauuuggucacuuggaggaagaauucagaaagccaauucauaaguaugucaacgucuucacaaaugaggcuucaaccaagaggaugccuuacuuauaaacuccucuuaguuucuuacaacaacucaguggggacauuacagauaaauuucuuuuugguuuagugaguuuuaagucauuuguggauaauuuuaguguuuuauuugagacuauaaucuaauaaacaaaauauugcagcuaaccuccaugcuuuauuuaguuaaguauuuagcauccauucauuaaauuuaucaauaugaauuuauuaaaugccuaacauguacaaggcacuuaacuauaagcaaagagacuacacagauuaaauaguacacuaucuuauauucaaaggacucagguggagacauguuuaaaaaaaggaauuacacuaugguugguaaguacuaugacaaauacauguugaggaguauagaagaugguucucaaucccaggaaagacuucuugaaaguagagaaauaaaagcaaaaaauuagaggaugaauaggaacuugcuguauaaagacagagagugggaguagagucuaaucagguugguaacaaaggcacucaaggaauuggaaagagcagauacaaaggugaagaguuaggaaagagucuugucuuauggucaaaccguaaguuuggaguaacugggcaauuaaaugugaggcacgaaugguaagagaugagaacugaguguuggacaggagccaggugauggaauauuguuuaugcucugaagaacucagacuucuaaacugugggcauugggaagccaagaaaauaacugaagaaugggaauuauguguuuaucuuuccauggcauggauaacuuggguauauaugcaaguaugugaaucguauauuugcaggagacaacacuggaagaagaaagacuuaugagacuccuauaguucaggugaaaaaugagguagccucaaucuaggugacaaucuaggcuaaucuuucuagauaagaagagauuuccacuucuagaaauauuuaguagguaaaauugacaggacuugauuaugguuggauauacaagaugagaaagaggaagaaaugaaaacuauuuucagaguuucuaacaugagucugaaugguuggugguggaucagcuggaauagagaaugugagaggcuaagaagguucaaauucuaaaaugaauuacauuuuuggcauguucaaauuuauggugccucugguauagucagagaguugccuagguaacaguugaauauacaaaucugaaguucaagaauagaugauguagaucugggagucaucagcauauuggcaguuguugaaaucauacacugaaaaacugaauaaauuggaagaaguaagaugaaaacagagguuaauuauaucuagguaugucaccuccuauuucuggucaaugcucauaucuaucaacauccuugucauccuuccuuauuuauucacaacuuugacacauggcucaauuucuuuuucuccagucuaauccaagccaucauuacagcuggcucaccuaacccuuuaucucucaguuccuugaucagcuuugaaguccuucaccaaaucuuaacaucuggaauuuguauccacauaccuacaacauguucuccucuauuacauuucaaaaaaaauuaggcuuagauguccuauuuuauaaauacagacuccaaacucauuuauaauuauguuuucacucuuuuucuguaaucuuauugagaccucuacuacucucuccuaacuacucuaucuuuuuuuuuuuuuuuuuuuuuuuuuuugagauggaguuucacucuugucaucccggcuggagugcaauggcacaaucucggcucacugcaaccucccgcuccuggguucaagcaauucuccagccucagccuccugaguagcugggauuacaggcgcccaccaccaugccuggcauuuuuuuguauuuuuagcagagaugguguuucaccauguuggccgggcuggucucgaacuccugaccucaggugauccgccugccucggccucccaaagugcuggcaugugccaccaugccaggccuacucuaucaauuucuacccuuacucuucuuuacauucgcauucuugguccuucucuuucuaguucuccauauaccccaugaucuacuauuucaaucaauaucuacaucaaaaugaucuacaaucauuugucuuguuaucccuuuuuuuacauaugucaauuaucugccgcugagucuaauucauuguuuuauuuauuuaguaaacacuuaugugacacuuauauaaguuauaucuaagaacuucacaauuuuaaccauucauuaauaaauucucauaaaaacccaugagguggguacauccaggauguucucugcaagaggaauucacaccaucacacaaguuuaugacucccaaccuggaacauaaaauucuuuaauugggauguucucuguggagaaagcaacuaccaugcugugagaaagucaaacuaucccaugcaaagugaccucauggagaggcccaaauggagaaaaagcugaggccacuagcccacagaccgcaucaaccaccagacaugugagugaaaugaacaagccuuuggaugauuuuagccucuggccucugaauugucuagcugaaaccucagacaucauagggcaaagacaagccuuuuuugcuucaauaauaaauuuauuguuaaauccaacaaaaaccuuucaagccuuaauuucauuugauucuuugaaagguuuaacacagucaaccaaacguauacuacuagcugcucugauuuucacuugugcauuuauagucacuccuuaucaggcaccacugagugcuccucuauccauuccuuuccuuagagcucuguccuaggcuuuguaugggccagugguccucaaucaggaguuugcaauuaagagcaacuacucugugugaucucauuaacucccaugucuucaaaauuuccuacauuccaauaucuccuaaauauauauuaaguccagaugucucuucugugcaucugacaaauauaucaaaccacuaagcacacauuaguaauacucuuuuggauguuucacggauagcucaaacucaaugugcagcagaaugaauguaucaucucuccugucauaucuguuuuuucuguuuuauuuuuucaguaaaugagauccacauccaauauacauaauuuucuauucaaaaaccuaggauaaaacuuuaucuccuuuuuucuucaguacugacccccacaccacgcuauagguaaucaaagccuguugauuccauuucaucaauacucuccucuugacucccaaagcuaccuuaccuuugagcaagccacaucaacucuuugcucaguuauuguaauagucuucuaauuugucugacuuuucacauugccuuuuuucaaucuauucuccacauuauaaccagaauauuucuagaguaaaauuugaaucuguauuuucccauuuauuaucuuuaaauaucugaucauuucaaggaucaguucaaacuccuuauaauaacaaauguagcuucagccucaucuuuacuagauccucucugcuuggacuaucuuaauuucucucucacuucuuggucugaaauuccauccuaaccguuuaugucuccuuuucuccauucaucuuccucaagaagcacuuuccauaguuaacucugucucucuguauaaaguguuacuuuaaaaagccuucucugcgacauuaacauauauuaagugcuucuacaccuaugaucuccuaacagucuaugcuuauccuaccacagaacuuucuacccacaauuguaauccuguguuuacauguuugugucucauuagacuucuguuguggcgcaaugauggcaaagaccuucuugcucaccaucauacacuaauugcuuaggaaaguucuacuuagauaguguggauuaaauauuuacugaauuaauuauuaaugaaagaacuaaaagugucugugaaaaauauacaguaacagguaagcuuagagcccuggauauggaaggguggagggaaaagcaugcuuacaaaagguuuaagggcuagauuagaaguuagcaagucagaugaagguucuagacuaaucuuugauuaaauuagaauagaaaaaugaaguuaaauggaagguccaagagaaaauaggaauaaaaagaaagauguuauugagaguuguaaauauuagcacaaaaguauaaugucuccauuguagcaaacauccuccucuucaauauauguguagagcuugcaagagacuaucaauuuucuuacuauuucauucucuaugaggcaauagucucaaguaaggaaugcaauaaauauuauucuauuuugaaacagugagagccaaauaauuaauuggacaaguuuaaagaguugggcagauuggauauuaaauaacagagcaaugacauucuuuagaaaauagugaaauuguaaguuaaaucaccaguaaagauuacauaucaaaguaaaagauaaaacacaaaauuucucaucagucucaaauuaaccaaagucuuuucaaugacaauauuuuuaaugcaugaaauaaugucucugaacaaagaacaaguccuaacauuucuuacauauguaaauaauuaaauaguaccuucucugguaauaaguaauuucauccuuauaaggcuauuucucagaaagucagaguuuggagaggaaaaucugaucuugauguuuucugugagcuuuaccuuugacauucacauuugccuuuguugaugaaauuaaacuuacaucaaaagacaaugaaccauuauugcuggaaacuuggugugucugagauccacuaggaggaaguagcaaauguucuuuucugagcauuucugugaguacccuuuagaacacuuauugaugucagauacagaaccuuauuaacugaauacauggcuuuggaaacaucacauucuauuuuuuuuaaauacuagaauguacuuuugcuccuuaccuuguuguacaaaagauccauacacaaaccacauggaguuguagagaguaguagacgucauugaucccauuuguaaucgugggggauuaagccaguucaagagguagaccaguagacccaccagaaggacugugccagcaaugcaagcccauagagagagaucaaauggugcaagacaggcaaacauauccacugucuuuucagcccuucgaaguaguacccccacugaguaguccauguaacgugucguaaaguccaccacauuuucacgaucuggagugaugguuaaagcagaaaucccuaugucggcucucugagaaauugaaagagaaaggaauacauuaacagugugaaaaacaauuucauuugugccacuucagcuugccucgaggaaaaaaaaauagaugccucaggcaauauaaaucuuuuuauauaaacugaaacacugcauagacuucuuacagaagagcuaugugugaauuuugcauuucuuacugaaaaucuugccccaccagagucagacaaauuaccuuguucauauuaucagcauauguaaaaucagugaagaauauuucagacacagauaacacagggagaaaauugucuuuuuucgugggucauuuuaucaaagcaaucauuaacaguaaaggaaaagcuuauaauggagaaucuuuucuaggaacauguucccaagauauucaauauguucuuaacauguaaauuacuaggugggcuauuuagaaacuucaacauggcauuuuaccauugguuuauauuucucuucacagaaauuuauauuauugggcucuaaacagauuuguuagaguuuuuauagcacuaaggugucauaugccuaaggucacuacuaugauuguauuguauaaacuucagaaauauuuuaaugaaaaaguaaugauuaaggaaagagaauucuucuuggaguaauaaucccuuucuaaugugucuucuuagauucucagugauagcacucuuaacuacagcauuuacuauuuauuuaaaauguaacagaaucucaguaaaccagaggguagaugacuucacauuuaaacugcauaauaugauaauacauauuuaaauaucuaaaagaugugucuuuuuugaaauaaugaucuucagcugugauuaaagcugcaggaugacccuuccagacaaacaaaaacacuaguaaauuauuuuuugaacauuuucuuguauuuucuuuuuaauuguuucaggaaagaagauaaaacuuguguuuauagcuuuugggaacaaaaacaaagaaagauaugaaaaguaacaucccuaguagaaugcuaaaccaacuuggaugaaucuagucucaaacuaauaaugcuuuuaaaaauauucuagcuaaaguuaagcaguguggguacguguuuguaugucuguguguaccgaguucauauaucuuuguugcuaggcccugugcuaaguauuuaaguauuuuuuuuuacuuaguccuuacaaugaacuaugaauuauguguuuuccucuccauuucguaaguggagaaacuaaaccuuagaaguuuaaguaacuuguucagaucucaguuaguaaguacagaaguuagauauuaaagcuauguuuuacuuauuccgaaggcugugcucauaaucauuuuaccauauugcagcuaucauucauuuuccaaaugaaccauauaguaggcacucaggguaauugguucuaggaaauuuuuuauauuaaaacagugugaaauuuugcuguuuaaacuguacuauuuacauuauaacaagaccauauuaguauacguaccauggaucuacaauuauuaacugaaugguauuaaacuuaauaacgcuauaugaaaaugaacuugcagaaaaauauugcuuucaaacucauauauguauuuaauuuuuauagcaagauauugggaauugggucuuuucagauggaaaaucuaaccuggauguuuaacucccuugucccgucuuuucugagcuuuaguuuaaucuauuugugaaaugaauguaacuguucaguuucauuauugugagcugacucauuuaucuugauuuuaaugaugaauaaauaacuaagauucaauuaggugcucagaagaugcauuuacuuuuucaggccauuaaaguacuauggaucaguaauuuacuaauugaucacuagugacccaaaacauuuaaugacucaaccaaagucagaaaauuccaccugaggaggaauuuacugacaacauguugauaauauuuauaaaauguucacaaauauuuuucuaauaaauaauuauauguuuuacuuuuaaaugauuauaaauuggaaugguuacugauuuuaauaauggauaccuuuaaauaucacgaagugaauuuuuaaaauagaauaaaaauagcuaaaguuuuuuauuuaggaaaagggagcugauuauuuguaugugcuacacuauuuauuaaauuuaacaauuacuugucauauaucuauaaacaaauuccuaaauucuggucuauuuucaacauuuggcuauucuauuuucaaggagaaauuucuagccucccugugggaggcauaucagaaucauauaaugaacuuuuucuaacaaauacacacacucucucucucucucucucucucucucucucucucucucucucuuucccaucucugaguuuuguauagucuuccuaaagaggugcuucacuccauccuucagaaucaaugauacagcagaacacuguaauggauaaugaguaugugguaguccuuacuuauauuagaggugcugcacugaagcaaaauuuaaaaaaaggccaagcaaggacagaaaaccaaacaccgcauguucucacucauaggugggaauugaacaaugagaacacauggacacaggaaggcgaacaucacacaccggggccuguugugggguggggggagggggagggauagcauuuggagauauaucuaauguuaaaugacgaguuacugggugcagcacaccaacauggcacauguauacauauguaacuaaccugcacauugugcacauguacccuaaaacuuaaaguauaauaaaaaaaaaaaggccaaggaccacuaauucagaaagacaguucuaaaacuuccuaaauaucaauaaacaacauaaccagaaauaaucaaagacaauuauuuauucuuacccuucuuagguuuuuauuuauuuggucaacucacuuguccacuuuuuacaacgacuugucacaucuuuaauccuacuguuauuauauagagaacauagaagaugggagauuaaaaaucauacuuauuucuguguuccaaccuauagcccauacccagucuacucuauuuaucugcuuccacaauacaggagcuguccccuuuccuaaggcuaaccuuccaucauuaaauguaucaaucucucucuauuucagauacuuaaguuccugucucaugcauucaacaucauccuauuaacuagauuucccauuaaaagauucuuuguuucuuguuaaaaugaaaucaaagagauugagcccuucccucuacucucugguuacuccacauuaccacauuuucucuccauuuuuauauaucccagucacucugagaaaacucuuuuuccccauauuguuggauacccuauuccucauggaaaaaguacuucuuaauuauuguauuguugaacguaguggauauacuucaaagcucaucuaaucaggucucuugacauuuagcauugaugauuucucccuccaucacaaacacaacuuucccuugaauuucaugacauaacauacaccucuuucucaguuccuuuuucaagcucauguuagcaguucucuggacuugggccuacauccuuuucucauuugagcucuucugccuaggcaauuccaucuguguucauuacugcuauuguccccaucuacacacaauuuacaaauguauuauuucuagauguguaucugagcucugggaucuagacugauuuauucaacuacauaauugacauuucuacuaaaugacuuaaaaauaccucaaauuuaacauuuaacauggccaacaucauacuuaugauauucaaccaguccucuuccaacaucucuugcuuuaauggugucuuuuuauauaagucauaaaacuuguuagcuucauuaucuucuccagccuaugcccccuaucaaaucuaucauuauugauuuuaccuccugagcauccuaauauccauucauuucuuuacuauuuccagcuuucauuguuuuccuaggcuccagcuccuuguaagacuaccugaaaucuaccuuucuuccucuucagucucccuauuguagccaaaguagucuuucuauagagcaaaucugauccugucuccugccacacuuuaaaaauuuucaaugaauuugcauggcucuuaggagaaagauuaaaaacauggucuacacaccuuuacguaggcuauccccaaccugcuucaacauauucauacuguaccauuuucccuuccagcaguucuuccugaugcauggucuuuguacaugcuguucccacagucuggauugacccuccugaaacuucaaguaaacacucauuuauaucuauaugucagcuugauuuucauuuucacagggaagcuauccacuaucucuuugauuggaacaauaauuuguuuacacuaucagaaguuuacauuccucacuuuccuagccacuaugacagcugcaaucuuacauauguuuauaugaucuuuucaauaauguuugacuccuccacuaggccauaagcuccaugaaagcaaggauugugacuuuuaaaaaaauuacauaucacauuuucuggcauagaauucauggucaauaaauacuugcuaugaauauaugaauaaauaaagauggagccccuacuaaacuuauauuaccuaauuauuauaaaucucuuccaucuuuuugucugcauucccaacagagagagguauuuaaauaauaaaaagaaaauggcaauaugaaaauugacuguuuuauagcaaugauaaaagauuaauauccugaauaauuaugucaauaauuaaaguaagguucuugauuuaucaguauauuuacacuuacauuauuugcaaauagcuaagauaauuaggcaucuacuauagaaaauucaauauauuacaaaauauuauaugucaaauauuuauuguaaaaugauuauuuaaauuuugauuaggacuagcacuaaaacuggaauauaaauacauuuuuaaaauuauuuuaauuauauagucauaauauuuuccuugagagaagauacaagauuugcauucucucaagucaugaaaaggauauggauggaugauacaauggagcaugacuaauaagcaauauaaucacugaaucuuagaagcuuagacaaauugaaauacauuuacucuaaauuuaaucuaaaauaaaugauuauauguaacaacuaaagaucuaauuuauucuugaauauaaugcuaagaacauuauauugguaagauuaauaguaugcauuuaguuagugcuuacuauauaccaaguaucauguguuuuacaugcauuauuuuaacauuacaccaaguccaguugcuuuuucuaagaugaaaauuuugcauuugaaauauucuaauuauuauaaaacuuugauuuuauaaugaaucaauaccugcuucccuguacucuuuauuagauguuuuaguuuugucauccauacauuauguuaucaaucuaaauagaucugcccuaugacaagcuuucaaacuuuuuccaaagauaugauuuucugucccucaaaauacuugucauucuccugugaacacagucuaaauaaucaguuuccucaauugauauaaauuauacacuuuuuaaauaaaauuggaggcuguaucauuuuuauuaggugauuuuuaauacugccuuaugcuaaauuuaaggucaaauaaaauuuuaaaaauauuuuuaaaauaaacacuaucaaacuaguagcccacaaagucuuaugcaauugaagcaaauguuagauuuuauauuugucucuuuaauuucauucuuugguucuuuuguauuuuucacaucuacuguaaucuauacuucucauucauuaugucaacuuuauuuuaccauguuugagccauucagaaguugaggagcaagccuuuaauucuucauucacauuacuaguaaaguauugaugaaacauacauuggcaaguucaaaguauggcaauaugccucuaaaguucuaugcacuuugaugauagcucacuaguuaaaacuuuagauauagcuuuucaaucaccuauaaauauuccuuacuacacugccaucaagccacguuugucuauaggguuuaaagugcuuuguaaaaggcauuauugaacucaaaauacauauuuaaucagauauucauuugauccugaauagcuaaugcuaucaaaaacaugaacugcuauuuuaaucaucuaaaacacaucugauuaauaauccauucuguaauuuaaucugagaauaaaaucaaacucacugcucuaucagaaugaaaauuuuauuucugauuuugaauaugacaauuccaaacuaaauaucaccucuguuuuucauguuuuguacauauugcuuguaguaauucacguaucacuucaggaaaugcuuucauuucaacuuuaaauauuuucuacagaaagcagaaggaaaauaguuacugaagaguuuuggcacacauuucacaaguacuaggucuacuucugccuaucuaacuuacuaaacuguuuccuucucuugcuguucaagagaauaaauuuuuguaaauauuugaaauuucuugauaguuuucuuaaauauuauuugauuuuauuuggcuuuuaaauaauauuacaauguaaagauuccagguuugcuugggagaaaguaaggauugaagaaaugcuaaaggaaggaagaaaggguggaaaaaaaagggaaggaggaaaaauaggagggagauggagaagaaggaaggaaagaagaaaagaaggaagggaaagggaaggggaaggggaagggaaggggaagggaagggaagggaaggggaagggaagggaaggggaagggaaggggaagggaaggggaagggaagggaagggaagggaagggaagggaagggaagggaagggaagggaagggaagggaagggaaggggagggccaagacuacuaauuacgccuuuaaguauccuuuacagauucugauauauaguauuuuuauuaccacuaauuuuaaagauaauuuuuguuucuuuuucucuuuucuacaguuguuuaacaugaugauuucuuaauuucaggugaaaagccuucucuuacuguucuucuaaauuucuaguuuuauuguauuuugaugagggaacacuauuuguaauaaaguacuuaaauggaacuuaauaguguuuucuuugaggccaaucaauauaugauugacuuuugucaauguuccauguaugcuugagaaaauggcauauuaugaggguguaguguuugauccauaucccaaaaauguaucuuauuuaaucuauucuuuauguuauuuauuauuguguagauuuuguuauauuuacuguguuuuucuauguagcauguuuucuuugguagguuuuucuuuuacuaucuagaaagauuugcacuuuuauuauaguuuuuaaccucaauauuuaaaaauuuuauuaugcuuuuacuccuuuuuuuccaguuaacguuuugaaaauuuuaaauaaaaucuguuacuuccacuuauucccuaaagugcauuacgauauccuauuuuccccuacuuuccccuuuuccuuugauuuuuuaauaccauucuuucauuuuuagaacacaugaugauuucauauuauuaucuaauccaugucuccaacuuugcuuacuauuagauauuuugccaaagauucuccuguuaucuuuugguugaaugaagcucauucuguaauaaacccuguuugguaauacuuuacuauguucuaauaugcugacggauuaaauaugaaaggacauuuaagauuuuuggauauucauauccaaaagaauuuuguaaaagaauucaauuaucacuuaauaaguauuuuuauuaccacuacuaaagugauauugaauguuuuuucuuuuuuuguaugugauuucauuuucagccauucuuuugggaauuacucuagcucuucagaauuaauuggguaacuuuuaugaaaugucuuaaucauuuggccuacucuuuccugaaauuaagaaaacaggcaggagauaacauuauuaauuuguuuguaaacaaauaacauuuuuugucauauuggacauauauuuaauugucuucuauuucuucuugggucaauuuuaaugaugggauguuuuccuugauaauaauucaugccauacguuucuuucaaauaauuacgauaaaguuguacuuacuguuccaucaugcuugugaaaauuuuucuuaauugugguguacacauguuuuugauacuuuuauuuaugcauuucauuuuccaaaaccagacaugcccaaggcuuguuuuuguuuuauaucuuuucaaagaacuguuuuuucccuucaauuaacccuauugauuuaugaauucuaaaauacagauuuuaaugcauuuuaacucaagcuuuaauggcuucauauuuuguuuauugaguugaaggcuugauucauuauuuuaauuuaguaauuaaguagaguuuaaagaugaacacguuucuguaagcaaaguuuuaaaaacaauuuacauguagugcuuuuguuaucauuauuuucuaaauagucuauacuuuuaguuuuuauuuccucuuugcucuaggaacaguguaugagaguuuuugcucauuugcuauuuuuacuuccaagugguuugagauuuugucuuuguuuaaaauguuauucaucuuaauuuuauuguguuuuaaucugguaauuuguuagguauuacuuauguuguauauaaauuuuggaguuggaggcacaugauguauuaucaauuuuuguaauuaaccuaugggucuucagugucuauaggacacaaauuuauauaaaauauauauuaauuguacuauuuauauuauauuuaauagaguuguaaaauguuauccuuucagucuucucuaucaaaacucacauguugaugguccaugauucauaaguaacuuacagaugugguuauguucaaccacaguuuuaaaauacuucagccagaauucaaaauuaguagagucuacauagaaauucaaacuuacaauuucaugugaaaauugcuggagucuguuucaagcaacuuguugaauuugagagacagugcccccuuggaaaguucaugagaucuucaauucacuuuagcucucacaauucaagcacauugugugcauagguacuauacccaacuuuacuuuuauaccuuaacagccugaucucuauuagguauuugaauuuauuauccuucauuucuucucuugguuuauuagucuaacugaucagcacggcagauuacauaagauagccacaaaguucuuccuauucugguauuccugccccuuugcaauguacuguucagcucuuccaacaauuggugcagucuauuucccuauccuuuaacuuugggauuagccaggaacuugcuuugaucaaugggagaaaagcaaugugauacaaacagagcauuggagggcuggcacaauggcuugccaucuaucuugcugugccaggaacccuggaucaccaugugaaugaguccuaauuugcucgcugaagagugaggagccaugcagaagauaacagaagugcugcuacugagucacaacagcaacuuggcaaugaaauauuaugcuuccugcugagcuaauacccugcucuuuucugcaguuuguacccuuccaaauuaggacaauuaauggauuuugucagggucacgugaaaaacagaaauuucuuaggagugugcuuuuuugaaaucugccaauuccugguucauggaggguacccuuacuuaauuuagaguacuguuguaaaauuuccucuaauuuucuauuuauuugucauaucauaugagaucuaaaaaauggaagguaaagguagaugcuuauguuuucuucaacaucuuaaguaaauagauauuucaaaaauuuuaaaaauuucuuuaauggaaucauuuuaaaauaucuuccaagcucaguagaaaauaaauauuucgacagggcuuacacaugauaaaucagugaauauuauuuucaaguacuuauaauguuauucauuucccaaguuuuagguauuaaaaaugugggaaaaggaauuuucuaacuuggauucccaaugaaaugcaguaauuuaaauuauguuaguguauuuagcugaacauggaaguugggccaauauaaaaacaaaacauaaaagugaaacuuuuauauaccacagaauggcuaauaaguuuaccauuuacaaaacauagggaagcaaaacuaagaugaaaaauaaauaaguuuaaacacugaacuguaaaaacuauguaugaauauauucuaguuuuuaaagggucaaauuacauaaaaucagccuauuuucuuccugcagguaaaagaaaugcccaaaauaucacuggcuuaaaaaucaacaugaaagaaguucccuggcugacuaucccagguuuaucacgcuuccagagcuaagaaccaaacuuauuuuacuuauuuucucuuguugcucugugcuccucaguacauagcuuccaacucaugucuuuagagggcugcuugaacacaagucauccuauuaacauuccagccagaagaaaggaggaagauaagaauaagaauaaaaauccuuccuuuaagaacauuucucagaggcaucacaugauauuucugcuuaaauaucauuggcuacaauuuagucacaugaccacacuagcuaaggagagaaacugggaaauucauauugugggaagucuguaucuggcuauuaugauucaggagcuguauuacuaagaaaggagagaacagauauuuauaaacaaugaacagucaucgcuacauuuccucauauguaaacacuguuuugagauugaaaaaguucuuuuagacucuuuucuauuuuuacauauacauagguauguacauuuuuuccauaaaccuuaucauaauguaauguaaucuuagagaaauacauguuuaucccuacccaaucuuucuaaauacugcacagaauuuugagcaauaauuauuuuugucacuuuuguauuuuuaacacauugauagcacaugaauagaugcucaauaaguguuuauugauuaugaagguacucuaauuuacauauuuucgcuuugaaggacuuuuuugaauguuuccuuuuucuuaccuauuauaauuaauagauguuugaucuugcaauuugaguauauucauuugaaaaguguuucuuggguuuugccacacugauguuucucaaaauuaguauguuucauuauuucaauagauuuuuuucucugacagcacaauagugacaaaaacaucaugauuaguuuaguuuaugugugauaagccuuauugcuacacuguuucucagaaaccacgugcuauuccuucuccuagcucccucuuuagcaggccuccaagucuacucacaugcugaucuccuuuuaaaguccuuauaggaacaauuuaguuuucacuagucucugaaccagcuuuuaucuuccagccugauuuguuuucacuagucucugaaccagcuuuuaucuuccagccugauuauauauacugaaaaauaccuaguuuuccuuuucuaauguauuuucaccugaguuugugacauugccucccuagaguuuacaguuauccuucauuucucuguuuuucuguaucucuccuaugggacuuaucccauaauaucuguuuuauauucucaauuucaauauaaacuucuugauauagguauuuuaucuucguagucuucugucucccuaaauauuuucacauugcuuugcccacagucauuuuccaaaaauguucuccaagaaagaugucucucucucucucucaacuuacuugcucugcuuguucuuugcaauuugguaguaauaagugcuuuuauauaaccuucaauuccagcauucaaggaauagauucuuggcuauauacugccugaaaaaaaaaagucucucccauuuugucauugacuuaaagguuuuuuuuccauaugaagcucuuagccaggcacucugaccuugguagcuuggauucuaauauuuucagcccacaugugugggauaaaccuccauuuaugccagcugugcugcaacccugcucaugauguaucaccacuuuccuuucgcugaggccaaaucuaagacucagacaagguaaauagcuugccugagauuauaggugaacaaauuguggaguuggccauguccccuauaauaugcuugauaaauuugauuaacuuuuugccuuaugguuucuguauaaucucuuccuucuaauuacuuccccaguauuuauucauugcucuauuuuuuucagcacauauguccuuuuuaauucuuacucuuauuuuucugaguucugauuuauaccuaagcaauacucauacuagggaaguaggagaaagagauuucacagagauggugguaaguguauauguauauaauugaacauauaaggcauuauagggaauuauguaaauuagaguugaaggaaaacuauuggaggguuauagggagaguguaauacgaucugacauuuuaaaacaaucacuuuggcugcucuguuaaaaauagauuuuuuaacagaaauaggaaaaagagcaguagcuuggugagcaguuaaagggccauugaaauaguccuaaagagagaaaaauaguggcuuucgaguggugagaagugaucguauuuauauuuaugguauauuucagauuuacagccagacaaauuugcugaugcauuguauauaaggcgugacagagagaagagaauucaaggacaacucaaagguuuugcacugaguaacuugaaaauuggaguugccauacacuacaacagacaaggaugggggaaaggggugaaaucagaaauucaguuuugaacacuuaauguuugagguacccauuagaaauggaaaaugcugaaggcauugugaggaauaaaagccuguaguucaggugagaggucuggguuaaagaaacaauuggggaaguggucuacuuauagaugauaauugaauccauaagaugggaugaguccaccaaaaguugaaguauagauaguaaagcaagugguggauauguguugaucucuucucucucucucucugucucugucucugucguucugucucucucuucucuauagagcugcuuagcucuugaagaacaagaacucuguguucuauacuuuauguauucuccaaaauuccaccuacacauuaggccccaauaaaugcuuauugaaugcuaagugggggaaaaaguuaccaguuauaaauuacaguagcauuagaagaggcuuaacaauauauauuguuucuauaauucccaagagguaaugcuauaucuuugaagaaacagaccaucagaaagaguuuuccagucauguagagacuucuucaauuuucuaagaggccaucugaaggcugcuuaugggcaaagaauacaggagcaaucgcugacugaaaugcccaaacugcaaauacacauuucagucaaaugcaaaucaaggauaaaagaacuagaauugagugaauuuuuaucuucauuauaguaaaauuuucaaucauuguagaauucacuuaauguagcuauuauauagauguuuuaggagcucuggaggggaggggaauguaagcucuuuguuaauaagaagauaacuagcucccagaaacaguuugucucuaugagaaguaaaucaauucuggcuguucuccuagugauucugugcaguaucaaaugaaauauaaaaugaguaggagagacacucagauguccucacacugcuagagggagccucugaagccaaacugcagucaucuccuaccuggacacagcugagccuuguuaggucuccggauuuuuuuuuguucuuaguuaagaaaaccuuuacuuauuuuaaagccugccauuacaaaauuaccaaauuacaaaaagaaaacucaggaucauugagacuuagaacaacugaaaucugaaguacccaaauggcaggcaagaguaaguccgcaguuaucuuucaagguauggcucguggcucugcuuccaaauauucauucugaauauuuguaugucaaguuaaaaaaaauccuuuaaaugagguuggaacauugauugcuagagugagugaauauuuaaagguuccauuugugguuuuaauguuguacuaaaggauguuuccauuucucuuuaauauuaaaauuaaccuuuucauuuaguaaaguauucaccauugcaaaaaaagagaaagaggaaauauauuauauauugcaucaacuaccuuucuaggcuauaauaaauuuuuauuauucucuuuuacuuguagcauauuucucuauguuuauaauuuccagacuaacguagacuagaacuggcauguuaaauaaaaaugaccaagcaaucuaaacacaauaccucacaauuaugcccauagaacauagagaauuucauauccgaaaugucuuuaaaaguuauuuauaguauccucacccaaaucuguaaccucuuauaugcuuggauguuaucuuacucauuaauuuuaucuccaaaccaugaucagggauagaugaaauucuagguaacaaauggaauuucaauagccaaccguggauuucaggauuuaucuauccuuaaguugucagauuuucucaucacagcuucagcuggauaagcuguaacccaccaaaucuuuuuauuuguaauauuuuacugaaguuuuguuuguccuugucuauaaguucuccuuaaaucuaagagccauuccuggaugguaucauucccuuuggcaaauguucacucucuguucuuuaguuuugauucaagacuuauuauucaccacuuaucugcgcuugccaucuauuaggccaaguacuuaaugauucaaguucuuuaucugauugaauugcuccuugcuguuugcaaugucugccaauuaaauaucaccugcaaauuuagaaaauugcuccuacagccauucacuaagucauuugcaucuacauaauuuauuuccuuucacagaucucucguuauccuuuuccuucauuaguguuaaaauccuuccuuaucaacaacaaauauuuuuggccauguuuuccucuuguacuuauauacaaacagguuguaugaucucccauaucuauauuuuaguuucauccuauaugcauauccaguggauuuugaacacuuaccauucagacgugcaaacauguauucuuaugaccacauguauuuuuuuuaacuuccugccuguguacagcugacauacucugggaaacucaaucugucuauuauuacuuguuuaaucucauguaagaaugaaagucuuagccacuguccaauuuaaagucucuauaagggcuucccuucuuuuuacguauuuuacucugguccccuuugcaaagcuaucuccucauuucacaaggccugcaagcauuuaucacugggcagucacuggcagguguguuguagcagggagguucuucuucggugggcaaaguuuucuuggcccauacauauauuuucaaggcugguuugcaguaaugaaaauauguaagacucuuuugugugaucauggaacauuuuugauggcuuucaggcacccagcugagaacccuucuucauucacaagcguugcuccucauaacaggaccuucuccugaucccaguggguggugggcucucccugcacaaggaggccauuuccucuggucuuuguccuugccagcucuuccuccuucucuagacugugggaaucuuagguguucuugccacccuaaguuugacuaccuaggaaauggugggucagaauggugggaauugugccucccugcagcauguucugcuggcauagagagauaggcucgacuuuaugggaagaaugccugauccuucccaacugccccuggcaugccccucuccaguguggguggaaaaggggacaacucaucacauucucagguucucugaacucucuucccaaaguuaacccucuccucccucuaguuuuuaaauuauuuccccucgcagcaaaaauaauuaacaccuguucuccuuacccaugcucagguggaacaauuuaggaccuuaaauaaucauucugugcaugaucuuccuauuaauccaacauucccaaugaaguuuuuauaauggaagugauggaaauaccuauguuuccuaaacuuuuagaaauucucaacauuauucacuuggguuccagaugcucacugacuaauuguuccuagacaauuccaugagaauguuccucagguaccacaaaaucaaaaugccuauagccaaauucugugucccuguugcccuuuuccaaucugcuuuuccuucugcauccccuauuuuuguuguggaguguccaucugcucauuuuccucugcuaaauuucucaccaagucucaacccuuccuucuuuucuccuccaaguuaucaauuucuauuauuaugccauagaauguggaagucaguguggcgauuccucagggaucuagaacuagaaauaccauuugacccagccaucacauuacuggguauauacccaaaggauuguaaaucaugcugcuauaaagacacaugcacacauauguuuauagcugcacucuucacaauagcaaagacuuggaaccaacccaaauguccaacaacgauagacuggauuaagaaaauguggcacauauacaccauggaauacuaugcagccauaaaaaaugaugaauucauguccuuuguagggacaugaaugaaaguggaaaccaucauucucagcaaacuaucacaaggacaaaaaaccaaacaccgcauauucucacucauaggugggaauugaacaaugagaacacauggacacgggaaggggaacaucacacuccggggacuauuguggggugggggauggggggagggauagcauuaggagauauaccuaaugcuaaaugacaaguuaaugggugcagcacaccaacauggcacauguauacauauguaacaaacuugcacauugugcacauguacccuaaaacuuaaaguauaauaauaauaaaauaaaauaaagaauauuaacuuuccucagacucauucuuuuuguuagucuccuguuacuguuguuuuaauguagacauuccauuauuccucccuagauuguugaaaaagccauuuguuuuuuucucuuccucacuccaaugcauucucaggccuaccucagcuaucuuucuuaaacguaaguuaaaucacauuuuucucuuuuguaaaacucuuuuauaauuuguacuggcuaaaugauaaagugcaaacuauuuaucaaggcaaacaugcuuuuauaauuaucccuauuguugccucuuauacuccuacucaucugaagaccuagcuuaaauuucuccucuucugugaaaucuuuucaacuccccaggcagaagcugccauucggccccuggguugccauggcacccuguauguauuacccuauggcauuuuucacacuguguuuuaauuauuuaucuacacauuuguuuuucgugugcacuuagagaucuuugaaggccgaggaaaaguaucuuccacuccuuuguaucuaugaugccaggcacagugcccagaauacaacaugcauucaaaaacaugugcagauaaauggaugaauuuagggcauucugcugugugcuuggcauacaaaguaaacauaaccuuagucuucugauuuccaaaacagggacuaugcaaaaagaaggucucucucucccuccaucucucucguucucucuuccugagauuguauauaugcccauuuauagauauagauguagauauauauagauagauguguaacauuacacaaagguaauuugaaaagaaguggaauagguguucucagaggacgagauuacuaagagaugggaguaguuugaaagccuuaugggacaaagugcaaguuuagcuaggguugagaaaugaagugaguacaggcagucuaggcagauuaaagcugaaugucaucuaaauggagugugauuaaaugcaagagggaagugagauauagacuguacaguauauugcaguccuuucuaaaaguuuuaauuuuuuauggaaagaagacacagguguuugagaaagaagugugaauuucgagaaguuuagaaaugcaaaucuuuuacaucucaccccaaaucuuucucuauguaaucuuauguuuugucuucuacucauacucugucugaacuccuaucugaaccuucuucaaauaugcagguuuaaaaaaaaacagcucugaacuguuugaguauuguuuuucucacugacauguaacuggguuuauuuaaaugcuuugcagacaaaacuguuuuucucuggaaacugguaaaggaguuaagcacuuggaugcuggagccaaacuuccugaauuugaauaauuaauucucuacaacuuggcuaugugacuaugggcaaguuacuucaccucucucuguuucaucaucuacaacauugagauaauaguaguacuuaucauugugaguacugagagguaauaaauacauaguaugugagacugugucaggaauaaguaagcucuauaucagugcuaguauaguuguuauuuggucaguuucaagcuaugcuuuuaaauuccuuguggguuuuguguuaauugcaguguugucaaaucuauuauugaugacaaguaugucaucaaauucuggugauguucuacuuuauuaugaaauacaacauauaaaauaauuccaagcauauauaacacauuuacauuauuuuguaaaauaaaauauauaucaaucauauuucauaaacuuaacuuucuaaaaaaugauuaacugcccuucuccauugcaauauauuugcuuucggauuuauacugccuacuaguuucuccuuuugaaacucuaaguucauaucuuuuauaucuauccaguggggucuuaguauuuucuuguugauuuuuacuucauguagcagugaagcggugacacaaacaagucaccauuacacuuuuacaaauauuuucuagcauuuuguuuguaguuuaauuuaguucauuaugauuuuguauuacugucgauuuaaauuuuuguguacauguaacuauugauaguuuccuguaacuuauucuauuguuuuuaagccccugaaggauaucuuuuguuuuuccuguuugguaucuacuuccccuuccucugauaacagcauccuacuuuuccuugggauucacuacuccccgaggcuugcucuagguguuuugcguguagcuaccccuacucucagugcuccaccugggcaagugguguaggccuggcauugagaacacugccuccucuugaacacaauacuucauagucagagccagugaauguuaaagcugaggcucuguauuggaacugcagguaaaagagaaucuauguuuauguugggauagauaagaggaugaaaucuaagccuaagagcuacuaaaagucacuuuacugccaagagaggagagccugccugagaacuggggcaacacacacacaaaaaaaucacagcugagagauggagcaagcgauaccaaagccugaugaaaggagccuggaucucaucccugaauaggccaguuuugugagaauuaaauuaucuuuucacuucaauuggauugucauuugcaaccaaagacaccuaauuaauuuagcuuagaauacaugagcagguuauuuucaagauagagaauaccuuuuuuaagaaauggggaaggagcaaagaauuugaaagagacugaaaauaaaagagaaguagggauaaagaaagguagaggggcaauuuaaacuucaucuauaugcagacuggccucaaaugcauguguccauuccauauccuuacccgaacuccagacucauauaucagauuacuuauuucauuuuccauuuggauagcuccaaagagguauauccauaguuguuaagagaauggaaucaaacaauuuaagcuaauauccugguucuuccaguuauuggcuaugugaccuugagcaagguauuuaaauucucuaagccuugaugucuuaaaucuacauaaugggcauauuaacuaucuauuucaucaaauuaguaagagcauguaaggagucaauaccuguaaagcuuuagaauagcaucuggguauuauuacugauuucuaaaauaguaguuuugauuccgcauucugcaacuccuggccaaauauuuccuucauucauuucuucugugccaauaaaugguaccauucucaauuaacuugaaguaaagugagaguagcugaauauaacaagcuguuuaauuaauggacaaaauauuuaaaauaauaggaacaaaagcucaaaguguagucuuucaacaaagauaaaaacauuuuauauaaaguccaaauuuaguaggcuauaguagguuaauugauuuuauuaaagagcaaugagaucccauugaaugguuauuaauuaggggaguguuauuaccuaauguaugccauguggccaccauucauucuuuuauguacaaauauuuucuagauauugaggcuucaguaguaaaccaaauauaugaaaucucagaccaacuucagcuuacauuuuaccagaggaagacaaaugaacaagucaguacauaauaaaauaauuguaaguguuauaaaaaacaauaaaacagaauaagagagauagguaguacaaaggauggaaguuguucuuuugaagaggguggcaauggcaguccucucuaauaagcuuuaagcaaaugcugaaaaaaaaaugagguggacagagaaauaucauuuuaggcagauaggagagacagaaauugaaaaggccaaguucaaugaguauaaggaaguacaagggguaccauaagcuuggagcauggugacagagggagagauaaagagaucacaaagggaauugauugggcagauuauguagacaauuuuaaggacaguuuuuacucugagugggauggaaacccaucaaaagucuucuagcaggaaaaugacuggaucacucuggcugcuguguuaaaauauauugaaggcagucaagaguggaaagggagaguaauuggaccucuacggcuacaauccagagaagagauaauuguggcuaggaacaagauagugaguggagcuggggaaaauggaaauaaaggcuguuuuuuuuuguuuuuguuuuuguuuucugcugcuguggcugaaaagacaaaauuaaaaagggaugaguuuagaagagauuguuggcuuuggucuuuuuuaaauuuuuuuuauauauuuuuauuauacuuuaaguucuaggguacaugugcacaaugugcagguuuguuacauauguauacaugugccauguuggugugcugcaaccauuaacucgacauuuacauuagguauaucuccuuagggacauggaugaagcuggaaaccauuauucucggcuuuggucuuucucucacuuccccacagcaaauccuaucagacuaccuuccaaauauguguuggaucuguuacauuuuuaaaacacagaaccugaggaaguuuuaccaaucuauccgagucaacaaauacaacaagaucuauuuguuuuuccugcaacacauucuugaauucauuuucuugguucaucuucacaauagcuucauuccacugauguggacauugugacucagagaggauucaaaacucuuuuaggcucacauggguauuaaaugugucaacaguauccauaacuaaugccuuugaugucacuaaagaugagagaaucauggaaggauuuugagguugaauaucaagaacacaagggacuuacgcuagauucucacagcuuuugcaguaaaccauagaguuuaacaacugaacaugacgaggguguaaaaaaugaagggacuagaaauugaggcuugaaaaguguggaaaauguuuggaauggucaugugggauuuaaauaaaaggucaauaccuaacgaauuaaaggacacuggaaaaucaaugaaaguucuauugacauuagcuacuaggguauugaaaugaacuccaucagccaagugucaugacuagcuacaucaauaacccagugugcgggauccuagacaauaggaguggggaugagcacaggaggcauagaaaaagagcaagagcuugagcauggcuugggcaaaaaauauacuuguuuugagcugacauggcgugggaauucucuuccaucauuuucacuauuuauuaggggccauggaauuuugccuuucuuagauacucaaggaaccuguuuuuuguuauuuauuaaugagacucuauucaugcuaucuccauucuuguuuuguuuuguuuuauguugucaauuacaugugcuuucugaggucucaucaccuccaccagacaaaccucacaauagcaucuucuucuccuucucugaaaacuuugagaccuggcuaaauguuucucuucacacaaaaacugaccaaccuccuaauauauuucagaaucaauguagauauuccuuacaacaaucauuuugggucaugauucagauagauauuauuuucuaaagcaguuuuagguuuucagaaaaauugagcagaaagugugaauaauuuacccuauuauuacuauguugcauuggugagguacauuuguuacaguuaaugaaccuuacaaucauuauuggagacggaucucacucugucauccaggcuagagugcgguggugcuaucacagcucacugcagccucaaacucuugagcuaaagggauccucccaccucagccuccucaacagcucggacuagagccaugcaccaccaugucuagcuaauuuuuuuuaauguuuauuuuuuuagagguggaggucucucuauguugcucagauuggugucaaacuccuggccucaagggauccucccaucuuggccucccaaaguguugggauuacaggcaugagccaccuugccuggccaaugaaccaauaucaauacaugauuauuaacuaggguguacaguuuacauuagaguucauucuuucuauggguuuugacaaguguauaaugucagcaguguauccaucauuagaguaucauccaaaauaguuuuauugcccugaaaauccccuaugcuucaucuauucaucccucccucccucacuccauuuugagcuauuuuaaacucauuucuuuuguuuucucuaacacucugccaugaaccucaaggucaaauucuagaacuuucguauuucagucucugguuaugucuuucuaaccuacucuuucauuucuucacucauacuucaccuguuuuucaacuucauuugaucuucuaauuaacauuuccaaaauuuuauccaaguuuaugucucugaucauggcuaugcuuccuuaaucauuuuagcucuucuuucaucucauuuaauucccuuaccaaguuuauccaccaugucucaaccuugauaugaacauuuucaucucugcuccuagacuugggcacucaaucucagcugaagaaagucacacuguuguguaaacuagcagcaauaaaaaagugucaguuucauauaaaccuccacucagucuuuagugccacugaucuauucuuuuaucuguucugauuuagcagucacuuucccuuuccucaaugucuauuucaaucuucaccacucuccuguagacuguuacauaauacauguccccaucacugucaacauacguaaucuccaauuuuuaucaauaaauuugaaggaauaagaaaguaucuuugucaauuuuccauucucuugccuaucuauuauuaacauacacauucucauuauauuauauucaguaucaaaguaacaucuuuaccucauuaaaaucaauuuucaguuuaaucauuuuugauggaguugaaucuguuccaggauauuuauccuucacauauuaacugacuuucuuauauuacauuuuccuucuuucuuuuucuuccuuagcuuauaauuuuacucaagucucuguuuuaacuuaaaaacaaacaaaaacucuaccaaaaccaaugacccuuccaauuauuaucucuuucuuccccucuccaucuaaaauuucugaaaaaauaauacauaugcaugucauuuucaccuuuucacauccaaguuuuuccaucaucuuuugcagucuggcuuuuucucccacuaugcuaccaaaagaguucuggcuuggguaaccaacaacucccaaauggccaaucuagugaacauuuggcaguucuuaucaucaacaucucaaauaguucugacauugcuagucauagcuuauuuuuugaaacuuucuuauuuuuuuucauaaauucuucuuauuuugucaauucuuaagugacagcuuucucuggguuucauccuaagauuagcccagugauccucuuacuccauguguucuuuuuggcaaucugauguacuuucaugauuucaacuaccacccacagguugcugacucccaaauguauaccuccuauggcacuuucacagugagcuucagaaugcuacauauccaacucacccuauucuaaacuguccuccuccucuaaaucuuuuucagcaaucucugucccaauuaguuacacaaccacccuuuuauguauuuguacuaugaacugaugaauuauuccagacuucucccuucuccucacuuuagccaauaaauucuguuuauccuaccuccuuuuuaucucugauuuccugucuuucauucucuucacaacauuaguaugguaggauagauucucaucacuuuuugcuuggagagcugcaaaauucucauaaauuuuggccugcuuuccaugcuguuucuaaccuuucuaccuuuacuucuacucuugugucugucaguagacguccuucacuuucugccaaucccucuuuaccuagauaauuacuaccuguuauuuugucaucaggcuauauuucuccuccuucaggaaauuuaccuuuacucuaccuuccuuguugcuuucuuagugcuucucuaucauugcaccuagugcauuguauuauaagugucuaguuuaaccucuguguuucucauuaagacaagaucucuucaagggcaagaaccauguuuuauuuaucuuuguaucuccagugccuagcacagugcauagcacauagagaccaucaacaaaauguuuucaugaucaaugucuaugucuuauucacacuugcaucccuccauagcacuuugaccauggcaugugauuaacacauguuaaguggcauauguuuugaaauauuuauaggcagggcgcaguggcucaugccaguaauucuagcaguuuaggaugcugaggcgggcagaucaccugaggucaggaguucaggaccauccuggccaacauggcgaaacucugucucuacuaaaaauacaaaaauuagccggguaugguggugggugcguguaaucacagcuacuugggaggcugaggcaggagagucgcuugaacccaggaggcggagguugcagcaagccgagauugcgccacugaacuccagccugggcaacagagugggacuccaucucuaaauaaauaaauaaaauaauaaaauaaaauauuuauaaagccucccgguaaauauaugcuuucuauuguuaaugcauugaugaacuaaaauacccaucauaggaauucauuuaccuaguaaaacuaaagaauugccaaacuuugugucaaccauaaaaauuaggaaagcuguguagucccaagcagcugauuuacucuguuuagucuugggagcauuuucuuucucagaaaaugacauuauuggcauuauaauuacuaaauaguaucuuauuauacuccaauauuauaugucuacuuucaaaaacauucuuuacucucaugaaaccacgugggugggcacagugacaagaaaagccuaguguuauacuagaaguuuagaaauugagagauaggacucucaauggugcuauauuuuaacauggaaacaucacuauuaauacuuacaugcuaaguauaguacuuuauccuaauuuuacagauuuauaauuuaguccacuuauuccuccuuuuuuuccauuuuccuggguucuggcuuucuuccauuguuggaucuauuuuccuuggggaguaaaauucuugucauauaauuuagcauuugauaaucaguuagcaugaagagauuuaauuuccaggugguggaaacgcucagguaaaauuaggcugaaggaacagauuauuuuuaaauccaaaacgaccagucauguucuuuauauaaaauaaaucuuccauuguaauaaccaucaagcuuuuuucuucauauaaaccccaaaggaauuuuuuaaguauguaucuuucuacauuuauaauugacauauuaauuuugcaaucauuuagaaaauuguaaagggcgcaauuugcagacaguacugaucauuaccuguuuucucuuaaaccuauacauaccauuuucuacucugcuauauacugugagccuuauagggaugggaaucugcaaaccagauuucccaggcuccuuugccaucuggcuucuccauaauuuccaccugagggaaaccacugaagauaucagacagaaaaagaaagagaagagccgucugcuuuaaaugguuauuucaguggcugcagcagcaguggcaguaggcgauucuugaucccagcagcuagggcacgggcagcaacuuuuuggcaauuccaggucugaucaaggggcauacgucuggcagauacaaucaacugacacaucaguaacacuugauaucuguguuuuacuuuuucuuuuugcuuuuccaauguccuacucuguucauccuuugcucuuugauuccuucuagcgccuuugugaucaacccacaauauuaaauucuccucuuuucaaaauuuuaggaaugguuuucauuuuccugagugggcgucggcacugacauauguauauuguguuguaaauauugauaacuuaaaauaauauugucaagucacuuuuaaaaauauaucuguuagaaucuaaauaucauagugauuugaccucaugcuuuaauagguagaauauuuauaucauuuuauuuuaugcuugaacuauauuuauauuccgccccacccucacacaauuguaauucaaguacaauagaaauguguguuugaaagucuuuucuugaucaccaaaguauuuuugcaucaaaaauaugcauacaaauuaaaauuacaauccuuuuuaaauaaccagugacuauaaaguuuuagguauaaaaucuuuuuuucugaauugagucaugauucaauuaguauacgaucuauggauucagugucuauaaaaaugaaguuuuacuacaaaugcagcuuacaauguuauggauagagccuuuuaaaaaaauaauuuagauauccaugggucaguacuaauuaugguuuaaaugagguagaguuuagcauuaagauuuaauuucuguauuuuuuuacuuuauagaaaucuuuuccaaacaaauuaauauaugaaaaaggaaguuuuuaguuucuauuucaaaaugucacucaacaccuugaaauuuuucugugcugaauauacuggcuugcccuuggaaagucuucuaauaccccuaaauacuccacuuuaaaagcuucugacuugaaagccagccaaagaagaaacuauaucaucaaacauccaacuguaucuaauucagaguuaucuuuguuuuuaauuuuuuugguacuucuauccuaaacuugauauacuuuuuauuucuuauugaaaguucucugugggccucucuucccuucuaaacuaggagaaaauaauuucucaguuacauuaacucacccuuaaauauuucuccuguacuaggcagaagauaucucucauuuaucuguuucauaucuuuuggccagauuuguguuuucauaaauuuuaagaacacauuaauugcagaaaauuauaagaguagugaggcagagaaggacuugaggagacuuuacuauauuauuaguuuuuaaauagacuccauauguacaucauaucaaucauuuucucucucucucugacugcauuuuccucucuuaaaaguauguauguacuggaccacugacuucugguuuuaaugagaaagcucucuaacaugagaucuaaucacuguggaauaaucauaugaauucagagcucacuuuccaacauuucuucuuugacucuucuuuaaugugaugguacgugcauaaucauuaugauauauauaauugcacuaugugaaacauucuuuuaaguuugguagccccuuagaaaggcacacgaguuaauccuguuaauuuuaaaauucuuacugucuuguacagagauauuuaguggcaacauuuauuuaaaauauacuuagauucacaaaaguauguauauuaucagaagauauaauaacaauaauaagcuugcuuuucuggagcuccaucauaacauuuuuaugccauuucaacgguguaauuuugguuuauagggguaaauacaccucauaaaguuugaauaugaugaauuuucuuggaaagcuaaauuauuuuaugguauuuuauuaaaguaucauuauguaauugaauuaacauuuguaauuguuaaaaauuauaacuuacaucucuacugauaacagucagaauacaguuaagggaauguuguguacccuuaacuugauagucauuuucuaauguugacugcucuuuccuucuugaaauguuauuuucuguuggcauucaugacaacccauuuucucaauuuucuuuuaaucucucuaucuacuccaacuaagucuuuuuuguagguuucuucuccuccaccugcuuaauaguuuuccugaagccuagucagagugacuaaauauccgguugaacaaaauaaaaaccuaguuccaaugaauaauuuuauauuuuuucugucuaaaaaucauaugucugcuucuuuaagccucaauuuuuuauuugcaaaaggacucccucuaaacuauaaauuaucauacaauaaugacaugcucuuacaugcaaauaguacauugaaauugauuguuuaugaagaacauucuauuucuuguguaugauugcuauacgauaaacuuauauuuucaaaacauaguauuuggaagugaucuuaccauuaacauacuuggacuccucauuuuuauaggugaaaaaguaagucuccaaaauuaaacuaacuaguguaagcacauaaaacaaauuaaaaacaacaucaacauacuaauuugaaugcuuuuuauguuuaauuugcaucuagcaaguguaguuuauuagcauaauaacucauuaaggauuuuaaccacuaucuauauagaauaaauuuguauaaugccuuuucuuuacacuaauuuuaacguaauugcuaaucuggguucagaucaggaaacagcccuuagaaagauaaagguggaacacugaauuugugacuuuuaaaagaauagaagaugaaggggcacgguuuuaauaagaaggaagaggacugacgauugcccauuuuguauuaaaaauaacgauauuaaugcuuuccaauacaauucuauauguaacuuauguauuaaauagaccaaauucauuaggauuuuauagaauauagaaauagcuuuauuauuuucccuaccacugccuuaagaaaccuuuuauuucuacucuucuccauuccuuacaaacaauuuagguuagauccucuagccuucugaguacuuuaaagcauuugagaaauuauuccaauucuagcaaugauguacuagcuuuuauuggacuagcccuaucagaauaaaaauuaaaaauucaggaucaaauugaaaaaaauauauagaaaagacuggagagcaacccaaagcaggcagaaacugcaggguacccuugaaaauaauaacugcacgggguagagcccuccuuuauuaggcuuagucauugaggacccacuucaguucagcggggauggggucgacagagcucaaguagaaagucagucuuauuaacuaacuugucagaggauggaguuugaaucagcuaggguugccagaaauugaaaagggaaacacaagaaggaggaugccacagaggagugagccccaaaaucuguguauaaacuuucuaaaauccuuagcugaccccuaaacugcacauauaugggagagauccuaggaaaauuagcaaagaguaauggcuagaaggcuaaacgugcuaaagaggggauuacaacuguugccuaugacagggaagauacagauugaauuuugaguuccuuuaagucagaagggcuugaggagaaccacaggcuuuccccagaaacuccagaagguuauaucuuagaaauauguggacuacgaaaaccaagggauuugcccuagggaccaagauuacaucaaauagaccugccuuaacaauguuuaaagcuaaaucuccacaaauucaagagaacagauagugauuuaacuauccacugaagcaaaaaucaauccuuuucagaauauacaauuucagagacauaaucccaagucuuaacaauguaucaaccacgaaguccaauauauaaucaaauguaaccagaaaugugaggaaccaggaaaaugcaauguauucugagaugauaagauguugaaauuuuagcaaacaaggacuuuaaagaagccauuauaaaugugaucaugaacuuuuaagaaaagaaagucauaacugauaaaaagauaggaaaucucagcagaaaaguaaaaauuauuucaaaaaauugaaauucuggaaagaaaaaauaagcaaucuagaaugaaaaagcuacugaaaggacuuaacaaaaauuugaagguggcagaauaucaguaaacuugaaggcagaucaagacaaauugucaaaucugaaggucagggaguaaaaauaucuuaauaaaacaagcaaggccucagugacuuaggagacaacauuaagugaucuaacuugaauauucucugagccucaaaucaagaagagaaaggaaagaagguaaaaaaaauugaagaaauaauucucuauauuuacuaaauguaaccuaucccagaaguuuagugaacucucagcacaauaaaugcaaagaaaaucauaucuagaacaucauaauuaaauuucuaaacaccaaaaaaugaagagaaacuuguagaauggccacuaacacauacaaaaauauacuacauauaaagaaucaggauacagaugauggcuaauuucucaucagaaauaauauauggcaaaacugauagaaucacaacuuuaaaaugaugaacauuaaaaaacccuguaaauucagaguuugauauccaguaagaauaucauuuugaaaugaggguuaaaaaagacauuucaagguaaacaaaaguugagaguauaugcuaccuacguagcccugcacuucaagacacucuaaagaaaguucuucagguugaagguaaauuauaccaaaugggagcucaaauauauguaaggaauaaagagccccagacacgguagauaagugauuauaucccagcaacugucuuuuuuuuuuucuuucuguaccuuuaaaagacaauaaauauuuaaauaaaaaacuaugauauuugguaugagguuaauaaaauauaaauaugugaacacaauaucaaaaaggagugaguacaaauaaaauuauauugcugaaaauuuauuacuuuuuaugugaaguaguacaauauuaacuuaagauagaauguaguaaguuaagaaggcauauuaugaccuuuagacuaaccacgaacaaaaauacaaagggagacaacuaaaaaggcaguaagagcaauaaaaucaaauacugaaauauauuuaauuaaccccaagaaaaacaggaaaagaagcaacagagaaaaaaaugguauacauauaaaccaaacaguaaguuauaaaccuaaacccaacuauucaauaauuuaucaggaaaauguaauaauuauaaaugucuaugugccuaauaacagagccucaaaaaacugaagcagauucugacaggacuaaagaaggacauagagguuuuaaacaccuuucugagaauugaaagaacaaagaaaaauauauacauauguacauaccuaucuugauuagauuacagaaugaaaugauuaguuucuaagcagugaauguuuuaauuuuuuccaauaacaucacauuuuuaaaaagaaaacaauaguccauccuggcuaacauggugaaaccccgucucuacuaaaaauacaaaaaaauuagcugggcgugggggcgggcgccuguaguccagcuacucgggaggcugaggcaggagaauggcgcgaaccuaggaggcggagcuugcagugagccgagauccagccacugcacuccagccuggaggacagagugagacucugucucaaaaaaaaaaaaaaaaaaaaaaaaaaaaagaaagaaaaaaaauaguacaaauugcauguguaacuuacauugugauuucaucacguaucauauacacuuucuguuuuugggguauaaguugagcaaagaaaaggucuucuucuaaacccuuuucuauuacaggauauauuuuaacauuuagguuuauuuugucaacuacuuuucuuuccacaaaguucauaaaauaguauugagugagacuuuuguacucaauuccaccaccuaaugcuuaaccaaccuaaauacaucacacuuauuuuauaugaaaucagcuucaagguguuacuguugaaccuuuagguaugagacaaauaauugaaccuuuaaguaugagacaaauaaauaaaguaauucuuaccuuaaagacaaguucuccuaccaagccauuccaugucccaucuucuugugggcuuccguauuugugauccggugcuacguaaauuucguaguuaaaacccagguaguuagauaaggcauccaaaacaucaauggagaagcccugguauuucuucggcuuacccaagacauuuucagagaccaucacaaaagguucuuccuacauggaaauaagagaaauuucugaugucaaucuauagugcucccuaaaagcaaagauuaauucuuuaaagaguuuugauuaaaucuaaaaauuguuuuauacuuugaaagaaucaacucaggaauauaacuuaugcauuauuaacgcaucauauuauuuaacaaugcuuaaucauucaauuucuuaucaucucccuuuuaauuauuaccauaucaaaaauuagauaaaaguaacuaaaaaacuuaggguccaugaauuuauuuuuccuguccucggaggaccaaucugagacuccuuaauaauaaaucauucaacaaacuauaaauuuaucguaucuauucucaggaauuuauuguuuguaaaccauguaaauuacauccaauaaaauuuuaacagcuauaaucuacauaaaacaaucugaaaagauaaaaaaauucuaagaacauauaauuuagcugaaauuaauaauaucgcauuuacugggaguuauucacuaaguaauuuugugacuuugauauaaacacacauuucauuggaaaaauagcuucuuuaugacugauaugagaaauucacuuaccuuuucaauaaacugucuaauuuaguaaauuuagcaaauugguuucugcuuccaccucuuuuaucuuuucccauuuuugucuuuuuaaagcuaacaaauaggccccuuucacuucugagaacaccugguguuaagaaagcucgauugauuugaaacaugcuggcagacuacagaaaacuagauaaucuauuccuuaauuuucuacauuuguucagaaaucuuucagcaacaguaauauuuacagauaaccauucaugguguauguaguccauccagcccucugggcaggcuaaaauuucuccuuguauauaagccagaauagccaaagguuuuuuuuuuuuuuugaaugauuuuuccucagagauucacaaaauagccuucauaaugcuuucauuuuggcuuuuauucaaagacacuguaaguagcuuauaaaaucacugcaccuguuauaggaauauugucaacuauaauauacaauuuucucccuaaaaauugcuaugagauaaauuuuguaauuguucagggucaaagagcuucauuugccucaguagugccuuuuucaaaaugauaaaaaacaauguaaccaauuauugagguauuucuuuucauuuuggauauucagaaaaucaguacuaaguuugauguucaucuauaacuauguugauauugugguauuuguaacauuucuuuaaucuugguuaucuaagguacuuacauuuucuaauuuugaaaacauauuuuaguuucacuguuuauauguuaucuuagagcaaaaugaacuaguaaauggacaguuaguagaguagguuacugcuaguuguccuccagaggaguucucuucuucucuaauuauauuuuuuuauauuuuaccacuauggagaauaaagacaaucuguaguccuacuucaggcaaaguggcuugcuucauggccaugugacuaauucuggccaacgugauguaaacagggugguuugugcaacauuucuuauucuuucugcuaccugaaaacuagaaagaacauacaauggcuggugcucugguaacuaucugagacuacacacagcagagaaaggagagaagucuaugucccugacacugaaaaugcuguacaacacuugggccaacucgccaaggcucuagaauguaagaaagaaagaaagaaauaucccagcacuuugggagaccgaagugggcggaucacgaggucaggagauugagaccauccuggcuaacauggugaaaccccgucucuacuaaaaauacaaaaaaguagcugggugugguggcaggcgccuguagucccagcuacuugggaggcugcagccggagaauggcgugaaccugggaggcagagcuugcagugagccaagaucacaccauugcacuccagccugggcaacagagugagacugucucaaaaacauaaauaaauaaauaaauaaauaaauaaauaaauaaguaaaaauaauaaauaaacaaauaaauuuccauauuuuuuguuaagguaccgauuuuuuuccuauuauaguaauauuucauguuaaugaauauugaagaucauuagaucaguagaugagagguuuucagaaugaaucagauuucuaauaauacugacuuguuuaaaugacaucauaauacaagugaaaagugaacaagcaaaccuuuaauauuauugguaaaauacaacacaucuugauauuccaaauauucauauauuuaaaguacauaauaaaacuuuacacaauuggcagaauuugcgacaucucauuugguuguuuggacaacuuauagagcuagccaaugauuacgccuuguacaaauacacuaaaguugguccugaggugauuagaaucagaauggauuaaaggaauuccaaaauaaagaucaaauucacagaccauguaaauaagaucauaaaguucuauaauuaauauagcuuuuaaugcuuguauugugauauaugauggcagcagaagcauguacugauuuccuuacaugcaacucauucauuucuagauuuugaacaucuaucaaucagcaaauuaauuguaagaggauucauggaagauauuauuugacuggcucuucuaccaauauuuggaagucauaugcauucucuauuuuucaggaccugcaaaaccaaaaaaaaucggcuauguuuaucaguaauuuaaucaccaggaaguugaauaacacucuucgauaugacacuuaaaaaauuaugaauuuaauuauugcauagguaaaugauagauguggcaaaaauacugucccaauguauauguugcuaaaaacuauuaauucuuuuucauuuuuaacucauaacuagcuagaccaauuauuuaguguacuaaaugguuauauuuucuuauguuaaauuucuuucuugaaaugacuuuaauucuaccuuuuaaguaaaucucuaggcaaacagaucccuugcacaagucugcugucaaaaucuguuccuagcaaugucaccuauaacugguuaaagauacagaauagaaauggcuauauuaaggggacuuucaaaaugaauuauugauaacauaccuuuuaaauuuuaugcccuaaauaaacuuucauugcauccuaucauucuucaucuggaucaauguuuuuaaagcuuuaguuuuaagcucuauuacggauuuggaccauuacucauaaauucuaacuaagacuaguacucuaugaguacaaccagccaauauauuggacagguaaacauagcaaaagaaauuugguugaagcuuugggaacuauaauagaaaagauacuuguuccuucucugcaguaauacuuagcuuguuuugaucacuuuuaucuauguaccuaucucuaaaauuuauucagucauugauuuauccauuuaacauucacugagcagcuagcuacugcaucaagguacuacacucaauauagugagagauaugguguuaagucauagauauuacucucaaaauaauuauacccuauuaguggggcauguacucaaucacugugcucaacaaaaauauaaagaaagaaaaagcaacacacaccauaacugguacugacaggacaacaaagaaauacaguagaaacuguaaaaaaaaaaaaaaaaaaaaaaggaaaaucaugauuuuggggauuaccagcuauaucuuuuuuaauagaucagaaaacuuaggaagaaucucaacucaaagucacacaauauguuacagaagaaggaggcaucauaaucugucuuaauugaagcuuaccucuuugaaacucuauuuuuuuccaccuauggauuaaaauccaggacugcauaguuuaaucucaaauuuuaacacaauuuauggugguacccugauggaggcuccagauuccugacagagaaaaacacaauccucucuagaaaaagguaauauuacuuuagguguaacaugauuccuucaaauaauuuuugaauaugauguccaaacaaaaaucaaagaaauguggugaaaagaaauauuagauuaguguaaaaguaauugugguguuugccauuaaaaguaaugguagaaaccuaaguuacuuuugcaccaacauaauaauucuucaauaauagaaccugcagaagaaacaaggaacagaaauugauccucaagaauuuagauacuagaauuuucagaugcauauuggaaauauuauguuuauuguguuugaagaaaugaagggcaaugcuuuuuuaauuggcaggaaacuggaaacuacaaaggaguguuguuacgcaguugaaaaagaacuaaacaaauuugagaauuagaaaagacaauuaccaaaguuaacauaugacugagucauuaauagauuagaaacagaugaagaaagaauucaugaauugcaauaggucagaauuaauauccagggugaaggaagaauaaacaagaggauagaaaauccuaaagcaagaauaaauagaggaggaacagaaagugagguagucugauaaucccaaguacugucaagcauauaaagaaauagaagugcuccuauuucuagaagucgaaauagaaguaggagugaauagcauucacuccugcucgauauauaaauuuacaaccauuuugaaaaauauuuugacuugucuaguagcauacagagcuacuuauauacaaguuaauauuacuugguuuuacguauuacaucaauauuuaucuaguaugaauaugcauggcuaaguccuagaaauuccacuccuuagguaugaauacaaaagaauacugggcaccaaacuauacauccaagaaugcucauagcacccuugucuguaauagcucaaauguggaaacaaucuaaaaauccaagugcccaucaacauggaaaagauaaauauauugugguacauugaugcaguggaauacuaaacagcuuaaaauugaaguuaacugaagcuguacccuaaaaugaaugaauguuuaagagaauaauuugagugaaaaaagcaauagccaaagaaagcagauuuugauuccauuuacauaacauucaaaaauggguaaauugaccauauuauuuaagaauucacacguagcuggagacaaucuaaagaaaauagaggaagugauuaucucugggugguuagacucugggaugcugggaagggucugaucagaaagaugcacuggggaggugguuucugugguaaugacaaucgucugcuuuuugcucugaguaguguuuucuggauguuacuuuacuacuuauuaauuaauguuucaugcuuuuuucuguauacauguuauauugcgauaucaaauaaggauaaaaauauguaaacugcaaacagauaauggagggcaacgaagccauauuaaagugucugcuauuuacuugacagggaauugaagauuuuguggaagggaaaugggauaguaagaaaguaauuuuaagaguagaguguagaauggauuauuacaagagaggggauuagggguccuuugcaacagcccagaugacaggagauuauggcuugugccuauuuaacauauauuuucaaagugugaguagauggcuuugagucuuccuuuauagggacagaagggaaaauaauaaaugauaaaauccugucauuaaaauucauuuuccagcaauuaguuucaaagaguauuaauaggacuugagucuaaauuggugaaaaccugucugccuauuaaaugaaaacaaauuacagguuaugauuugcugaucauuugcaugacagaugcucuaagcacaagccucagcaacuggaacaaacgaagcuuucagagaaugucugugguuuaucaaucuaaguacauuagcaugaggauccacagaccugcuuguagaaaaggguguuucaguggcugauaauuuucauauuagcaaggauuuauucacaucacuuguuggguuauuagauaauaacuucaugauucugaaucuguauucagucacuuaaaaaaucucaugauaaaugcuuaguugauuuacaacacuguuugcaacuugcagauuuugccguuaauuccuauauguuaauaacuaaguaauauuguuugcuagugauggcguuggaaaaaagcaucugacauuuuugauagguacaagcuacaagcucuacugccaaggcuuuacugagagcuguuuagagguuuuaauaugcacgacuacagaaugccaggaaggccaaaacuaagaaugagucacuggaaauucuuuauaauucugcucacauauguagcucaaagacauuaaagaaaaaagagacuauuucuuaauggcuuguuuaaaauauuuuuucccuaaaacauacuccuggcugaagcaaacaauaguugucuuuaugcauggugugagcuuauauuuugcucaaagaugacacauuccauuuugauauaugcagaauuaauggccacuguucuucuuggaaaaaccucacuuuuuuuuauagagcauaugugaguauuagaaauguucacaaguuaggaaggccaaugguauggaauuuguuaaaaggagauaucaagacaccagaauagaaaaacaaaauaaggaacagcaguagaggaagaaacaauccagguguuguaaagaaaacuaguaucugaguuucauggagagaagaaaagcagaucaucgggauaugcaaugaaaacauuuuuaaaaagagggauugcaggaagauuuuaugaaggagcaaauguuuauaaauaauacauuaaacuuagauuuuaaucuuuccuuaaauguuuuuaccagacaauaagauacaauuacaaaugauaaaaguaaauaaaaauacugucauccuaacuucuuaaauccuuacaucuucuauauuaucuuauauaucauuucuauuucuauucuguaagcaauuauuuaaauacaaauauuuuaaauugagcauaaaguuaaagcuauuauuaugcaagaugauugauuuuuaaaauaaaauauuuuauuuuagacauugcuuucaacuaaugaaauagccacaucuuagugacuuaaaggcuaaguggagaguggacaagacaauuuuuuuuguacaaaagaauuugaaagaagcauaaguugcuguaagugggaauacaaggucaccaaacacauuaggcaauuacaauaauccuaaguacccuaguucucauuuguugguucugccugacauucauuugaaaauacauuuuggagacuaagauuuuaugaaccacaugaucaaccuuuaggaacugaaaaauaccaaacucucagacugcguuuugaguaugagugcuggauaauauuuuuuguugcuuguuugguccaaguuuucauuauauuaguaaauuugacacuuaagugaaucuuacaugugucuauccacaugcaugaguaaauuauauucucuaaauauuuguugaaaguuuucuagguacaaagaacuuugcaagugcaguuaucuuaaagaaagcuaucaagaaauacauucgagauauaacauauugcagcuguaaggagugacuggcuguaccaaaugagagaagucugcaaguauuuaauggaagacuuuggcaacauuugacuucagaauggugaugauauuuacaaacacuggaguugaugaaucauauuucuguuaaaauauuauaagaaguaguaauguuaauaaaugucaacugaaacuuaugauaugacauuaucuggauauagaagcauuuaauaaauguaaacuaaagcuaauuaaauauuggaauguagcagaaagccacacaaauauuaaagauaaaaaccauauaaaacuugaaaauguuucaggauuaguggcauuucuauccaaaauaauauuacuuauagggaaauagcagaaauucagauauuuauucagucauucaaaagaguguuaaugccaggcacacacuaagaauacagcagugaacaaaacaaacaacaaacgaacauuucuauucuucuagaccuacauuuuagugggagugacagacaacaaacaaaaaaggaaauauauauauauauauauauaaaaugucagauggugaugauaggugcugugaagagaaauuaaacaaauaaugagaagaaggcauaugugagaaaugauuguaccuucaauuagaaagcaccucuguagaaacagcauucagacagaagaaagaguaaguauaaauacagcaguuaagagucucugacuuguuuaagagacagaagagacacuagcguggcuaggaccaaggaagcuagagccacauauuaggaaauaucugagaggcaauguauuuggauggggcagagcuucacuagagucuuuaggccacuaugaugaugucagcuguuacuuugacuaagauaggaagccagaugggcucugagcagaggagagacaugaucagauauauuuucacaguuuacuagacaguugacaguuacuauugacaauagacuggaagaggcaagugaagaagcugggagaucaauuaggagccuuuugcaauaaaucagaagugacuuggcaguaaaauggauuuaauaagacauaauuggauucuagguaauuuuugaagguagagcugaugaaauuuguugauauauuggaugugggguuauaagaacuuagugagaagugaugcaacaccaucucauacuuccuagaggugcucaguggaggcaucagucuuuggaagaguauuaacuucugggacuguccuugacugauuuuuaguuggaguaugugucauaauaauucuauuagaugaacuaaagcuuucaaucaauagacuaaaguccucaaggugaauguucaauauggaaccaaagacaguauucuguaaaaaccugcagcacugaauacaaaauuaacacacauucaaauuuaauggaggaaagcauuaaaauguauacuuucuuuuuuaucccuacauaauugugacuuagaauuauuuagaagagaaauauuauuuaugagaagaaaaaauaauuaaagucauaaucuuuaaagcuuaaauuuuaaaaagacaaaguuuaacagcaaccauugagggugaauuauuuauuguuuugcucucuuaacauaccuuuggggaauacaaauuaaaauaacaagaacuauuuaauuuauugcuuaucugacuggcaaggauaaaaaugaauguuaacauuuaucagcaagcaugugagaaaguagacuuucucaugcacuacuuaugugaauuaaaauugguaaaaguuuuccagaaaacaaauucacaauaaaaaagugaaagccucaaccccauaaaaaagugggcaaaggauaugaacagacacuucuauaaagaaaacauauaugugaccaauaaacauaugaaaagaagcucaacauucacugaucauuagagcaaugcgaaucaaaaccacaaugagauauuaucucacaccagucagaauggugauuacuaaaaagcugggaaacagcagaugcuggcaaggcugugaagaaauaggaacgcuuuuacacuguuggugggaguguaaauuaguucaaccauuguggaaggcaguguggcgauuccucaaggaucuagaaccagaaauaccauuugacccagcaaucucauuacuggguauuuacccauaggauuauaaaucauucuacuauaaagacacauacacacagauguuuacugcagcacuauuuacaauagcaaagacuuggaaccaacccaaaugcccaucaaugauauacugaauaaagaaaauguggcacuuacacaucguggaauacugugcagccauagcaaagaaugagaucauguccuuugcagggacauggaugaagcuggaagccaucauucucagcaaacuaacaaaugaacagacaaccaaacacuucauguucucacucauaagugggaguugaacaaugggaacacauggacacagggaggggaacaucacacacuggggccuguuagugggguaggcaaggggagggagagcauuaagacaaauaccuaaugcauguggugcuuaaacccuagaugacggguugguaggugcagcaaacuaacauggcacauguauaccuauguaacaaaccugcgcauucuacacauguauccuggaacuuaaaguaaaauaaaagaaaaagaaaaauaaaagugaaaggcuguaaauuuuuuauauuaucucaucuaauaauuguacaucuaaauaaucauaaaugagcauaaaugugcacaaguauauauuuuuaaaacguucauugcaaguuaucuaggaagaaguugaaaacaaccuaaauacgcuacaaucagagauggguuuuguuuugcuuuaagauauggggucuuguuaucuugcccagguugaagugcaauggcacaaucacggcucauuacauccucaaccuccugggcucaagcaauccugcuucaaacucuugaguagcugggaauacaggcacacacuguuaugccugguauuuuuuuuugggggggggggaugggucuuacuaugcugcccaggcuugucucaaagucuugaccucaagugauccccaaaugcuggaguuauaggcaugagccacagaacccagccuggggcuuuuuuuuuuuaagucuaucuguaugacacagcacagcacauugggcugucaacuucagugucucaaugcccugucacauaauuaucuacacagaguuggacuauaggucauuuuuuaaaaaaccaagaauagcauuuugaaguucgggauugguuuguuuuuuucuuuuuucuuuuuuuuuuuuuaauagagagauucaaaaauaucucuguaaagacauuaauuugcauuucaacauaguucagggaaugagaaauaaaacugucaacaguuagaaggcugggaauuacauacaacccuagauaaauuaauagacauuugaggcagcuguagaaauuauucacuaaguggcugaaaaaaucuacugaucacaucuguuaaaaauaucuauucacagcuggucacgguggcucaugccuguaaucccagcacuuugggaggccgaggcaggcagaucacgaggucaggaguucaagaccagccuggacaacauagugaaacucgucucuacuaaaacuacaaaaauuagccagguguaguggcaugcaccuguagucccagcuacucuggaggcugaggcgggagaaucgcuugaacccgggaggcggagguugcagugagcuaggaccacggcauugcacuccagccuaugugacagagugauagaguaagacuccgucucaaaaaaaaaaaaaucuauucaauuaaaaauacucauuugcauauugcuaaaugggaagaaaauguacaaagcuacauuuuugaauuugaaacauguguguacauguuugaaauugaaaaaaauaauagcagcaaauauucauauggaacuuaguaugugcuggguacuuuaaaaacuuuuuguguauucaugcucaauaguuuuaugaguuugggaccucaauuaccucaaauuuuauagauaaggaaauguaguuaaguuuagcuagugguagacacuaaaauauuagcaaguaacuuuugauggaagaauuauuuaugauuuugcuguuaauuuuuguuuuccauauuuucuguuuuuuugucauuaaauauagaauacuuuuuucaauaguacucguggauaaugagucugaagcaggagagagaggcuaggguuggaaauaaaaauuuguuuauaacuuucuagaaaguaaaugaagucauucaauaaaguauagugaaggccagggaugaaacucuggaagaagagaauccaaugaaggagguaaaaggaauagagaggccgggcacuguggcucacgccuguuaucccagcacuuugggaggccaaggcgggaggaucaccugaggucaggaguucgagaucagccugaccaacauggcaaaacccugucucuacuaaaaauacaaaauuagccaggcauguuggcgcaugccuguaaucccagcuacuugggagacugaggcaggagaaucacuugaacccaggagauggagguugcagugagccuagaucaugccauugcucuccaguuggggcaacaagagugaaacucugucucaaacaaacaaacaaauaaacaaaggaauagagaggucagaaucagaagauguugaagaugcaagagaggacagggcuucugggaguaaauugccaguggauuccaauggaggugagagguccaggaagguaaggucugaaagcaugcauuuaauuugucacguagaagaucaugaagacaaaaaagcaauuuguuuggagaagugaaaauagaagccaaauaucaaugauuugaggauaaaaauaaaugacaaagugaagacaacugaagagucugagacacuuacacgagaaaagaauugguagaauaaaggagauucagagcaaaagaaugcuuuuuuuuaccuugaacauauuuucaggcuacaggaaaaagcaaauaaaaacaauaaaaagcuuacuuuaugccugucaucauccuuaucacuuuacguucauuaccucauuuaguuuuuuuauuuuuugguauuguuauugucauuugcaaaggagagaacugaaacuugaggguagauaaauaauguaaaaguauauaauauaguucacauaacuugaguuagaauauugugaaauuuucuaaaccaauauugauuugauuaugguagucagucuaccuguuuuuuauaucuuugaauuugcaaaugacucugucgaucucucucuaaacuucuagagacaaguaauaaaucuguuuucagaaguaaacuguauaacacaucucugaaauauuuacucauuguuuaaucuaaaaaugcaguuuccagcuuccaagaggaaaaaaguuugaaguuacaaagcuaguaagaaagauugaaauuugaauccaaugcccucuggugcugaaguucauauucuuaaccauuaauuuagacugccuccaucaguauauggguaugcauguguguauacugcagguugcagaaacuacaugguugauaaagaacuugggguacucuuagucuuugacauggucgugucaaaaucucucucucagugugugugugccuguugcuuucucuuucucucuuucuacuauaccuaaaaaaugcuuuauaucuagaauaaaucuacuuauacuuucucuuuuuuuccaagccacacuucaacuuucaucagcauauugaaggaaucacaguuuuagcauaaagauuaaagugaaaauauuugaaaucugaucugacuuucccuuaccuaacuaaagcugacacuacccccaauacagcugcuauuaacucuccuccaagagcuuucugcuaaucccaggaaggagaucaacuacacauugaugcccuagccacacuucccuucccuuuuuuaaguugcuauaccaaucuuuaccucuggguauucaggaaacgacucauuauugagugacuucacaugcauguguagauuaaccuuuucuuuucuccuguuaaucugucuauuaucaguuaauucacaggccccuaaacauaggaaccuaaguggguagaggaaauguuuuccucccaaugguauuaagucauuuuccagagcaaagagucucuucccuaaaagauguggagagaacaagguacauaauuauuuugcuaccccuacucuauacccuuuguagacacuacccucacuauuucagccacuggccuggcugaucuaagguuuuaagaauaaggugacagguuuucuauuucuagugagaugaaugcuuucugagggauguaccuuuuucuuuugauuuuauuaugaagcacggugggaaacuuaaaagaaaagaucuccugcauagagggcagagaccuaagaguagacagcagaaaggugcugauauuuaaaagcaagaaacaaaucugcagggauuuacaaaagaauguggagacaucugaacuuaaagcuacaaaggcuuuaaguuucugugugucacaauaagcauauaaaggaauauuacuacauauuauuaagauuaauaauaaggcacauaaaaaugaccucugugccagcucuuaucaaaaggacuguggauccagacuguaguacugaauuaauuauuagcacauauauaaaaaauuaaacggagauuccuauaauuuacuggaaaauauaaagaugcauauuuuuauugcuauauuuuauugcauaauaaauugaaaagcuugaccuaaaaucagcccuuacaccuacccugccuauaagauccugcuuuccugccuagaugaaacaaaugucacuugcaagugauuaaaaaaaaaaagaaaaugagcauuaguccuauuuauucuugcauuucucagcauauguuccagcagugucaccaaauguaauauuacauguaucgaaaugcaucuuaauuccugagacguguaucgaagugcaucuucccugagacugauaaaacaaaggagggguaauuuucaaacgcuuuguuuuugaugaguguucuguuaaaaaauucuccuucacuuuuaaaacagugaaagaccuugcuuucaaaugcuaaucagcugcuucuuuauuccccaguagacuucagacuacucggccucaauacuuuuuucuugaguacuuuacugaccauggucuuggagauuacauuuggcucagaacaccauccuagcuuguuauuuuuaauugaauugcaaaguacauuacucuacauaagaaucauugggaaaauauuuagucugaauauuuuguuuucccaauucaaaaaucauaccacuagcaaugguuaaaaauaaaaaugaagaagaaggaggagaaggagaagcaggagguggaggaggaggaggaggaggagaaggaggaggaggaagaggaggaggacgaggaggaggacgaggaggaugaggaggaggaggaggaggacgaggaggaggaggaggaggaggaggaggaggagaaggaggaggaggaggaggagaccuuccaaacaugaaaaaaaaaaaauucugaaaaauuguaaaguuccuuugcucgugcuaacuuccaucaccuagagaaacugaaauuccuugcugaacaauuuuaaacaugaugcaaggaucacauauucaguuucaagcauuauggacuuuuuuguuucuauccaggcuaacauaauacuuggaaguuuaccuggagaugcugugaaaauaacaccuuaaaaccaaaaccucuguauuucgaccgaucauuaaaaaucccaaggaacauauuauaaaaaaguauauuaccuuccuuccuuugaucagcuuuuccauuucugggacuuccaugcaguauggugggucuccccuugauuaucuucccaccucccagaaggagcugaauuuuaauagcauguucacuauuccagaagcugacagaugaguaaaccagccccagauuuggaugcuuuuugaagauaucuauucucauuucagacucuccuagaguaccauguaaugcaguggauagugauuugaucaaugcuucucuauuggucaaaaccucuuacugugccuuugaaagaauccaaguuccaguuagggacuuaguuuuuucuuugguaaggcugccauggaagacugcagcauuuugggagggacaggaaaagcauaugugauuugucaaaauuuauuuucuuuugugaacugaaauccaaucaugauguugcaacuuuaagguugcuuuucucuacugagaaggaagauuuccaaaaugugaacaagaaaaacuuucugugacguuuuuucgucguuuacccaaugcuaauuuauaucagcuaugaaacagcaagaacaucaacaugcucuuggagcucagaaggggaagaugagcgugcagcuuccuaacaaaaaacuggacauuuugggaggucagggaaauauguaaaacacagaaauagcaaggugugugggaguauccuacuuuauaucuauauagauauuuagauauucaccuaaauuucuaucgaucacuacacaacucaaagauaaauacauacuuucuacauuuucuuuugaauucuugauacaauacgaucuccccaaaugaaaccuuucucaaaaaucaugugugagcucuggcgauuguucugauuccugucauucuuugcccacacuuguagaauuucucucuagcauugauggucuaguacucaggcaagauucacauuucuguaaauauuuuccugcucagcucccucuaauuuacaacauaucucaaaaaugagauaauaugcgccaaccacaucagcuuucucacccucugaucucuacuucguaaacucagugaggcugacaaguucuguuuuggauccauacuuucaugucuccaguauggaaacugccagcagcaagaaagcugggauaauuguugggaucauuuaguuguuuccaaccuuuuagguaucaaaguccauuucuaccaauugacuaaugucugaaaagguuuuuccauacuuggcucaguuuuauagccuuuuguggcaggaaauuaggccaguccuuguuagaaucaucauggcugggaguaaauuagauagauaaggauucaaugcuuauuuuuagcauauuuguaacuugaagaaguuauuuaauaacucuauccuagccauaucaauaaaauaugaaaaaaauuaauaaucuuaaagguucaguaaagacuagagaaaauacuaacaaugagauuuauuaguaagcuagaugguaauguuaucuguaagcuuuaauagcuacuaauguguuccuuuguaacucugaaauguaaaaucuauuucaguagcaucucucaaguuuuuauuuauauucauguucauuucugaagaauuuuauguggaacugguuuugucuugugauuauguugaaacuacugcauugccaaaagaugacuuaaagcuucaaggacaccuuaacauuauguuuuuguucagauggagugguacacugcauuucugaaaguauauaauguaguucauguaauuucgguuagaauauugugaaauguucuaaccaaauauugauuugauuauggaagucaaucuaccuacuguuuuuauaucuuugaauuugcaaaugacucugucaaucucuuucuaaaugucuagagacaaguaguagaucuguuuuucagaaguaaauuagauaacacaucucugaaauauuuacucauugauuagucuaagaauucagguuccagcuuccaagaggagaaaaguagggucaugcauggcuaccacauauacaauagcaauacucacacaugucugugcaacagcuaucauuucaagaauuggugugauacaaaagaauaagaaauugucaagccauugucaugcaucaauucuuauggugauuuuauuuagugagcgcugaagugaacacauauacuaugguugcucuaaauuacaucauuugcauaggccauuuuucuuuaagagucuguuuauaaaaaucauauuuuccccauucaccuaagaugaguacacucagaagaagagacaaaacaaaauauguacacaacacagagcuaugucuacugauuacacuguuucaauaauaaaaaugaguacuauuuuaccuaaacuuuacacuggaucagaguuguagcaauguuauuuuuaacuuggugaauauuauuuacaucauacaauauuaccuucauagucacagagaaauuucuuacugaauugucucuaaaggaacucuuaaaaaagagaagacaugacacauagguugcuggaauuuucuguauuucaauuucauauacuucagaaaauauuugaauuuacuuuuaggauacuuuaaauucuugauagaauaucauaucuacauacuuccgcauauacucuuucuaaugcuggauaucccuucccucuuaucuauuccuugauaaucccugcucaucuuucaagaugaauuuaaauaucauccuuuaagccuugccgacugccuuacccauaaguuggauacuucuuucaugcucucccuuaacagucugugcauaagaagaauggacacauaucacacuuuucaugugccagguucuguuagaaggucuuuguucuuugcauguacuaguuauuugaauuuuuauaacagcuuuaugagguagguaauuuauauuaucuccauuguacagaugaagaaacagaaucauagaguuuaaauaccuggccuacauucacagguaggagagguggggauuuaaacauaggcagucuggggaaccagacucucucuuuuuuaaaaaguagcuuuauucagauauaauuuacauaauauacaauucacccauccaaagugcacaauccaauagcuuuaguauauucgcaaauaugugcaaucaucauugcagucaguuuuagaacuuuauuaccagcucccccucaaaaaugccacucuuguuagcugucaucugccaaucuccaaaacuuucccagaccuaggcaaucacgaauuacuuuuugccccugugagucccuauagauuugucuauucugaacauuucacagaaaugaauucauauaauacaugauccucugugucuggcuucuuucccuuagcaugcuuucaagguucauccaugcugcacacuguuaucaacauguaauuucauucuauugccaaauaauauuccauuuuaugguauacuacauuuuauguauccauucaccaguugauagaccuuuggguuguuuccauuuuuggcugcaaucaaccaugcugcuaugagcauuugaguacaaguuuucauauggacauauguuuucauuucucuugggauuauauauacaguggaauuuguaaucauguagugacucuacuuuuaaccauuugaggaacugcuagacuguuuucugaaggagucguaccauuuuacauuccuaccagcaauguaucagcauucugauuuuucaacauccuugccaacauuuguuauuaucugucauuuugaauauagccauccuagugggcuuguagucauagcucauugugguuuugauuugcauuuccuugauggaaaacuaugcugagcaucucuucauuugcuuacugaccauuuauauaaauauaucuucauugcagaacuguucagaucuuugcccauuuuaauuuuuuuuaauuuuguuuauauuucuucauacugaguuauaauauuuuuguauaugcuaaauaucacuuaugagauauaugauuugcaauuauuuccagagaauguaaacuuuuuuguuaguguuguuuuuuguucauuucuuuuucauuuuugacaucucugcuuauuuugcuggggaguggguccauggaacuccucauuugccaccccagaagugaaacugugggaacuguguucuuaaccacaaugcuauccuguguauuuccauuguaggauuauuacauggcacuuaucauauuuuauugugacuuuaaguuuauuuuagauaucagccccuggaaauuuccucagccagaguugucauucuugccuggaguccugaaccaaacuuuauuauuuauuaacuccuccgaaggagcccucguaagacauugcugugggagccaccagagcuugcugucagcucucuucccaacuccuugcugugagggcuugcccaguagagucucuugacaaguuuacuuucccaaccccuaaccuugccuccagguucaagaggcucaaacgcugggaccucagaaaagcuugaacuuugagguagcgaugaaaauucugaaagucucuaaguagcaaacacuuggacaauguccuuagcaaaaaauuuaaggacaaugacguuucagaacuaucacuggaggcauuuguuuaguuauauauuaaaauauagagucuauuuaaagcuagccuggaaucaaacacaguuuauaugagauaauauaauugauauauaaacuucuagauauuuuugaaaaucauaauucagggugcuuuuguuuucggugguagguguuuuuugugcauuuuuccucuaggaaguaccagcuucacuggcagaagaguuccugugguccucauuagcagguuuucaaauugagguaacagugacggggccuaaaacucauuauucugcaguuuacauuuguuugucucccuuagaguccuccaaucucccacaaaaaucugaaguuugaugacaaugaauaauuagacuuuuaugaucacucaugcuuuuuuuucuuuacugaguuuacacaucauaguuuuacugcagagauaauguauguagaagcacuguucauuuugcuaccugcuuucacauaguuucauccaguuaauauaguaguaacccuuugugauugguuuuauuauuccuguuuuacagauggaaaaauugaaguucagaacagcgucuugguuuccauaaauucaaagaucaauuaagcagaaaaacuaguacgauacuaaaagucauaccuuuugacugcaaguugagugcuuuuugcagugugugccaaagcuucuuagcauagguguauuaaauagaggagacuuggugaaauaaaggcaacaaaauugugugaaguacuuugaauaaaaaaugaauuauauauuauuuauuccuuuguuaaaagguauauuaagaggaaauuaaguacauugcuuuacuucaugcugauguauauaaauaacuaaaucuaaccuaaauacuuuuuuuuuguuuuuguacaaauuaagacucuggugcccauauaucagucacaaucuccauaaaaaaaaaaaaagaaauuccaaaaagugagacuaaugauggauauuuuuuaggaaaaagaaauuacucaaaaugauaacucaguagguggcugucugcugcagccaggcaaacaauccuuccuuuggugaguugcuuagaaaaaccuaccauucucucaauagauauuuuggauauugcuuugugguaaugauucaagauaagcuaucucuguguauuuccuauuucuguguauauccuucuaugauugaggcaacaguuuuaauuuagacaguaauuuuucucauugcuauuacuguccuauguuuucuaauugguauauuuccuacugccuuuucuuuuggagguauucuuuaaaauaguuauucucuuuauguggcuucuugcccagugacguuuaacuuaacuuuccaggaauauccauuaacuuaauuuguaaaaauaccauacauuauuuaaucuaaaauguuuccuauuguaagaugugcaacuauuuuacacaucacuaauaaagacaaacauggugcuaauuacaauugcaaauagaaguugaaggaugcauccuaauuuuagagagauuaaaauaugaaaaacuauguuuuuuaauuuauaaaaugcagaaaaaucacuaucacagucuuuacuauagacuuccagucauauauuuauauaugaauucaauuuauauauugaauuauuuuuaugguaauucuaggcaaaaaaaugcucuauuguguauuuaauggagaacaacugcacugcaguuuuucaagacuauuuugagagcuuuagaagauaucuugcaagaaucaaacucccuggaugggugcgguggcucauaccuguaaucccaauacuuugggaggauuacuugaggccaggaguucaagaccagcuugggcaacauagcgagccccugucucuacgaaaaauaaauuagucaggcacgguggcaugcaccuguagucccagcuacucaggaggcugaggugggaggauuucuugagcccaggaguuugaagcuccagugagccaugaucaugccacuguacuccagccugggugaaggagugagagccugucucaauaaaaacaaacaacaaaaaaacucucuaaagucaggaucuuugacuguuuugugugaauucaugagugaauguauguuuauuaggaauguauaugucuuuuuuaaggccaaucaaaguagguaaauaagaauuacuaaucagugagcuccucccaaaugccaauuuaugguucucagauaucuuauacuuguugcagcauagcuucgcacgccuuucuuuuaauuuguaaccaauuccuuuccauuuuauuaucauauauauuaugauuauguuuauaacucaguaauguuuccaauaguguuuucaugaauuaccaugaaaacaauugaaugacuuaauuggucauuuauugcuaucuacauugcauaacucaggaaguuaaaaacgggaaaaucuucauaauuccuuuguaguaauacacuuggaccacuugguaagaaguaaagaucagugggcaaauuauggaaacaaagagauuagaagagacaccaaguaguagagacugcuuuuauuaucauucuuucuuuuccuccauuucuaagacauauuucuguggcuuuggugaugguugaauacaaagaaaucuauauaugaagaaauuuaggaaaauucuccuaaguuaucaauccaacauaugcaauccucacaucucaauaauuauaucaaauuucauuuauaccuaacaugaguccauucugauucagaaggaagauuaucagaguggcuaaggacaugguuuguggaaccaggaucucugaucuugaaauuuaugucuggcuccugcuagcuauauggaggcagaaauuuaguuaacucuuauguacccuauuuuuauccuuauaauguaauuagugccacucauaugaaauuuuauaaggauuaaauaaguuaauauauauaaccuucuuauaauagguccuaucaaaugguagaugcucguguugguuuuucucuacuuuucuucuggauucacugagggcuucacugccuuccucuguguccugaaagacuaacuuucauggucuuccuuacuuaggcucccauaaccucugacuucugguuggauuugcaguuggagaccaugaaaagagauagauaagaggagugagaucaguguaucccuuauucccaguuccucauagccugauuuugguauuggcagugauucucuuucuuuuucugcacuguagcucacuacuacuaugagugauggucucucucccauggcucuauugcuuugucuaguaauaaugcuuccucccaugccuuaucagucuucauguaagucaucuagguagguucuggugauucaacacuccuuguugauuccuuuaacacuauuuacaucuucgucaauaauaccucuauuuaacucuucaaugaaauguuugagagcaccacuuauuugcccaugggaucacaaacaguagagugcugaauuguguaguuuaaaauaaauaugaaguuauuucuuucaagucaauaaaauaucaacagucauaagaaugggaauuucaaaauuuugguaagaaaaauccauuuuauuaaccugguguaauugauaauauaaaauuucuuaagaaaagagggaguggguagagcuaagacuagauuucaguuucaauagaagaaaggaggaaauagcuucuucccauguacacauugguccuuucccuuuucucuucuggaaaguguuggacguaaauacuuggaauauaagggggugggagguugcguuuaggugacaacaucaaguugaguauagauuaaauccuaguuucaggguuuagugagguaaagccucaagauucgggaguugcuggguggggugaggggagagugguucucaguguugaguagaagaagcuugcaaggccauauaacuaagagcuagaccugaaaaggcacuuguagaaaauaaauaagaagggaaugacugguuuccauucucagaguaguuacagaaagacauaggaagcaugcaaaauuauuaaacacaaugauuguauauuguaguaauguaauaaguauaacaaccuguuacucaacuggcacccaacugauaaguccaucauagaagacuugaaaaaaaaaaaaaaaaacacugcuuccaugucuccagucacaaaaccauauucaauaucugugcagggcuaagcuugcaggaaauagagauuauuaagagucaugaaggugaaccugggguaugcagguguuaacacugugugaagugcuacuauuucaugaacaaaauagcaauuguuuuauucagccuggaaaugaauuuaacaugauuguaccuacaauccuucccaauaaaacucacuuucaccuuauucagacguaagcauuuucaacucucaagucaaacaaaauucuauagacaccucaguucucacacuuaucacaguaggacuggagacaguauaauguaucauuaagagggaagggguuaacgucuagaaucugucuuccugaauuugaauccuaacucugcuacuuacugucuguaaaaccacaaggcucagguaauacuuaccagagcaguuaccacacguagaaucgcuccuugcauguuauucuucaauuucuucuagguucauguauuuaugaacauuauacagauaguaaguagcagaguuaggauucaaauucaggaagucugauucuagaccuuaaccccuucccuuaaugauaagauauauauauauauauauacacacacacauacauguauguauuucaacuucuggaugucucaguuuccucuugagaucagaauauuaccuauuucuugagaauauugugaggacaaaauaagacaauacaugcaaaagacuuaguagaguagcuugcacauaguaaguacaguuaacacuccauauccacagguucugcaucuagacucaacuccauagauucaacaaacugaggcucaaaaauauuaggaaaaaaacccaauaaaaauaacaaaaauaaauauauaauucgguagagccacuacuuacauagcauuuacacuguauuagguauuaagaguaaucuaaaaugcuuuaaagcauaugagaggagguacauagguuauaugcaaauacuauaucauuuuauaucagaaacuuaagaauuugcagauuuugguguggggguuuccuggaaccaaugccucacagacaccaagggucaaccauauuuaaucaaucugagcuguuuuucucuaugugcaucaaccuaacaagauucuaugaauacuuugaggacaaggucuguauauuauuucucuuauauccauuacugagucuaucauauaguaauugcgaaauaacuauuugcuuaaaacugacugagguuaauuggacuuaaagauuugcuuucuuuucucaaaggaaaacaaagcacauauaccgucuuucacugcaaucaucacuggaguuuucaugcuaaucacuggaggaaagacuauuaauaauuugcuguacuuuaaauaucugucuuuuuuaauauuagugcaucaauguaaaugcauaucaauacccuuagguacauacagaagcgaauucacauuuaaguugugaaauacuuacaauuauuuaccaaaagcaauuaagcccuuuuaaaaauaauaacuaggaauaauuuaugggccacaaaaaaagaagaauaggucacucacuugaauguccuuucauagaaaauaugcacaaauccacuuuuuugacaauaaaauuacauugcauauauuuaauuuguaguaaacaauguacaaagggcagcaacugguguuauaaaauuugaugaacauccaauuagcaucaacguaucaaaaagucuuccucuccuauuuacuaauucugcaauuuaccuagcccauaggaaaaucuuuuucaaaauuaaaaacaaguagacuuuucugaagaaaaauaaaguacuaacuauggacuauuacguuuugaaacaggcuauaaacuagcacaugauuaaacacauuggaauagcaaaggagaauguaugccuucgugguuuauggcuauuuagacagagcccauuugaguauuuuacuguuuaagaauauuucuauuaacaucuuauuguauguaucuauuaggaaagaaaacuauaauguauagaauuauaacaguuaccauuuauugacuuuuuaauaaguaaaugaaauuguaacagaucuuucccagguauacaguagacucuucuuauccaugguugcucuuucaccaguuucgguuacuccucaaucagccaugguccaaaaaauauuaaaugaaaacuuccagaaauaaacaauuuauaaguuuugaauuuaacauuguucuaaguagcaugaugaaaucucacaccaucccacugacaugcccuggaugugacucaucccuuuguccagcauauccacacucuauaaccuauaagcccuacacaaugugauuguguuggaagaaaacaaaacuauccacaguuucaggcauccacugggggucuuggaaugcaucccccacagauaaagggaaacuacuguaauccuauucaacauucacagaaucacuagaugauaaguucuaucaagacagaauuauaucugucauuuuauuugucaauguucucaguaaucagcacugagccuggaauacagucgacaguagaugccuauuaaacaacagcuucccuuugaaguagguucuuacgagaaaaagauucuuaguuuguuaauauuucacuauuagagaauguacauuuuaccaaaucuaccauuguuuggcauggucaggguuauguucauuuauaguuucaauguucacuauauguugacuaucuauguucacuacaguuuuaaugaaagaaggccugagacauaccuuuacuuugucauguguagaaaacuguaggauggaaauugagccuaaaauuucuaagaaaauuccuaacacauacacuguaguuaaaagucugcaaaacugugauccugauccacguaaauugaaggcugugaaauaugaccauuaaaaaaucuuagaaagcguauuuagaauuuguuaaaaucucuuuuaagauuaugucaucaguuaauaaagaaagaaauauaggauaaaguaaccuccaaaagucaaaaccacgaggcucagauaauacuuaccagaacaguuacuacacguagaaccacuccacgcauguuauucuccaauuucuugucagucagugacccauucagaccugugacaggauuccagcaaccaagcugaaagauaagacaacuuuggucauuuuucugccugaagaacagucccaucaccucuguauagucuuuauggagaacuaugugauagcucuuagaauaauugguauggaaagaguacugcacagguuuucuuuuuaaauaggaaaugaaguuauuagauaugccauuucuugcucuuaaauaucauuauauggcacaugacaguacccaaugugcuuuaggaggcucauugaggacauuuuacuuaaugaggacuuauguauacaccaaucacucagucccaguaauguacuaauuggaaaaauaauagcacauauaacucuaacauaaugucuuuuuuaauauaucaauuacuguaaguuagauucucuaauaguuucaaugguuuuaauuugaucuuauauggcuuuuacugggaaaaaagacacuauuuuuaauaugguuagaagggcaacugcuuuuauuugaaaaaaaucauguguaugucuuuguuuucaaaguauucauagcacauaaaacaauauaauuugccuuuuuggcaguguuaucaauuugcuuggaauauuuuggcagcagccuuucccuuaaagucuugcaaugacucacugcucuuuacucacccaaauaguaguuuaauuuuaugcuguuauauaggucuuaucucuuggaauguacaaaucugagggcuaccaguuuuuaaauuacugucuauauaucugaaugggauaaaaauugaugacucucaaucaaaaauauggagaaagaaagagaugauuugacuugaauuagcagauaacuguuuacagaacaaggcuacagagagagagaauguuguaaugcacaucuugagaagaaauuuccuauuauucauccugaaagcagauccaugagccuucacauuugggaacauauuccgcaugugcacacuuaaaaauguaacagaucuuucaucauauucagagacuguuuugauuaacugaauggucauaggggcaaaugguuauuugugcuguuuccuccugaugauugugauuuauuucuuuuuauugcgguuugucuguagcuuccaaagucaucuacauacuggcuggcaagucucccccacaaauaaacaauuuaggugcuuccuauuaaaacccaaguuucccuuuaagcuccccaaaagguguuuaauuaagaaaaugaaaauguacauaauauaucuuaagagaagggaaugucacaguauaaacagcagagccagcuuuuuccuuauuaaaauaauuuggaaaaggcugcuaauuguuaguuucaacuguaaaagcacauuaaauucauacaaugauaugucauucuuaguuacauaaaaagccuaauuagaacuuagauccaauuagcaaauccaaauguguugaaagucuaauuaucaaagacauugugguccucuugccauauuuaaaacuuuacgaaauuucuuuugagcuuuucucuucugaggucaacaaaagucuaucuucaauuacauucccugaugugugcuuuuucuaauuacuuccucaagaggauuuuacuuuccuagaccaaauaauauugguggaaaaagugaucuauaacauuaagugaagagcuauuccaaugugcuuucuccacauauuacaaccauauaacuuaauuuuaagcuuaacgaauagcuuuuaagauauaaucuuguucgugguaaguaugucuaagcugccaaagcacacacaggaauuucuuuucugucccccuuaaauucgucucuuaacuuuggugaaccuauugucaguuuguguaaauaaaugacaucuauuagcaccaacuugacuguaccauuuugguguauugaguagucaaaaauaucagcaacuggauuaacagugaaaccugagccauuuguuucaacaaugcuauggacaaacauuuauaaauauauaauuuccaguuuccucagaaugauguuuucuuuuaaacauaacugaacauggucaaugguuuuauaauucuaaagcauucuaguauuuggagguuccaaacaaugacagcaaaaaagcauuugaaguagguagaauagguaaauauaucuaaucuucuaaccuaggcaaugacuuaaauauuauucauaccauguauaauauuucuuuucauuuuaaaaauguuuaauauuuggcuagacucucucauauauauuacaagacaauaauuucucuccucugcuugacaaagacuuuucaccuuucuguguucuccuuuuuuuuccgccugacucauacauccuuugauaacagcauuuguacaguuguucuucuucuuaauaacagcagucuggauuuuaggauugguaaguuccauuuacuuaguucuuccuucaaauguacaaacaaauuuuaauguuuccuaaauauuagcuguggaugucaagaguuaggaugcucaaagacugaauuugggaguaaagaauguuuaggauacagauuaucuggaaaacuagaaauaaaguacauucucuuaucacauaugauaaugggguauaacuaagaaauuauuaaggaaauaaaauaauacuuauuuccuauauugauuauguuuuugaacacuguuaaauacuuucuaugugucagccaugguacugagcuuuuuauacauguaagcuucacaaugaccauaugagaaggugcccuuaccauuauuauuuaacagacaagaaaacuaaggacuucauuaagaucacauauauacuaagagguaaaauuaguauuuaauucacuucuuuuuaaaguccagauacagcauuuuucauugagguguuguuuuauaacuuaugaaucuuuuucauaaaugugaucuauuuaagguaggaagggaagauauuucuacuuuauagucaacgacauugagacucagaauuguuaaguguuuuguuuuauacuccugggcucaagggauucucccaccucagccucccaaaaugcugggauuauagguuuaagccacagcacccagucuggauuucucauuuuaacauucuuuaauuucuguucauauccacuuaccucccugagguucauuucaagcuuuuuuguuugauuauaauaacuuuuuaaaauaauaagcaaugaaaaugaguuagauucauauagauucaaauugaauuuguaucugcaacugguaauguuucuuauugcauagcaagaaugacaggcauaguguuugauaaaaacuagaagaauuucacuuagguucaagugugaggcuuaucuaacaaguccucugguuucgaugucugaauucucauuaauuugacuucucugguuauguggaggugguuguuuuugucugcugugucuuugauuuuguuucuguuuuuuuuaacaaugaguccaagacuaguaaagagaacacacacacaaaaucucauacugucuauucagcugagugcuuccuaaauaaaaaacaauaaagauggcccuugcagcacaugagacuuagagaaagucacacugcugauggcaaaacaagauucacuaucuucaguggucuggcaaucugaagaaaauuuagacgggauaaaaaaaguaaacccaauucaauuuccuuucaauuacaguauauugauuuucuauaguauuuucugguuauugauuuccuauaguauuuucugucauuuuaagaccuuaaaaugccuagugcuuuaauuauuuccuucauuggagcuuuggcaauaauaaucuuguaacauucuguuaaaauuaauguaauaucuuguguucaacaaacuggauugauguauuugcaugagcacaguagccugcuccuaacauguguacuaaugaucaaguuuuaaauauuuacucuuucuuccucaauguuuccacuucuuauuugccaugggcuguaaggaaugacuugugacucuuggguuuuacauuauuuuucaggcaguguuauaaugucaaaaagagcugaacugcucgauuuuaauuuuaugcucaauaguuuguaggcuuuaauaacaggagucaggggagaucuuaauugaauaccaaauggaauucucuccauuuauuaacuuguauucauauggaacaaaugaagcccaucuguacgaccaaugcuccagcugccggacacaaaauauccacugcacugaggaccuaugcuaccagccacaauguuuuguuuacuugauuucucagcugagaaaaagagggaacaaaaagccauaggcaaagcagcuuaaaagccagccacuuagaaaugugcagcauuuauuugguagauauucuguaaggggauagaaaguguaaaaaauacauauggcagguugacucagauacauguuuuauagaaguaaauuggaauguuuuccacuuugacaugugaaugaaugcagugugccaguaaucucuccaaugauaauuuucuuuaugguauuuccaccugcaagauagguucaauuuguaaaauguguucccuagaggaugauuauaugcuccuaagauucuauuacuacaguuuggucauuacuauaaaguaguagucguucuugagauuauguggaauagccuuagcacuugagcuuccuucaggagaaaaugucuuugaaaagucagaaaaaaaaucacaugguucaaccacuuuuaucucccuguuucacuacugaaaacagaaccuucauacuauguaacaagaacuuguuaacugauuccuacaaaugaagaaaacaugagaaccagcauauauauacacacacauauauauacaaauauguauacauauaucuauauauagacauauuugaauaaauauauacauauauaugucuauauacacauauguauaacccauagauguuuuaugcagucauaauaaucacucuauuaucaacuagcauuuaacugauuuaaugauauccuauuuuuauagguuuuccuuucuuuuauaauucuucugguauaaaauuaccauuacacuacauuuagaggcaauauagcauaccaguucagauaagaagcucuagaagaagacugauugaguucaaguaccuguucuaacacuuacuuugcgugugcuguuggguuucaguuuucucaucucucaaaugcgaauaguaaaagugacuuccucauacaguuuuugggaccacuaacugauuuaaaauauguuaaguguuuagaaguguucaugacacacugagacuaaagaaauguuuguuauuauuuuuccuauauaaucagaauucuuuuguuccuugcucagucucauuuuucgggugacuuaguagucugagugauaaaacaugcccuuaaaacuguggcuuucaacuuuuguugacuauuagaauauuuuguugacuauuagaauggaaagcuuuaaaaaauucugaugcuccauccaaaccccaggacaauuaagucagaauccccaggaguauaaccaaggcaucaguaguuuaaaagccuuuccagguaauuccaauguauagccaagguugaaaaccacugcccuaaaacuugcuucaggcugggugcgguggcucacgccuguagucccaacacuuugggaggccaaggcggguagaucaccuaaggucaggaguucaagaccagccuggccaacauggugaaaccccgucucuacuaaaaauacaaaaaucagccaggugugguggcacaugccuguaaucccagcuacuuggggggcugaggcgggagaauugcuugaaccugggagauggagguugccgugagccgagggugccacugcacuccagccuaggcaacagagcaagacugucucaaaaaaagaaaaaaaaaagaaaaaaaaaaacuugcuucaacacacagggaaugcaaacucauagaauggcuacuuaaccucuuuuaauaaagucauuauuuugacugguuuccuuugugaaagcuaacuagggauauugucucaaguaaacuauuuuuuauaauaaauaugauaugaaccuauaaacuaugugccagaaugaugacuaccuuguccacaguuguacuccuagcucuuaucauaguauuguuguauugguacauggcagauuugaauaaacaaauccaugauuuaaaacuccugcuguccucuuuauucuucuuucuuuuugguucuccaguucaagcugaaugaaaaaccaaaauguuuccaacuagacaccguguccuaauaugauguuguaucccugagaguuuucaugauucuucggggucauuccccucccucaaauucuauuagcuuuccuuuucuaucagaucacaauauuauuauuuuuucuaauaauauuuuagcauuuaauuauuacaaccugauaaaaguugcuggauuuucuucucuucuauuccauucuaccuugagacauuuuaagauguucauuuuaaaaucacauuaaauucucacugucuuuccuaucuccuccauuaaauaauuaaccacuuaaggucauggguaccaucugaaucauuuuucugucuauuacagugccuuuuaccauguuuuguaccaguaaaguaauuuuuaugaaacugacaagguuaguguaaagcaucucuauugcaauuuagaucuuuacuccuaaacaauaaaaaucucaagcucagcaaucuccuuauauuucacuaucacuucacugucucugcuuagauaccucaaagggagcucagauaucucuaagauuaagcucacuaucuaucccuacuaucagcucagucccacuagccaaaaaucaagcugucagucucaccaccucucagauccaauccuuugcccagcucugccaauuucaccucuuuaaaaaugucuccugaaucuauuuaacucguuccuuccuaccauccuagccgaagcuaauuucauagcuucucuuuacagucuuucuuugcaaacauaaauucugagauuauaacaucugcuuaaagucuuuccauaguuuuccaguauucucaagauaaaggccaaacuuuggauguggccuaccagaauuugcaugauuuguuauuauuuauauucaucaauucaugucauaaugccuucccucucauucuuugaauucaaaucauaugagucuuccuacgguuucuugaguaaggcauaacccuccuaccuugaaaauuuaaacauuguuucuaaagcacugacuaaagcuuaucagaaccgcuaggggaguuauaaaaaaagaucccgacaccaaagccacaccccaugccaaugaaaucagaaucugggcaugaaaucuaggcaucaguauuguguaaaguuaugaagaugauuccaaaguagagccaaaugugagaaucagugguuuugaauauacaguuuuccuugacuggaacaaucuuaagacaccugcaauucuuuaaugaauuaguaaaguaauuuuuccucauccuuuagaucucaauauaaacaccuguaguuugggguaaacucuccuugaucuccugcccccaccccaggcuaccucauaucacuguaauauagaaucauguuccucucuuuuacaguaauauuguaguuaaguuuuuuaaauauauauuuuguaugauaauauuuauugcagcaauuaucuauaaauuuccacguguucaagaaaaauuacuguuuuguuuccucuucccauuuauuaaauacauaauuauuggcacaaagugagacuucaauuuuuauuggauacuaaacaaauuuagaugauuuuuaaacaagaaccuuaauacacauuaaagugauuguacaucauuucuuucuuuuuuuuuuuuuuuuugagacagagucuugcucuguugcccagacuggagugcaguggcauuaucucggcucacuucggccucggccucccagguucaagcgauucucuugccucagccugccgaguaguugggauuacaggcacacaccaccauaccuggcuaauuuuuguauuuuuaguagagaugggguuccacuguguuggccaggcuggucucaaacuccugaccucaggugauccacccaccuuggccucccaaagugcugggauuacaagcaucagccaccgcgccuggccuguacaucauuucuuauaugaugcuuuaaguaaguaucucaauacauagccaacacuguguuaccagcuaucagcugagauuuuucccccuuuuaaauuuagauggugaauuuccaacugucuuucuuccugagagcagaaagguuaaacucuguauaguaaagaccaaggaacauuuuucaaaagccuucaguaugaggaauaaugauauuaccuaacucuggagagaauaaaauaaguuguuuuauuggagcuauaaucugaacaguuauauacaagcaaccauagcuauaguaauaauaagaguaauaccuaaucuauguuagauacuuuucaucuauauuauaucucacuugaaagagaaccaccaacauacaaaugaaauauaaacuguugaaacuuuugggaggauuucuccuagaaauccucucaaggaauccagcuccaagucaaaaaccucuguaugauuuugcccugcccuaggcaauacaaaggcuuugccugggaggccuucacagaggaaagcuucccuccccaaacugacuugcacagacaaugugcugcagugucugacgggaguugcagucaaggacuuaggaccccuggccagccauguuuuauacauauuugcauucuuagcccaggagccuccauucagaggcuucuuuacuggggacucugagaugaaccuuuccaggagccucugccaagaccugcuuguugggaggaguggguacccuggaggacacuuuucuccauucugacuuaguacuugguacuuucccauuccuagaucuuccccuugcuucuucuccugcccuuagguccauaaaaccauaggaacuuuuuguuugggguucccugagcaguaagacaguuauccaaaacuguacuaaugcaucugacccuugcguggugccauuuguagggaaaaugaaacacaggugaagcuggcacuuucuuucuggacucuugauuauacuaucacaguaaguggaauaaaagcuuaaucguuacuuucauuuuggcuuguugucuuacugaauacucccacaucuggcagcucagcccuccccagcucagcucaauucuuaacaucuccuauuuaauaauggugguuuauauuuacugaagacuuauauuuaugaggcagguauugugccagucauuagauauuauuuaaucuuuuuuugcuauaauccugucagaauuauccugauaugauuauaauuaugcuaauuuuaacagauguggaaauugagaauuagagggauuaauuuaccuguuccaggcuacucagcuaacaaaugacauagcuaggauuugaacacaggcaguguagcucuagaaacugcugucauuuuuuaccucaaucaaugagacacuauuucagagaggaauuagagcaagggucaugcagacagccuuaauaguuuugagcgcucacuucucaaguucagcuuuguguuuugggguccuugagaaaacacauuuuuuuuuuaauaauaaacccuucuguuuugcuucaacuauucaaacuugguuucuuucacaugagcucaaaaauuuauaucuaacauauauggacaguaugguagauuuugugaauacauaucuaacucaacauagagaaaggaagauauuuuugaaagacagauaaagaaguaaagaacauuaggaugggugguuagauuuuauuuucaguaaaaucaguuuuuuaaaaaccuuaguuucucgaucugaaaaugaaaugguuuguuaaugaaaagaauucuacacucaaaacucacagcuuauuagugguuggguuuauuuugugaauuuuuuuuuauauuaucagaaaaccaauguaaaauauauaaacauugauguaaguauuauuauuaguaaggauuaaugauauuuauaaaggggaagcuuacgaaauaacuuauguccccuacuagacugcaaguuccauaggcaaagaucuuugccucuucuauucacugacguauggcaagcacauggaacaggccuaguauacaauucacacacaaugaaaauuuauugcaugaauaaauggcucuuauuuuucucaaagaaagaacuaagucucagcagcauagaggaguuuuguggcaugcagguuuuauuucaagaugaggaauaaaucaguuagucucauaaaaugucuagcuuggugauucuacaauuguuuaauaugauuggguucacaccaagagucaucccuaugaugaacaagagaggguuucuuauucagguuuucuaaauuacucucgcuagagauaguacaaucaaccauugcaaucaguuuaucugaugcuaagaccgacaugacacuugucuaggucacuguaugauucuuccuuuccagcucucuugcuaucagaugccuugcucuugcugaaaaugugcauggaguucuuggguuucauugguaacuaugaaucaucagaugaggaaguaugccucugaguauuuuuaucaacuuugaagagaauuuuuauuuuauugcagaguauuccaaacauuuaaacaauugaaacucccauaaaucauuaacucaacaggcauguugaaaaugcuagcauacuucaaaaagagucauuuuuuccuuguggauuuauguguucuucuaauuacucuuuuguuaauccuccuaaauaugcuucccauaucuguguccauucacaacucuuagcuauaaccauauauguaagauaagcaugagaaagucaggcguauuuuaaaaaggaggucaguacuaagugauugauaugcagcaagaaauaaugcagugcaugauaugcagcaagaaacaaucuaguggauaauaauacaaccaccgugcauuaguguaaauacaucauucucccaccacuuaaaauuuauaauuaagaagacaguuauuuauuaaauaccuacuaugcugguuuuacgggguacaaggaaauauagaacaucaucuuuaaccuccaagaguuugugauuguuuuugaaaugacaaaacaggaaaaaauuuuuaaugacaacaaauuccacuaggcagcauaugacuaauucccaaaugacugauauaaauaauaagugcugaguguuuuacaaaggagauauuugugagaaaggaucagaugucaucaaagaaaaugauaagaaaaagcagagcacugugugguagucugccugcaagauggccacagauaauuccuccuaucccugugcacacauaccauucuucuuucaagagauggaguccacuucccuaauauuguugcgcuccaaaauucauauguuggaacucaauuguauuaaagauuuaagaaggugauuaauucacgaggguucuucccucaugaauaggauuagcucccuuauaaaaugaacugaaggaaguugccuuccccuuuggccaugugaggauacuguucaccccuucugcaagaugugccgucuacgaagcagagagcaagccuucaccagguauugaaucugcugaugccuugacuucucagccucuagaacucugagaaauaaauuacuacuauuuaugaauuacccaaacuaagguauuuuauuauagaagcucaaaaggucuaagacagccccuuuucuugaaucugaguuugcucugugaguuuucuccaguaaaauguggcagaagugaugacauaugauuugguggcaugaaucuuaagagaucucacagguuuucucuucucauuuuuggaagccaaucaagugaaaaagaaauaaagaaauaaaaaaaggcugguccagagcaggggaaaaccaaaguugugagugagaugugagcuguguaggggguaguggcauccccauccagaggacauuucucacagccauaguccacuaacaacaaaaauuagaauuacagcugguucuccccagcuuucaaggagagaaacaagauuagaaaggaagauuuugggaagcuggcaaaauagaaagcaccagaaaucugucuccccauguaggcaacaacugcacuggcagaaucuaucugauauaaauauucuggaguucuggagucuauugaaggcuugaaacuuccaguggaaagcuuauaaggaaaauuaugguuacuuuugaucaauuuaagcucuuaaaacaguagcagcuaccuauccugacccuuaguccaauggcaggcagccaugaauauguuucaggagcaacuuacaugcaguucacaaaagccagcaugggcaaaaggaauguuauaauccaaauauuggagaucugugcucugauugcuuacugcugcuucuaaucacggacuuguagacgaagggcuagguagucacuguuguugcaccuccccuccauuguugcacaccccuaccccucuggcugaaguaauuuccaggggauuuaaauggccagugccugcuugccaccuucauuuuucucuuuuccucuuuuuggagguagacauuaaauacuaagacauuuaaaagcaaccacauacacacgggaaauuagaaaguugcuguguaugcccagggaaaggugcaggcucaaaagagacuugagaagaccuuaaauuuacguacaucucagauugauccuuugcacagagacagucuagucuacaacauuuagaacaaaaggggaaaaccuaggaaauuucuccuaggaaaaccuaggagaaauaaguacaaucugauugccggaguuacuacauuacuacagucacaugucuaauuuucaacaaaaaaaaauuauaaggcauccaaagaaacaggaaagaauggcucauuuaaaaauaaaauaaaauaagccaacagaaacugucacugaaaaagacaugaugggggaccuacuggacaacuguaauaaaacaacuguaauaaagaugcucaaagaacuaaaagaaaaguagaggaaaucaagaaauaauacaugaauaaauuauaaacguccauaaagagauagaaaacuuaaaaguagaaagaaauuuuguagcuaaaaaguacaagugaaaugaaaaaaauuugccagagauuuucaaagguagauuuaagcagccagaagaaagacucagcaaauguaaagagaagaccaugggaauuaucaauccaaggaacagaaagaaaaaagauuaaagaaaagugaacagagaauaaggaaccauugguacaccaucaaguggacaaacagaugcauuauggaguccauaagaagacagagaaaagaagagaggauauuugaagccauaauggccaaaacucccaaauauaacaaagaauaugaauauaaacauuuaagaagcucaguaaacucuaaauacaaugagcucagagauccacauuaucaaccuuugaaaugaugaagacaaaaaagagaauaucaaaaacaucaaaagagaagugauuaaucacauacaagggauuuuugauaaaauuauaagcauauaucuuaucagaaauuuuggaaaccauaaagaaaugggccaauauauacaaagugcuaagagaaaauaaaccugucaagcaagaauccuauaucuggcaaaaauuuccuucaaacuaagggagacauuaaggcauuucuagguauacaaaaguugagaggaguuuguuaacacuagacuugucuggaagaaacguuaaugugaguucugaagauggaaauaaaaauacacuauacaauaauuugaagucauauaugaagaaauaaauaucacaguaaagguaaguauauggacaauuauaaaagcuacuauuauuguaacaaugguuuaauucaagaaacugauauauuuaaaaauuauuaguuuuuguuuuuggaccugcaauguguaaagguguaguuuuaggacaucagcaaccaaaagaaguggguauggaaauguaaaagagagaguuuuguguauuauuggaguuaaacuggcauaaaucuaaauaagaguguuauaacuguaggauguuaaauguaauagcuauagaaaauauacaaaagucaaugacauagauacauaaacauuucauuacaauaaucaacuaaacacaaaagaagacagucacgcaggaagcaagggacaaaaaugcuauaagccauauagaaaacaaguuuuuaaaugacagaaguaagucucuccuuaucagucagccuuacaaaggauagaaauacuacaacauggaugaaccuugaggacauuaugcuaagugaaaugaaucagucacaaaauaacaaauaccuuaugauuccacuuaacauaaguuucuugaaauggucaaaaucauagaaacagaaagaauagcaguugccacgggcuggacagagagggaaauggggaaucauuguuuacuaaguauagaguuucaguuuugcaugaugaaaggaguuuugaaaauagaugggugaugauggaugcaaaggaauauaaauguacuuauuaucauugaacuguacacuuaaaauguuuaagaugguauauuuuauauguguauuuuaccacaauaaaauuuuuuuuaaaggcugggguagaauauugaguaauuagaggcuauguggagagaaaaggguaacuaaagcaccucagccaacagccaggaccaaagccccagacaugcaaaugauaccaucuucaauccucuuacccuaauugaacuaucccagugagcgccauguagaacagagguaagcuauccccacugaauccugccugaauaucagauccgcaggaaccuuaguaauaaaacaguuguuuuaagacaauaugcuuuagaguauuuuguuaugugguauuucaucauugaaacacauggcuugucaauggucaaugaacagucaaugguagccuuugccucugaaauugaucagacaucuaaggcuucuauuaguaagaaguuguacauauaugagggauauucucuuguuuucucaagacuuucuuuuauaucuuaaaacuuuuccuuuuuaaaugcaaaauguuucccaacugcaacucagauagacauuucuguaugcacuugcauuuuguggaauuucaauuuuccuaauugaaauugaaaauuaucuaugcuuuggaaaauaaggcaaacuagaucacgacuugcuuucaauggcugccauaacaaacugccccaaagucaucugcuuaaacaucaaaaaauuauucucuccaaguuccagaggacagauaugaaaucaaaguauuugcagggcucuauccaaaggcucuaggggaaaaucuuucauugucuuuuccagcuucucuugguuccaagcauucuuugaccuguggcugcauaacuucaaucucugucuccauuuucacauggcugucuccucuuccuuuucuguuuuaaauccccguaugucuuucucuaauaaagauacuugccauuagauuuggagcccacucagauauuccauaacgaucucaucuugaaauucuuuacaauuauaucugcaaagauaucuuuucccuauuugaucacauuuacauguuccagggauuaguucauggacauacuuuuuguuuuucgcaggguugggcaccauuuaacuuacuacagaucacaauuuauaaauucucauuuuagugucaagcuuuuuaugaggucuguuaaguuaaaacacuaucuauuuggggaaauggguaguuuuaugggauccaaauccaauggggagaauugaugcuuuguguaucucaauugacuagaauguauucaaauuagaauagagaaaguacuuaccaaacuguuguugaguuugcaucucucaaauaaguaucucacuguacuuauuauuugaaauauuauccugggcuucagucacuuuaccuguuucucccaguagaauuuugagcuuugugauggcugaaucaucuuuuuaucaccauaucuccagcacuuuuguaugcaaucgaccauucauaagucauucugauucaaaguauuuuauuuugcgcaauauguuguaauuaguuuaauaaauauguagcgggauuauuaucccuuagacauuuauggcugagauacugagaugcauuuccaaucuaccuuuuaaucugcuaaaugguaggaaaagaucucuccccuuuuugcuccagucuacguuugacuuucuaaagucaaguguagagaauggaagggacagcauaagcuaggugugauuacauacagucagagacauacguaguaaaaucagagggagcaaaagugcaacccuccucaaauauuuucaaaaaacuuuuaaaaucuauauuuuaccaauauauuaauucaguuaacauguugcuuguuacuuauucuauauuuaaauauauuacuugucuuauugauaauagcaaguaaagugacggaauaaacuugauuagauaauacaguuuagcugaaaguuggucauauuugguuuauaauaaagccuuacuaugaaaacacaauucuuuuucauagaguuugcuuaguggcaaaucauauccucuauaugaaguauauagauuucuuaaggcauguuuuauuaauguagagaauaaaaaaacagguaucacucuugucuugccaaugguaauuuagaucacagguuacugaagauaaaaucauuaaucaaucuuggaccucuauauacagcaggaauuauccaagggauaauagaggaaguuuuguacagggauguucuauccaaccaaaaaaauaauuuucaguugggacaucauucaagaaguuauuccucccagcaaaaacaaacuguaaccuuucuccaaagucacagcagaauagagcaccagaugcacaaagguuuuaagccaaauaauaaagacauagauucagaaaagacacuugggcaauaucagaaaauuuggaauaaaaauuuggaaucuuaagagaucaaaaacaggaccguucucuaagcuaaucuuacugagaaguaucucuaguuccuuaauaaauauccacuuaaauaucaauagcagaaucccaucacagguguuuauaaaguuugugaaccauauaauaaaauguaugagauuuuauuauaauugugguuuacuuacccaauaauuuccuguaauaaauuaauaaaauccagaguaaaugaaccugggagaagcugauuaacuuguaauaacaauuacggaaucuuuacuagaaaaaacagauaugcaccuuuccuuauaggauauagauuuaacaagguugauuucccaggaauauuuacucaaucauuauaauagaccuuucuguguaaucuguuagcagugcugauauuagcugcauuacuuuauguggaaaccauuuuggggauucauugaaaucuaaauuuaaguuuaagaauuauuaauuugguuaaaguaagauuuauucuaggaauuuaaacauauuaaauuauuuucagagcagacaggcauauaaaaauaggauuaaaguuuuguugaagguauaaauuuuuugaaacagucauuguaacuaucauuuuuggagggcucaugacacaccuggaacuguacugaggauuugcauucauuguuuucaacaaaguccuaugagcuuugaucuguuaaauuaaaccuuauaaaauuagugacauuuuacaauuuuuugacguaaaaguugaaauuauaaaauauagacauaagucaagauauacauguagaaucauuuuaucuuaguuucuauucuuauucuuuuauuacacaaucagaagauucauuuuuuuuuuccagaaugcuuuuuaaaaugccagguuacuguagcaaguaaaguaaaaacugucaauuuugagacucauuuugauucuggcagagauguucucuaauccagagggaaaagacucuugaaaaacuucaaacaucaucucaauccucagaaguguuauuauaauauuuuauucagucaaauuaacagcuggauuggacauauuuugaaauauauuugguacaagaggguaaaaaaugacaagcacuauugugugaagucuaaacuuauugagcugaacacgaucagagcaacuucuggacagguuaucacaggugacuagaauacugugcuaauguggguggcaucaaaguuuaauaaucagagaagguaguuagucugccaagccgaaacccuguccuucaaccagagccugcucuccuaaccucagcuagcucuccagugcacccaauuaaccuuacaaggaaaacucaagaggcagccugauugacucaucaaagcucaucauaacucaggcaaaacaacuaaaaagacauaucuucuuuuagugaacauuuacaaaguuuaaaauaccaauauaaagcuuuuucaacuuuucaguauaaaaauuuucaaauauauaaauagaauaaaauuauaaacucaaauauucaucauccuacugaaacaauuaucaacucauuaucaaugaguuauuuauuuaugcgccuacucuuucuugccccuacuuuggucagauuugauuugaaacaaauggcagacauuauacaauauuauuucuauucugguauauaucucuaaaaguuaagaaguccuuuaaaacauaaucaugacaccauuaucauacuucccaagauuuagaauaauuuauuuuuauuuuuaguucaugugcagguacaugugcaggaugugcagguuuguuacaaagguaaaugugugcaaagguguuuugcugcacuuaucaacccaucacccagguauuaagcccaguaugcauuaguuauuuuuccuaaugcucucccucucugcacuccaccccggggaaggccccaguguguguuguuccccuuucuguguccauguguucucguuguucagcucccacuuauaagugagaacauguggcauuugguuuucuguuucuguguuaguuugcugaggauaauggcuuccagcuucauccacgucccugaaaaggacaugaucucauuccuuuucauagcugcacaguuagaauaguuucucagugucaucaaauaaccagucaguauuaaaauuuucuuucuuuacucaaauuaggaccuauguuuuaugaguucauguguaucuugaauugcuuuauuuauggguucuccauucaucuaucuucauuuguuccuucaauuauaugucacaaaaugggucauuuuuuuuuucuguaguuucccgagcuagauugugcugucugaaucccccauauccacaucuugcucuguggauugcauuauuugcaaauugguaaaucuagaagauugaccuaauucagcuuaauauuugucaauaauuuuguguuguauacuuuaaacagcagguguauaauguuugucuccuuuuuuuguagucauacgauccgucauugauuucagguaugacuuccauucauuuaaugagcugaauuguguuuccccaaauuuagguguugacgcccuaacccccaguaccucacaaugcauuugaagauagggucuuuaaagaagauaauuaugguuaagugagaucauaugggugggcccaaaacuaaucagacuguuguaguuacaggaagaggagauuagaccauaaagagagccaucgggugcaaagaagaccauguuaggacacagggaaaaguuggccaucugcaagcugaagagagaggccucagggaaaacccaauccacuggcaccuugcuuuugaacucccagucaaauuuuugucguuucagccacuuggucuguggaauuuuguuacaguagccucuacaaacuaauauaauuagugauggccaaauguucauguuuuacuuuuaccauuucuucuucauucaugugcugaaauauuugaauaaagaaaaaccuuuucuucaguaauuauuugauuaaccugagguagaguuuguuuucacacaaaaaauaaaucgguauucuacagcauccuccaaaaagguguaacucauguuuuaaacauugcaugguaacucacacuucaaacaagugugauggugaaauagcaagugcucuggcuuccucccuuaaaaucaacacuggggaaacugcagagggaaacauacauuccagagaccuacacaacaucacagugaaaaacuccuggccaggcgcgguggcucacaccuguaaucccagcacuuugggaaaaugaagugggcagauuaugaggucaggaguucaagaccagccuggccaacauggugaaaccccaucucuacuaaaaauacaaaaauuagccgggcgugguggugagugccuguaaucccagcuacucgggaggcugaggcaggagaaucacuugaacccgggaggcagagcuugcagcgagacaagauccuguacugcacuucagccugggcgauagagugagauucugucucaaaaaaaaaaaaaaaaagggaaaaaaagaaaaacucccauggaggguaaagauacucuaaaguggcagcuuagaguauguuuggcugcagucuggguagaggcaacggaaagcugcagugauggauuagguuacgguuuaugaaauucagcucuugcccuuuccauguguugcuuuggaaugccauucccugguccuucccuguacaaaucuaauguuguuacccaaagcauugauuaauguauuggggcaaggcagaguuaagaauaauagagaagcacuaaaauucuuuugggaaaugaaauugaaagaagcagagacaggucgauugacuuuagucccaacugauuagaaagaaacuaguaaaauuuacuggaaaauaaauguagggaacgugcaaaauuuacacacuuuuaaugacagcuaacuccuaaccacacaccuuccuucguucucuuucauauaguugugaggaaaauuuugucacaaauaucuacaauaugauuuuaucuucuaggaauguauucauauaaacaggaugaaaccaccaauuucugguuaaucuccagaaagaagaauguagcuagggaugcauuuggaggagagcucuaugggggggauuucaacugacuuaaauuguuaaaauuauauacuuauuuaaaagcgguuaaacaaauaagcaaaaauaagauaccagcuggcaaaacucaaaugauuaguuacaauauacuaaccaaauaaguauugaccuggcugcacuuccaucccuauaguuuagaauaaguacaauuucuuacuguaccauuuccucagccuauccaccaauuauuccuuuguaacugauugauaacaugaaguguuauuaagcuugaaacaacugggauacuguaaacaccccugcuauugcuguuuccucacaugugcuccaucauuauccugcacugauuuugaaauugugaaguguuuaaucaaaacaugccauacugauugcaaccugaaucugaagagcuaauaugacauauuauugccuuuuuuagguacaaagaaaaacacauuuuauaaaugauaucauuuaaaaugaauuuucuucaucuacaugacaacaucuguuggaguuauaaugaccuaacuugacagugcaaucuaccugucuuaggcauuuaaguggaaaguggcauauaacagaugcaugcugcguuuuaaaccaagaauuggcauggaaacuacaauguaccacuuaagacaacacauacuaguaucaauauacccuaauaagccuucuguaguguagaucaaucuuuggaaauuuagcacuuauuucaaguauuuccuugcaaauacuuuuauuauuucagcaaaagcaccuugcuacauacuguagcagccuuucccggcuggcauuucucauuggaacuagaaacaacaaaaaugauuucagugaccauuuucccaguucucccaagaauggcacauagccacuaccugucaagaugcauaggagagaaguuaauuaaucacauacaguggcugcuuuagguauuaaggcuucauucucuguauuagcaaggaugcuggggauaacuauuacagcaaagauucaguuacaaaugaauucauacucucuauuucaguuccuguuccaggaaaacaaacaugauacauuaauuuuaaaaaggcacuuuggguuauaaagauauauaaaauaugauucuugucuaugggugauaacaucuuguuggagaggcaauaaauaagaauaagauaaucaguaguaagaccacaguauacauauuuguacuauacacugauauaaauggucacuauauuguaauaugaaguaauuaaauugguaaaucacauuaccuucugccacuguagaaacuaaagagauauuuuuuucuagguuguccuggaaaaaaaaaacuuagagaacagaagguauuuaaacuaaaagaagagagaggauaacaaaagauggcagaaaaauucuaguuugaggaacagcacaagcaaaaacauauauuuaagagugauaaauauuagcaaguucugagguaagggagaaauuaaagggccagcaaauaguuccuguggggaaaugauaggaaauaagacugaauaaaggagguagguaaagauuguaaaggccucugacagcuuaggagauggguugaagacuugaaaucugagacugagacuuuuaaagugaacaccuguauccaccaccaagcuuaaaaaggaacaugaugguucacuguugguuaugggcaaaggaguaauauagauacccacaaaaguauuaucuacuuauauauugcacaucuaucuaguggcuagcacugcugagagugauacauauguuguacauauuuucauaauuaucuuacaaguugggcauuaguagugagacucucagaaguuacuaucuucucacagucauauaacugguaucugguauauauacuauuguauugugcuuaagaucugucugauuccaaugcuauuaaagcacauauccaugauggaagcaauguuuauggaaaauuaguuuggaugccgaguggaaaauagacagugaaaaaugguuucugugccucuaaugucuacaagacacuagagacacagaaaccauuuaggagucaauuaaaugaguccucccagggaucguaaaaacaaagagggaggcccagaaaaaagagaaaagaaggaggaagcaaugagaagcuuaagggguagagaauaauaagcaaaagcaggacacaauaucuuggaauacaagaaaggagaaaccaacauggggacauuguaguagucagggaaauugaauagagugaagagguagaauaauaauaaaaguguucuuacuauaaucccuacugucauuugugcauauguaguuacauuuuccuggaaaguccucucugucuuuucaaauuguuauguuccuugaagacccaauucaaaauuaacuuuguggugugaaaaauuucuuugccauuccuuagaaggaauaauuauuccugagauacuuaauauuugauauguauuacuauuuuauuguuaccuuuguuuacuugugugucuuuaauacuauuauaaugaggucuuugaagcagaggcuauucuuacaucuacaucaaaauauaaaguguauauguacuuuuuaauuacaaaagaaauaguggugggucaggggcaguggcucacgccuguaaucccagcacuuugggaggccgaggcuggcagaucaugaggucaagaguuugagaccagccuggccaacaugguaaaaccccgucucuacuaagaauacaaaaauuagccgggugugguggugggugccuguaaucccagcuacucaggaggcugaggcagaagaaucacuugaaccuuggaggcggaaguugcagugagccaagaucaugccacugcgcuccagccugggcaacacagcaagacuccaucuccaaaaaaaaaaaaaaaaaaaaaaagaaauagugauuauguauauaccaauauacagaaaaagaaaagcacaugugauguauggaguauuuucauccagucucuuaaaaauauauaauuuauuuuuccuaguuugaauuguaacauuauuuugcaugugaaucuaauccugaaagaucagacauguucaucuucugaccagaguaauugguucaaagaaauguaagugguccaacgaaggccaguuagagccuucccuucauccauuagauauuuucuggaacgauugaguaaaaggcuucacucuuucccugagacuguuaaauaugaguacaguaucuagaauaauagucuuguuaccacaugaguagaaucugccugagagggaaaacaaaacaaaaaaaaaaggaauaacagaacacaguaauggcuaaacaugggcaguucccuaauggcauugcuugagcaucugaauguaacuguaccuggugccugcuggucucuuaggcuuaacaauuauaucauauagcaggaaucuuuuuacuuaaacuuggcauuaguuuacuucaagcaacccuaauagucucaacaaauaugauuuccuuugccuuuaaucuuaaacccuaauuuuuuaacaauucuauuuugggauuuuuagccuuugugcagugccuacagugacauaauaaguucuuucugaauaaacgauucaaugcaucuuucucucuuacaauggagugucuccauauugaguuccugguccuagaaguauuuugcuuaauuuguuaacuaugauuauaaaacagauauagguaaaucgugccauuuaaauguaucaaugacuuuaauuuacaguaauuuaguucaucagaaguuuaugagcauuugcuaugugucaagaaccaugcaaacaacuaggagauguaaagauagauaagacccaguucugucuucaagguggucauagucuaaaaaacaaaucacacagggaaaauaaacacgaucgcauaugaugcacacaguaauagaguuacauguaaggagcuaugaagauguguaaggaucagggaaaacuauagagaaaauauaauaguuggccaaguuuuaauagcugugcaaaaaaagagaaaaccuuaaagcagaaaaaagagggaagaacacucugaucucaaaaaauaacaugagcaaaugcaguuuaugauuauuuucaagaaacagugaacaauucugugugacugcaauaucaaggaacugugugugcgugugugugugugugcgugugugugugugucucugugugcguguuugugugugcgugugugugugugccugugugugcguguuuguguguguuuguguguguguguuuguguguguuuguguguguguaugucuguguguguaguauuaugaagcaaggagaggaauguuaagugauaaaucugcagacaaggacagggaucggaaauuuaagaagaagcauugcaugcucuuaaaaccagguugcuuuuccuuuauguaucugaaagcuagacagauuuuuaaguagagaacacaagaaagucuguguuuugaaaauauguguaucuacuguuuguauggaaggagaaggauagcaucaaggauuaaaaacagaacaucaaguagaagaccauagcccuuggauaaauugggcuuaaccuaagggaauuucagugaggauuagaaggaagggggaucauuuaaggccucuuucagagacagagucaauaaggcuucagugccaaacuggggagaucuugaggacaaugugcacugggaauaugacuguaugaagccuaaccugcaacaaauaauuaaucacauuuucaaaacugucuuuuccuaaaguggaaaacagcuucauuguguuacagaugcucuuuauauuuguaaaauaauuagaagagaaagagauggcccuguguauauauuaaugcagcaauagaaaccuaauuuugagccuggcacaguggcuuauaccuguaaucccagcaguuugggaggccaaggcaggaggauugcuagaucucaggaguuuuagaccagccuggucaacacagagagacccugucucuacaaaaaaaugaaauauuagcugugugugguggcaugcaccuguccucuaaacuacuugggaggcugagguggaaagaucgcuugaaacugggagugugaugcugcagugagccaugacuguccacugcacuccagccuugacaacagagcaagacccugucucaaagaaaaaagaaaccuauuuuaagcugcuuguuagaaaaugcuuuuguaguagguuaaaucauggucacccagagauauuaaauccuaaaauuuggaaacaaacguugcuuuauuuggaaaaaggaucuuugcagauauaauuauguuaaguauugagaggggagaguguucuagauuacaugaauaugcacuaaacccaaugacaacuguuuguuuaagacuaugguagagggagauuugucagacagaagaggaggcaacauggccauggaggcagagauuggagugauguugccacaaaucaaagaaugcugacagcuaacagaagcugaaacgcucaaaaucauucucccccaaagccuuuagggggagugcagcccugcugauaccuugcuugugaacuuuuggccuccaaaacugugagagaauaaauuuccguuguuuuaagccaaucaguuugcgauaauuuaagauagucagggaacaagucacucuguuuuaaucguuugggacugcucacaaaaccaaaaauagugcacauuuaagguauucaauaaauacauguugaaucaauaacuaaaacuuucucucucucuuuuuagaugaaaucaacguuuucuuuuaaauuauuaaaacuugccaacucacuacgacuucguaaaguggaagacucuuuaaauuuuuccagguuaucuucuuccuuuugcaggugugacuuauaguaagacuaaucccauuuuaugauugugaucauuugauucuuauuccaauuuaccuaaucuaauuuaaucuaauuuaccccaugcugacuagcuuuucauuagcauuaaaaaaccuacauugaaaaaguuuauuguuuuacuuaacuacauuuaaucuggauauuucaaaaauaacauggacacaggaaggggaacaucacacaccggggccuguuguggggagaggugggaguggggagagauagcauuaggacauauaucuaauguaaaugaugaguuaaugggugcaguacaccaacauagcacauguauacauauguaacaaaccugcauguugugcacauguacccuaaaacuuaaaguauaauaaaaaaaaacuuuaguuauuuagagucuuacuauauccccauaguuaagaauguaacuuaagaauguaacauaguuaagaacauaauuacuuccccuuccauaguuuucucccucuccugugcccaagaguuucuagagguuacugauuuucuagauacuuuuuuuauuucugguaaauaauaauuauacauuuaaccacauccucuagguaagaauuaacugucacuuuauugguugggauaaaauguagcuacuaacuggauuaaaaugauguucuagccuuacugagauaguuaauuuuguuuuccaauuaguuuugagaaauucuguaguuugaaggucuuuaagcauugauacuucauagaauuccauuuugugauuaaaaaaauggacucuuuaaguaaaauuauauuguuucacugguuuuucucugaaaugaauucaugucuuuauauagauuuucuguaaucacuggugucuccugauaaauuuucugcucuaauuuaaucaacccuauguuauuuauuuuuucaacagauaacaaaaauaauucaauccaacacucacaaucgugacauuuaacuggagauaucacucaacucauuaguucacugacauuaaucaacacucuucucuguaugucuuuucaaccagcuuauauuuccuuuaacaguguuuuucaagccaacucaaauuaauuuugcaaucaaaauuucacacgacauugucuccaguacuuugcuagaagucaagaugcauuaugucuacuccacucuguucauuuacuaaggcuguaaagcuaucaaaaaagcaaccagcuuugucuggcacaauuuccucuguauuaaccuauucguauauuuauuucuuauggcugugcuuuccuuucucaggcuauuuuaaaccaaggaugugguaauuuucacaauaauguuucauuuuuaaacauucuuauucaaucaacaaaauuaauuacauuuaaaaaauaaauuagucauuuuuguuuaaaacauuucuaaagaguccaauagauuggggaaaaaauguauuaaauuuaagccaaggagagaggcaacuaaauuugaugauggcaugacugggugggauuauuuuaagagugaccagucugagacuuaaaacuagcuggcucugauacaccuccuccaaauaucuguuuaaaaauuucaacaacugaccaaaaaaaaaaaaacuuaaaaaaaaaaaaauaaagccacaggcuccauaauucaaguuagagaaagauaaaugagaaauucucaaauaauuugaaacaacuaaauugagauuggggauagauucaaaagcauacauuucaucuauguauuucauaucccauacuuacaaccagaacaggacgaauuaguccaaggaaaguagaaauauacuuugauucucuuuauguuguauaauuccuuugaguaugcauaacauuggggcuuaauacuuauucuaaauauauauauauauuuaucaaccauauauauucuuuuucaaauuaguacagggaagguagaaauaugcuuugagucucccuauauaauauauuuuaucggggaauugccccgauauucauguagguucuuuucuauuuuccuuaagcgucggccagcuugagaaauaaagggacagaguacaaaagagagaaauuuuaaagccgggcguccgggguagacaucacaugucgguagguucuaugaugccccacaagccacaaaaaccaguaaguuuuuauuagggauuuucaaaaggggagggagugugugaauaggugugggucagagacaucaaguacuuuacaagguaauagacuaucacaaggcaagcggaggcagggcaagaucacaagaccacaggacccaggugaaauuaaaauugcuaaugaaguuucaggcaccauugucauugacaacaucuuaucaggagacaggguuuugagagaucaaccagugugaccaaaauuuauuaggcgggaauuuccucuuccuaauaagccugggagugcuauaggagacuggagucuaucucaccucugcagucucgaccauaagagaugaccaugcccaggggugccaguuuagagaccuauccccaggugcgcauucucuuucucagggauguuccaugcugagaaaaagaauucagcauuauuucucccauuugcuuuucaaagaagagaaauauggcucuguuccacccggcucacaggcagucagaguuuaagguuaucucucuuauucccugaacaauugcuguuauccuguucuuuuuuuaaggugcccacauuucauauugcucaaacacacaugcuguacaguuugugcaguuaaugcaauuauuacaggguccugaggcaauauacauccuccucagcugacaggauuaagagauuaaaguaaagacaggcauaggaaaucacaaggguauugauuggggaagugguuaguguccaugaaaucuuuacaauuuauguuuagagauugcaguaaagacaggcauaagaaauuauaaaaguauuaauuuggggaacuaauaaauguccaugaaaucuucacaauccauguucuucugccauggcuucagccagucccuccauuuggggucccugacuucccgcaacaauauuuccuuugauuaugccuaacuuuaggcuguaagagcuuuauggccaaguaagcagcaagcuauccugaacuauaugagaacuaucuuuauuaguauccagagacuuuguucucuuauucacuaccugcugccuucucaguuacacucuuucacaaauauccagagacuacuacucaaagcagaaaccaccguaagguuauggaaguagagagggugagaugacaauaauuuuuguuuuggaagauuuagucacugagugauaaguaguauaaacaagacagugucuggaauaaaugcucugucauaauuagaccaaauaacuuuaguaaaucucugucaaaaaccuauacauggaauaccuacuaugcaugguaaauuugauuaaaugcugaacauaucuauuugaucuuuaacucuaggucugagaaagaaaaacugaacuuaacuaaauggauuguagaggaggcaaaagaugcuucacuuucuuuaacuauugacaaaaauaaagauugggccuggaugguuuauagaaacauaaacaaacacaaaaacucauugcacccuaaacaaaucagaauaucacccucaagucucagagguaguacauaccucacauaaauucuggcugcauucaauaaaaauguugcaauauaaucugaugaaugccuuuaaacaaugaaaaucuaggugaaacaucaguagagaaccaacaaagagaauaggcugaaaggaagguaaugauauaaaagaugagauaauaugagaaaagaaaacaaaaaagaauaaagacaaacuucuacugcagaauaaaaauaacaguugggaguaguaaagaaugcaaaugauauaucaggacuaaugaauaaguuacacaauaagugaacuuuuaaaacucucaaguugcaaagaaaaggucaaaaagaagagaauaaugagaaauaugaccuauaaagacaggaaugcaaucuaaggccuuaagauuuuccagaagaggguuagguacaguggcucacaccuggaaucccauggcuuugggagguugaggugggaggaucacucgaggccccaaauucaagacuaguuugggcaacauaucaaaacccuaucucuacaaaacauuuauaaaaauuagucaaaugugguggcauuugacugggugguagucccaguuauuuuagaggcugaggugggaggauugcuugagcccaggaguugaacguuacggugagcuaugauuacaccacugcacucuacucugagugacagagcaagacucuugucucuaaauauaauuuaaaaacaaaauaagauuuuucagaaaaaaauaauaggucaaugaaaauagauucaauacucaaagaaauaauggaagaaaaauuuucuaacccaaguaugauaguuuauauauuaaaagagcucacuaagucacaggcaaaauugauuuuuuuaaaaaagccuauuuuuagaccuaaccuugugauuauuuuuuaauuccaaaguuauaaaaauuuuuccacaugugucuaagcacaaaaacagauuaccuacaaacaaauaaaaauagcacuaguuucagauuuuuaugaaaacguagcuuuaguauuuuucuccuuagcagcagaugucaguugaaaauguauauaugucuucagauuuuuagaaagaaaaaacuaagaaugccaaauuguuauucaugagaaaaagcaauaggaaaacauucucaaacuacaaugaauacaacacacauauauauauuuuucuuacucuuuggcaagagaauuuaacugagaugacuaugagaugaauaaaaauacagaacugaagaauagagaauauaaaaguauaaaaugauuggaagagaaguuggaagcaauuacauauaugaagcuaggccuaaaaauaauauuuuggaugacuauauauacauauauuuucuauuaacuaauauuuucucuuaugauaguuuuggaagagaauauaugaagaggaaguaaaggggugccuuaauuuucaugcacaaagaaaaacagauuguuguaguauuguuuuucauaauuaagguauauuaauuuaaguacauguuaaaucaacuuaaacagauucacuagagaaauuaaaaacaaaauucauauguucuaugucacaaaagaagguaaauacauacauugcaagaaagagaacauaagcaugcaagcacucacacaacaguaacaacaaaacaagaauuaauuagaaaaaaaacacauauaucauuaacagagguaguuugauuuuuauauauuagauuuccagucuuugcuuaggauguagaugucuggaaagagcauuaauuccuucucaacaagaaaaaaagaagcuguaauggacaaaaucaucacuccucuuaaccacaucgagggcugggauugcagguagaucucauagccugaaauguaaggaaagacaggcuccuccaaggacaaagaggcacauguguacugaugcagcuggaguagagcaugaaaggagauugagguccugaugaaaguagguaagaaauuuuuguuuguuuguuugagacagggucucacucugucguccaggcuggagugcaguggugcaauuucagcucacugcaaccuucaucuccuaucaagugauucuucugccucagccuccugaguaccugagauuacagacaugcaccaccaugcccagauaauuuuuguauuuuuaguagagauaggguuucaccauguuggccaggcugaucccgaacuccuggccucaaacaaucaaccugccucagccugucaaagugcugggaucacaggugugagccaccgugccccgcugcagguaaggaaauuuuaauuuuuaaaauaaauugccuaauccaaguaugagcuugcaugaguauagagcuugcaugauaguauaugguguaagaguacacucauaagaguagagaacuacugggauucacaggcacaaaggcaauuuccacccaacuugcaggcuaucuuucacagaccucaccauguguuuacaacgaagacuggaggcagaaugaaagaucagagaaaacuucucucaguggugcaggccugagaagaggagcaauuucuguugugagaaagggguaaacccuugcccagauuuuucuucccuacauagcuuauugaacaaaagcuuuaaggcacuauggaaggggaagcaaagcuuaauagcuuugcuauaguuucucaggaaacaggugaaaacucaaugaaacuguguaaaggguaaaagaaaaaaaucaaccauuccaaaagggguaaaaucucccccaagcaugagaccugccaaacauuuaagacaaaguuugacugccaugaggaggaugaguaggaucaccaagaaagccagauccccaauccagggacacacugccugccuaagccuaagaacuguccacaacccgucccccggcaacaacuccccacacacccacaagcagacuaguaaguggugugaauaacaaguaauggcauucuaccauugagagagaagcaacgguauaaaaaauauacucacugaggcacaggcucacaggaaaaucuaguaucgagaaaaguuacaaauucucuuuagugacccaacaccuaaccuaagcauaagauuucacuagaagauuggaaaccuguggugcacugaguguaacaagcaacagcaguguaaaucaagauugacuguugacuggauugauuuaacagcccaucuccaauaaaaacacacacuggggccuguggggugggggaagggggaaggaaagcaucgggauaaauagcuaaugcauauggggccuaauaccuaggugauggguugauaggugcagcaaaccugcauagcacacguuuaccuauguaaccaaccugcacauccugcacguuuccuggaacuuaaaauaaaauauaaucuaaaaaaaaacuagcagcaggagaggcaugccuguuuccacacauuaauacuauuuaccucagucucugcuguccuuacauagugucugucuuucauucaaauguuauaagacacauaaaaaagcaagaaaauaacacccacuauuaggacauaaauuaaucacugaacuagaugcagauauaauccauaugcuggaaucaaaacacaggauauuuuaaagaaucaugauuaauacagugaaggcucuauuaaaaagguggacaacaugcaugaccagauaggaaauuucagcagagagauaggcucuaauagaaucaaauggaaauccuacaaauaauaauaauaauaauaauaauaauaauaaucacaguaacauuuaaaaagagccuuugaugggcucauuuguagacuucauacagcccugaaaagacugagcaaauuuaacaagagagaaaaauagcuuacuucuuacaagaccaagcagcauauuuauaaagaagcaacagacuauaguugccaaaaccucaguuuggagacagagagcuuggguucaaauuucagcucaguugcuuacuaguuuugugacuuugaacaacuuacauaaauucccucugcuucacucaacuguaacccucaguaaaugggaugauaaucauaccuuauaagguucucuugagggcuaaaugaauuauugcauguaaaaaaauuuaguaauuaugcaugucccacuauagaugucaauaaguguuaccuauuguaaugaaaaaagaaaaaagaagccaguauagcaaugguuauauuagauaaaauagaauuuggagaaaaauuauucaauaugcaaaauguuauaaaaguacauuugauaaaacuuuguacacuaaaaaaagcagcacaaauauacaaugugaaaaucuuagaaauacaaagaaaaacaaagaaauauagacaaagagaaguacagaaaaaauauagacaaaauugcauguggaguaaaaaaaauuuaaaauggcacuaaucaucuauaacugauaacaggugaaaaauuaaguauaugaaaaauaucauaaauaauauaauugaauuacaaauuauaaaacaaauuggauaucccaaagagaauauagcaugcucuuaaauauugaugaaacauugaccuuauauuugcaacaaaacacauguaaauauuuugaaauucugagcauguuacaaaauaaauaggaaaguucacauuaucugaccacaaugcaauacuagaaauuaauaacagauauauauuuuuaaaacuacugauaaaauauuuaaauaaggauuuucaccauauaaauucauuuaaaaaggauaucucacauauuuagaaaauagaaauacugacacuacauaucagaccuaugggguaaagccaaauugaucucagaugaaauauucaaguaauuaaaaauaucauuauugagcacaacaaaauuaaaauaaaugaacuaaguauuccauucaagaagcuggaaagguuagaauacauuauuucgcaagauagagaauggaauacauaaaagcaaaaggcaaaaggaagaaaugaauacauuagaaaaaaaggaacauaacacuaauauaaauaaauccaagaacggauucuuuuaaaacauugguaaaaugaacaaguuucuuauaagaccaguuaagaguagaaaauaaacaacuguagaaauaaaauauuaucgcagcuauaaagaaguugucucauuaagaaaugucuaggaaugaaauucuguuaaugaauuuuaaaagcuauuuuuaaagaagauuuacgugucaagacuuuaagaagacuugcaaagguaauauggaacagauaauuccuauauuauuuaagagauugcagagaauauaaaagaagugaugcuucaaaugguggcuugauuguauuauugaccccauuuuuuuuuuuuuuuuuuuuuuuuuuuuuuuuacaccuuccuuaucuaugcccuuuuguaaugccuacugccuucccauuacugacucugggcuuggcuaugguauucgcuuagcaaaugaaacaguagcgcuauccaugauguuggagcuacuguuucauuugcuaagcaaauaccauagccaagcccagagaucauuauguugaaugaaaugagccaggcgcagaaagauaaacaucacauguucucacuuauuugugaucuaaaaaucaaaacaauugaacuuauagucacagagagagaaggaugguuaccagaggcugggaagaguagcggguggcuagagauggggaugguuaauggcuacagaaaaaaaugaauaagaccuacuauuugauaacacaacagggugaauauaaucaauaauaauuucauugcauauuuuaaaauaacuaagaaugugauuggauuguuuguagcucaaaugauaaaugcuugagggaaaggauaucccauucuccaugaugugcugauuucacauugcaugccugugaugaaaacaucucauguaccccauaaauauauacaccuacuauguacucacaaaaauuacuuucaaaugaaaaaaaaaaugaaaaaauugcaaacaaguuucaaaagacacaugcaugguuuaacuuuauuggaccccugacgacaugugaggaugugugccugaucuagccuguuggaaagaaggaugucagagacacauuugaaagagggaugaauuaucucagcugaagguaucccagaucagcuaucuuaggugacuugccaguugaccacagaugaugagcaagcccagcugaggugagucaaaccugauccaguucagcagaacaucccaucaaccauagacucaugauaaauaauaaaugguguuacuuaaacugcuaauugagugauggagaacacagcauuaucauggcaacaguuaacuuucuucccauuguuaaauacagccaauaaaaacagacuucaaaaccugacaaaaauagcagaaaacagaaaauuaaccucccuuauguaaaauaacuguauuaauaguaguagcagacuuaauucaguauuacuuuuaaaaauaacguaguaacuaagucuuauuuguuccagauaugauucauuacuagaucaaagaagaaaaaucuggguagaugcugaaguagaauuugguacaauguaauccaaucuuuucuuaaaauuucaagaccuuuauuuaaauguuuuaucagcacuuuuuuguuucuuuuuuaaaaucucuuauuaguuucuagaguuauugcauuauggucagauaaugugaauuuuccccauuuaucuauuuucuaacaugcucagaauuucagaauauuuacaguuauuucauuuacuaauauaaaggucaauguuccauggaugcuuaccaauaugcuauguucucuuugguauauacaauuuguuuauuuguuuaacaauuaguacuuaaaaacagaaguacaauuucuuaacuuauuaaaauguaccaauuuaaaauaaaugaucauuuuaugcugaagcaauucucauuaaaaucaggaacaagaaaagagucauuuuugcuacuguuaauuaauauuuuuaaaguaauagcuaauaaagcuugauaaaaacaaaacauuuaauauaggaacuaaagacauaauuucuuacugaggauauaauugccuaucuggaauacccagguuaguguccucuuucuaaauuagaagaagaaauacuuugaagaugccauuuuucuccaaaauugaucuacaaauuugauaaguccaaugaaacuaucuuaaagacuuuguuuguaaacaucauuaauuauaaagcuccuuuaaaauaaaaaagaauaauaauauuuugaaaaagaaaaauauauuggauuuaccuuaccaaaauuguaauuagaauauaucacaaaguuucugcaguaaaaacuuuauaugauuugcaucaaaauaggucaauaaaacaaaauauauauagcacaaacacaaaaugaaauuuuuauuauacaaaaaggugggaaggaauggauuacucaauuagugacuuuugaacaaccaaguugugacagauaaaauaaagcuggauuccuauuucacaccuacaucaaacauaaucaagauccuuuacauauuuaaagaaaaacauuuuaauauaaacuauauugcugcaaaauaacaaaauauuuuguagcaauauuuuguagcaauauaaauuuuaauauaaacuauauugcugcaaaauaaugaaauauuuuguagcaauauaaauaaaauaaacuuggaaaccaaaagaaagaccuuucuaaauauaacagccagagcagaaacuauaaaaaggaaaauuaauaguuugauaacauaaaacauucaaaacuucccccaaaaauaggaaaaauuuaaagaaaaaugaaaaaauugggaauaaauauuuucaacauauaugacagaauauuuuuuaauucauggaguuaauaauuaaauuauuuuuuaauucauggaguccucuugaauuaauaagaaaaauaugcauaaauaaugaaauaaauaauuagcuaaggcaaaauaaucaguggcauuaguaaucaaagaaauguacauacuuuucaaccugucaguuugguaaaaauuaaaaagcaggauaauauaguuugauaggugagaaaagagacauuuucauuuuuuguuagugggagaguaaauuguuauaaccuguaagagggaaaaugauuacuuaauaugaaaaaccuucagacuuaaauaucauuugaucccuaaauccuagcuauaaaaacauaaaaaaaauugaaaacaggccauauaagaauuuaaauauagauauuccaaauuauuuucauuagugaaaaaauuaaaaucaaccuuaguaccuuagagacaaauagucauuuguccuuauaaagaaauaaaagaaauaaaaagacacacaaagcacacacauauuuguugucauaaaaacuguuccaaaaugcuuguacauaaaaauaauugcaaaauaauguaaauguuugaccccauauuacucaaaaauaugaacaagauagcugauucugaugaaaaaauauguaucaaaguuauagaaauggaauuucagugauuucugucuuucuuguacaacuuuuuuuguuuacacguuauguuuuaauaaaaugcuacuauaaauaauuuuguacauaauuagaaugaaucuacaacauauaaaaauaugagaggcagccaaaguuuucauaacuguuuaauucauuuuauaaaugccuuuaugauuaggagaguuagaauaaaaauacaugaaguaagcauucaauucaguaacuuagaaaaaaaucauaaaagcauuuuccauaaaugaaacaaaugguaauaaaagcagacaccaaaaauuagugguucuuaaaguagaaugaauaauugaaaaaaaaauuuauucuuugagaaaaaaauaaucauaaaagaacuaagcuaaauuaacaagaacagcaagaaauaaaauugcuuauccuaaaaugaagcuggagaacuaggccagggcccuuguuuuuauauacuuuaugaaucauauuaaguauucuauacuugauaacaauggcagagggacaaaauuaaaaauguaaaauuugugauggcaagaaguagcacagugucuuacccauuggaggugcucaacaaauguggugaguuagugaaagaugauaaguagguaaguuuauauuuauacggguuuuauauguuuaugauuuuaugugauuuuuaaacaauaauguuuauauuuuacaguguucuuucuuucugggucagguuuguaaaauaaauuagaaagaagcucagcuagaggaagagagacaagucagucuuugugauguucuggguaauaauuaaugagggcaccagcggauuuugagaguaagagacaaacuggaguuacauucuuuugcuguucucugaagaucuguaguaggaucauacuuucuugcauucugugguagcauguagguauuggaccaauuuuggccaaggaauugugaguugaaguaaaaugugucacuuucagggcaaauauauuuuuugcugaugcgagguccugcagagcucucuuucuuaaacugauaaaauuacaagcaaauucuagauaguggcuguuuuuucagucuauggacuaaagguggccacacauucuuuuacuucuccugauaaagaaguggaguuuguuuuuccaguucgugaaucacaagaucgauugcuuaacuaagaggacauagcagaaaugaugcugugccaauuucagguguagucuuaaagaguauuggcaucuuccacuuccucccucuuggaacacuugcucuugagauauggccucugcaaauucuucagcugugcugugagaaacccaauccacguaaacagacuccaugaaggcuguccagcagacagccccacuggagcccccagucaacauucaguauuaacugccaaucacacaagugaccaauguuggacaauccagcucaaccaaggugucagaugacagcaaucccagcagacaucaaauggaguggaaaccccccucacugagcccauuccucccacagaaccauaagaagucauaauagcacuguuaugucaaaaccaccaaguguuggggugguuuguuccacaguaguaaguaauggaaacagucuggauccaggaauaagaauguugaggagaggagaaaacacucuccccagaguagccuuauaagcaugagcaagaaauauaccucucuugcauuaaaucauugagguuuuuacauguugaugauaauaauaauaaugacaauaauuguccugauuuauaaauguagaauaucuagaagaaauaaguuguggaggaaauuuaaaaauaagcucaguuucacacacucagggggcaaccaggcaaaaauaucuaguaggcauuuaggucuucaacacaauaugucuagggucacuuuacaggccuuauugaacauuuuauauauauuauauauauauauauaucuuauuuauaaaauauauauauaaaucuucauauauaaauauuacauauacauaaagacuacauauacauauacauaaauauuacauauacauaaagauuacacacacacacacacacacacacacacacacacacacacacacggaugagccaccccaggggaguaaauaaucugaacuuuauaccuacuuuagcguaguuuaaaaucacguuaaguguuuaaaaguccuaauuuuugagcuauaaaucacugucacuguauacgauaauggugauacagggauugguaauguauaaucuuuguccucagggaacacucaaucuuuucuaccagaauuaugggauucuuucccucaaaaaaauuugcuucuuuccuguuucaucuuacauuuaguccuuucuguagcuugacaagucugucauucuuagcuucugugacauaaucuuuauuucucaauaauuagucaguuuaaugucuaaacagcauaagauuauucaacugauuagugcaauuuaaauuauaagaaauuaugaaaaauaaauaagauucuuucaugcaacaugaauucaacgaaaacaaguuaugccaaagaaccucauuuaaaaggcuuaguguuacuggacaaguagaucuugggaaaaaaguuauccucauauuuaauaucuauuuucuauucuccauaaugguagaaagaucaucaacuuuguagaguugcuuuaaaaauaaaauaaguuaauaauuguaaauuacuuaauacagugucuggcauaugugugugugugugugugugcaugugugugcuuguguguacauuuauucaauaacaugaauaaaccaucgauaauucaacaaugucaauuucaaguccucacaauaauacuggauguuaucaaaguuuguaggugccuacucuuauacauggggcucauuuucuugcuacugugaacauuaucuucuuugcugucuaaggaggaggcuaaauggaguaaaauagugccuacugcuuucccuuggccauuguuaauaugucauccucagccccaaguagcagaguuuccucuuuuuauuaucuuucuuguauuacgcaugauuuuuaaaacaccuuuggaauuuuucucaacuccauucuugcuuuaaacucacugucaauuuuuuuaggugucuauauuauucuuccauuaucauucuuacuuauauaccucuacuuucaucauuuuccauguucucacauuuauugcuagcuccuugggcugcugugcugaucucuuuggaugcccauuuucuucuuuaucagcaccaucugugauuguguggucugaaguccauuuugacaguuucucuuuucuuuuguggcauuuucauuuuauuguuaucugaucuccuagccauucuuucucuaagcuuucuguaaugugauuuuucacaucuagcuguuucugauucuguguacuguuacuuuuccuggcuagcucugacugcggggaaacaugauuaauuuuuccaggguuccugguacuuuuccuucuuuaauagguuccucucuuuugguagaaguuacaucuggugacagcucuccuauuaaguuuagaauugauuaaaauaucuaguuuccacagaaucuucuuauguaugaaccauggaaguccacgcucacuacuauguguuaccucaaagccaguuuuacaacaaggaugccugagucaugucuucagccucaccuggcuuucuaaagcacaucccauuggggaacuguuuuuguucuccuucuuuuugaaucucacccagacacaaugauauuuucaggacuugcacauguagcucuucacaacuccgcuuuauuucugcccuucuugauugcuucuguugaccacaauacaucuuuuuuaugcauacucaaauuccaucaaacugauagagaucaagucuuaaggaggcaagacugaaauuaggguagguagucaagcuuugguccaagcaucuccauuguaccccaccauguucuacaacaacaacaacaacuacaacuacaaaaauagucuugcucuuuaggaauacauuuacuuugcaucauuuuucuuaucucuguauuggggagacauucuguugcccauggauaaauauuucuagaaugaaauugaaugcaucaggccauaaaacuaguugucauuucuuauuaagaucauucaauagaguguaggacuuuggagccagacugccuggucuguuuuacagggacaccacuugcuaguugugagacuguggacagauuauuuaacuucucacuaagcuuaccuaucuaggaaaugugaauacuuauagacuugcacugauuggauuguuaugaacuuuaaaauaguuaauacuaugugauuuuucacauguagcuguuucugacucuguguacugcuucuuuuccuggcuggcucugauugcagggcaacaagauuaauuuuuccaggguuccugguacuuuuccuucuuuaauagguuuuuuaaaauagauaauacuauuuuagaguucuucaaacuuugaacuuuaaaauaguuaauauuugaauauaguuauuaacuauuuuaaaguucacaacaaugaaccuugauuaugauucaaugaucuccaccugucccucugaugagaaugccuggcuuggaauuauagcauacagcaagagaaugacugcaagcuucaaagucaggaauuaagugcucucuaaucuugcuacuugucagcaauaugggcuuagauuucauauucgagcuucugucuuauuuucuguaaaaugaugauaagaguaucuauauaacaggguugauaugagaguuagagugagucauagaggaugaaugaaaguguaaggcauaugagagacacuccuccauugggagcuguuaauguuguuaugauucucccugacuucaaggagcuuauaucauguuugguaggcagcacugggucaugauuaagaucuauuucucugaaguuaaauaaauuuagauuuaaaaucuggcucuaauccuuauuggcuauguaaauguaggcaaauuacuuaaacucucugagucucccauucuuuaucuauaaaauauucacauaauaacauuauaaaaacuaaauaaaauaaugcaaauauagaguuuagcaauaugcagcuuagcacaaugcauggagcauuguaguugcccuuccuauuaucacugacuuaacuccauuuucaugaaacaaaguucugauuguaauuuguagauuugccuacaaagagaacaaguagagaauaaugcccauaacauuucuggucugcuugauaguuguauuucuaauuguaaauguaaaugaauaauucagaaguguauauaucagacacuugugaaugucaauaaccuugaucagucucaaaggcuaauccauuuuguuuuauuaccaauuucaaucauaaaaucugcaaagcuguggaucagaugcugggauuuucuaacaacugucugugugcugucacucugugaggcccuguuugcaugcagagccaaauuuucuauaaaacucucuaccaacuaaauaacuauuugcugugaaaagaagguuugaaguacuuguacguauuaacaugaaugcaugaccuguguuuuaaaaaugugauugauacgguuuggcuguguccccacccaaaucucaccuuuaauuguaauaauccccacauaucaagggcagggacagguggaacauugaaucaugagggcaguuuaucucauacuguucuugugguagugaauaagucucauaagaucugaugguuuuauaaaugggaguuccccugcacacacucucuugccugccuccauguaagaugugccuuugcuucuccuuugccuucugccaugauugugaguccuccccagccauguagaacugugaguccauuaaaacucuuuccuuuauaaauaacccagacuuggguaugucuuuauuagcagcaugagaacagacuaauacagugauaaacauuaaauaauuuuuaagguuacaauuauuucaacaaugacugggauuuggugucugguucugcugauuacuagguaugaugcuuuacacuuggcuuccuggucuucaaaaaagacuuauuagccccuauaucuuaggguuauuaugaaaauuaaauuauauguuaugugacugcaacuaguauguauguguuaacuagaagauacucaaacaggcagggagggauuuuuuuuaaaaaaaauagcucccugccuuguacuaucuacuucucaagcuuuuugcugauuccccuacaaaauaauuauaaagcuuggaucacaaucugcaucuuaucuccugaauaguguuuacugauuuugcacuugauuauguuuccaauucuucauauucucugcaauaucuucuguaaccaucuaugauugaugucuuggaaggauauugccaacagaaggaaugacaugugcaaugguaucuucuaggaacuaaaaguucuugaggacugcuaaagcauagguucuguugaagugauuggggagaaaagcaacugggcauguugggaaagauuaacgaagguugcauggauaacgcuaagaaguuuguccuuuaugcugcaggcagugguagauggguguuuuacagauaaaugacagacuuuuccuggaagccuuaaauuuuugcugacagcucagcagucuuuagguaauuuucuaaaauccucuggguuuucuuuaaacaaaaugguucuaccuuccucugcacaagauguaaaauguucugagcacacuaugugcguaucacaugccacugauaccuggucuucuguuaagucaccauauaucagauuaugaauaucaacuccacacauauuuuuaaagaaacauaaaucauuuuauacccccaucccacacauauuauuuucuuacauuuauuuauuuuaucauaauuaagguauaauauuugucuacuuaucugaguuuaaggcauagagaaggcauuuuuauuguuauuguuccauuaggauuuuuuaguuuauuuguuuucgguuuuaaauaaaaaagaacugcacuagaaauaauccugcccuggaacacugagagcuggaugcucacucuaauaugugacuuuacauuaaggugacuuuuagcaaagucauauacuauauauaagcuuaaauuuucuccuguguaaaaugaaggaauacaauuaggagacuaugacucuuccauuuuuaaaauuuugcuuuucuauuaugugcaaaacucugcuaaauucuauggggcuagaaggagcaauauucuaguguaacuuuuuuucagcaugcuuucuuuauuugagaauauucugaaaauuuccaugaaugagagagaaaaaagaaauauagaaaauauucaaaauacagccaaauuauuaaucauuucauucaaguaucagcauggaugguaaaagaaaaaaaaguaugcaguuguguuaccucuugagauuauucaguugaaaauacagguuuagagagcucauuuuauagaaagccccaaguaauggaguagauggcaaacuacgcauuugacuuucauuucuccugugugagauaagacauauuucauuuucaugugaaaaugauaauauauguacaugugaacauauaauuugugacaucuucauacaauauucacaugaugugaaaaugugccuguauauaugaagaggcauuaguauucuccuugaacucugauaguucuuucucgccugccauucugacugcaucuaucaagcgaagaugugaauggaauuugcuuuuagaggcaguuucagcagcaagagagaagaauauccaagcuaauaaauaaauaaauaaauagccagccaagaaggcaggcccugccugggucugcugaguacccauuauuguccauucugugcagcuuucuauguagaucugauuuuuaaaacaauauuuuugcaaacauauacuaggaauagaagacuauauuuacugcuuuauaaaaccaagcaucuuuuuauauuuuauuugauuguuuucccucuacguguaguuggucuucugcacccaugcugauauauacccagaauaugcuaagcagagguccaguagaaugaugaaugcuccaguuccucugugggaagcagucuaugagugccaaugucccccaaauucuagagguaaccccagcacagucuggggccucaucuuccaaagaauaauuuccaaggaggccauuccaggagauggcauuuauccauuuucuaaagcauaggugaaggccaugagccccgcaggauuaguuaugauuuaaacacuuugcuucggacauuuucauuaacugcauugacacuaacuauaaauuauucauuuuauuuguacuucauugcacuucuaauauguaauuaugacauacaaauuugaggaagcucaucuuuauaaacugauguuucacuuucagcuuggguucaaauauacauugcuauguguuuugcaaaaugcuuaggauauagaauagaauuaaacagauauuaccuucaauaacauguguaugaagugaguaaugauuuuugucagcauaguuugaccuuguguuauauaaaauaacuuuuggaauaguuuuacuuaaauaagauaagcaauauaguagauauaugguuagaaaauuuuaugcaucaauacagccaaaaugccagucuucaaagaugcuuucuuagcaaaucuuugugccauuacagaaauguuaaucaaaguaaguauccaauuuucugguuuauggauugaaacauuucacaaguauauaaagacccagauuuaucaugacauguuaaaucuccaagaacuuugcuccccaaaaacgucacugacccauauuuuagagacacagauauuagaaaauuucuccaaauaauaaauuuuugauauuguucaaugcagcaaccagcuuucauuuuuuucaacagagaugcaguauaagguaguguuuaaguugcguacucuggagugcaacugccugggacugaaucuagcuacuuuuacuaacuugaugaccuuaaacaagucacaaauauauuguaccucaguuuccccauauguagaaugagauaacaaauaguaauuaccuuacaggguuguuaacuaaguaauacauuagcaaauauauggaaagcgcuuauaugaauaacuggcauacaguagacuuaauagaguguuaugauuacuauuaucuuaguguaguguuuaaguguaacgucaaacacuaugaugaaaaucauauaaggaauaauuuuuucucaacuaccacuuauaggaaaucucugcuuuuucuccaagucuaaaauaaaaguaugacauaucaucuguuccuauauuuuuuauuuuugcaacaacuauuuuauacuuacuaauaaagacaugaaacuuuaaaagguguaauaaaauuauguuuugauguacuuacaaauuaaauguguuugaaggaaaaaaguguaucagauuauuaauccuggugguugauugccaaacaccaagaaaaauuagcaaaaaugccuaaaugauaauauuuaaguacuucaaaaguuauuaauuuuuuuuaacaacuugaaauuuauucugaaauaguacaacauaaauucagcuucccaugguagugugagaguuagaucccacuccuggugugaaagcaagcagaaagugagagugaaagcugaguggaggcuggugaagggucugcaaagccaguuccacuccagggagcuccgcgccgcaguggugaggcaaggaaagaccgaaagaugcugcuagguuaccacuaacccugaagauggucucugauaggagcagggcaggaaaauuggaaggcaagcauaccaaugacagcucaguaagcucccuacagggauauuauuuaucaaaacuuagcaggacuccuauuuaugaauuauuaaacagaauaauaaagagguaugacagguuuguaauauucuaacauuuacccaaggcuuucuuaauccagucuauucaaaucucucugacauugauauuauacuaaaaaucuguugagaugagauucgcuuaggaaaguucaguuauuuccgaauuucagauaaaaaugcaacauugaauguggcaacuuucaaaugagccaggaaagauauuuuacucuaaaaaagaaccaauuuucauggccauuaaauuauuagaacaggcuuuggugggaaaacugaguuuaaugacacaacaaugaaacaaauuuuccccaaucuccucuugcacuuaguccacacaaauuuaucaccuuugggcuacaaucaguguggaacaaaaaauaaaaauaaaaauguagcaagaucagagaagggggaaaagaagaugaauugugagagagaaaggaggaaaugcuguuuuggaguauugugcugaagagggagcaggaagucaaagcuuccaguccuauuuguucucauuuccacacacauauauaaccaugaggcauuucuaaaaauguaauaguaauaggaauuucgaccucaaauauaauuuucucuuugcuuuucauuauauaauuguaaaaaucuguugccauaaauaaaaaagucacaaguuucacauuugaaaucaaacuacuaauuuuaauucaagguaacuacagaaaaaagaaaaauaauccuaaaauuugcauggagaccuaaaauacccaaauagucaaagcaaucuuuggcaaaaaauagcugggggaaucacaguaccugauuuugauauauacuacaaagcuauagcaauuaaaacagcaugguguuggcauaaaaacauacauauagacuaaggggucagaagaaauagccuagaaaaaaauccaugcauauacagucacugauuuuuuuaaaaaguugccaaguacacaaaaugggaaaaggacaaucucuucaauaaaugugcauugggaaaacugaauauccacaugcagaugaaugaaauugaauccuuaucucacacuaaaaauaaaaaucaacucaaauuggauuuaagaccuaaacauaagaucugaaacuauaaaacuacuagaagaaaacauagaauuaaggcuucuugacauugaucugggcaaggauuuuuuuugggcuguaaccacaaaagcacagguaacggcaacaaaacagacaaaugggauuacaucaaaccaaaaagcuuccucaagcaagggaaacaaucaacacagugaagagacaaccuacagaaugggaaaaaaauacuugcaaaccguacaaacuauuaauauccaaaauauauaagaaacuugaacaacucaauagcaagaaaacaaauaaacugauugaaaaaugggcaaaugaccugaauauacauuucucagaagaugacaugcaaauggccaacagggguaugaaaaaacgcucaacaucauuaauauucagggaaugcaaauuaaaaccacagugauacaucacuuugcaccagagagaguggcuacuacuaaagauaacaaguauuggugagaauguggacaaaagggaaugcuuauagacuguuaguggaaauuuaaauuaguauagcuauuauagaaaacaauaaaaaguuuccccaaaaaauuaaaaauuggacuaccaugugauccagcaauccuacuucugaguauauauacaaaagaaauaaaaucaguauguuaaagagauauuugcacuuuuguguucacagcagcauuauuuacaauagccaagauacggaaucagccaaccuaaguguucauugacagaugauugaaugaagaaaaugugagcuacacacacacacacacacacacacacacacacacacacuagaauacaacucagccuuuaaaaagaaggaaaugcugucauuuuugauaacauggauaaaacuggaggaacuuuugcuaagugaaauaagcuaggcauagaaagacaaauacuacaugaucucacuuauauguggaaucuaaaagauaucaaauucauacaaguagaggguaaaaugcugguugccaggagcuagagaaggcuggcgguggaaauggggagauacugguuaaaagauacaguuuuacuuaggcaggaugaauaaguucaagagaucuacuguauaauaugacuauaguuaauaauaauauauuauaaaaauauacuguaaauauauuaaauauauacaauauaaaauauauauuuaauauauugcaaaaauuagaaauugcugauuuaagcucuccaaugcucucacaaaauauaaguaugugcaacaauagauguuaauuagcuugauuuaaucauuucacaauagguacauauaucaaaacauugccuuguauacugugaauacauacaauuuuuauuugucaauuuuaccuuaauaaagcugaggggggaaaaaagaaaaagaagccacccauggccacaguugaggaaucauaaauaaauacauaaauguuauguaauuggaauuuucugcuuaauuaugcuaugguuucuauguuccagucaugucuaccuccauaaagucuuauuuuuauggaaucuuuggccaugcagcaaaauuagguauauaaauaccccauucaugacaguguuggcaauuaacaugguucugaauguugaugaccagucuuguaagggcuaucagggugaauauaaccuuccuauuaccuauuacuucugaauuuacuuggaacaauuauaaggcuucuccaugcaucaaggaggacuguguaauuuacuuauaacuauuacuuuggaaaggucuucauuugaaauuucagacaauguuauggcuacugcucugaaagaaaaauguggucuaaacauuucaaaaagaaagauaaugaagcaagauguuauuaaucugagauacuaauagaccauuauauucuaaacagauuaaauguucaagaauauuacaaaaugaagauauuguagacugcacuaauuucuaauuucuaagcuuacacauucuauaaucuaauauuuuguauguugcacgaugaccuaaaaucugacgguuagccacaggucagagaucagcauccucuccaaagucuucaagaugagguagagcuuucuaucuuuaacauaauauuugauuccccaaaucuaccaaacauuuaaaaaaauuuuuuugaugaauaaucagaacaaaggaaucaaugacaucagaaagauaaauaaauaccuguagacaaauuuacauggaaagauuucuuuuuauguuaucacuaauuuaacuuuuagagaccauuuucaaaaugaaggacucuaaagauuauugcauauuaaauauuucccaaugcccuuucacuguaucuuuuuugaacaucuugggaaauaaugaaugucuuaugaagcguacaguugaaaguggaaaacaaguugaaaaacaaagguuaucuuucaucugggagaacuugaaauuucuuacaaaacguaugcaacuacuaugacacuaugccccaucuuuucuuuuucauacaaaauaauuaaagaaaacacaucccaauucaaauagucagaugugaaugaaaaucagaugguaacccacauagccaauuauauuauuucuuaauuuuauaauuauuauaagggaacuucuaauaacuucuaauaugacccaauacacacacacacacacacacacacacacacacacacacagucaccucacacuugggagaauaauagcuguaaaaucggaaaggcaagaacucacuuuacaggcccucuuuauuguccucaauauuuaucuucucucauauucuugcacuuuacaauucccuuguacagaaaugcaguguuaaaauacuacagaaaaucugaugucucuugcacuuaagcuucaugaauauuuuacuugauacucugcccucgggggccuugcaucacuaaagcauuauacccuuuucuugaugcauaaauuauucuaaaaaugcuuccaauuucaagcaaggucagccugaaaaaaucugaaaauaagcaggccuaauuuaaugcaguuugaauaaaaaaauacacaaguuaagaaggaaacauaauaauuugcaauuuguuuuucuuuauuucuuugcaccauaguugauuuugcucugcauaaccaguuaucacuuuuccuaaaauaaaauucauuuuaauacuagguuuuauauacaaaucauucauuuuagugccuauuccucuuucaucaauuauuuaucacacacuuguuuugucccagaaaugauaccaggcacaagggauaaagugaucaaugaaaaacuuguuucuugcccucaccaaaguaacaaaucauuacaaauugugaagaguaugauuaaggaaaccauggauuuaggagggggaaugauaauaauaaguuuuuuuuucucuuuuuaaaugaggaaauggauuuuaagcgaaguucugaagaaacuagcccugggaaauacauagcccugggaaaugcagaagagagagcagucuuggcagaaagacagcagggacaggaaaaguuggcauauaugagggaagaaaaaaaugaccauggugguuuuagcaaauuuagcuagugcaaagggcuaaggauggaaaauuaggcagggucuagaucauggacuuauagguguuggacuuacauggacuuacagguguugguaaggaguuggacuuuauuacugcuaucaccgaagaguuuuuaguaguagagugauaucauuugauuugcaguauaagaugcuaucucacagugcuauacagagauggauuauagagggguaggauacaauauugcauagcuuggaccaagauaauaguggaauagaaggagagaagauucagauaauaauucagaagauaagagaguagaucuggauaaaauccuuuguucuauucuauggcaaaaauuacacuuaaaauuuuugcaaaaauauauuuagaagaauaaaauauuucuauuuaaaccacagaaucacaaagucugauaagaacauaauauuucacccaguucaauaucucacuucaugauagagaaacucaagguucugaaagcugaaauaccuugccccaaaucccacaacuccuaggcaaauccaggacuuucccagccuguggccauuggucuacuccacuuuaugucaugucauguugaguuucaggaugaaaucacaaauaagaagauguacacauaaaaaccauuacuaaagguugggaacaguggcucacgccuauaauccuagcaguuuggcaggcugagaauggguggaucacuugaggccaggaguucgagaucacccuggccaacauggcaaaaccccaucucuaccaaaaauacaaaaaugagccgggcgugguggcgggcaccuguaaucccagcuacucaaggcugaugccugagaguugcuuguacccaggagguggagguugcagggagccaaaauugcaccacugcgcuccagccugggugacagagugagacucugucucaaagaaaaaaaaaaauaguagaaggacuaagaggcuacaaauuacaauuguuuaaaggggaaaaaaaaguuuuagaaauaagcaaaauggaagacaugcuguuuuacauuuggucauauguaguaucuaccgaaauuuuggaccuuuuaucuuguuuacuauagaaauuuuaaauuauauauguuaugccuuuauggauauguuuuuaucauuuaaauaaacugaauuaaaaugugcuuugaaaaaagaaagauuucuguauaucugguucaagauuuuaaaccgcuguuuaucuacuuucccuauugagauucuguuaaaauuguugcaagaauacaaaacagaauaaauuagauagacccacaauauacucugagaagcccaaggagagucuugggccuuggaaaugccaggcauaaagaaggguacaaguaaaagaugggccuaagcacuggaguauuaaaugaaaaucuauaugggcaguuaagacucccaucucuuuccccauguugcugccagguauuuaccauucaauuuucccuccaaagagaaagcccucugagagcucuagguauaaauguuacugcuccuaagacaaacucuuucaucuucgggacauuaggugacuccagcuuaauaguggaccucuuaccucuccaccagucaguaaacccauagaaauaucagagaacaguguguagugcaucacuuuaaagaggaacuagugucaucagacauuugagaaaaagagcaacuuaaaaucaaagaaggaaccaaaaacugaaaauaaucuagaaaccagaauacacuuacacaaaacaaccaaaaaaacuccuccccuucuaauuagcacuucagagagauucaaguauauauggcucccuaaagguaagauuaaaaugaacaucugaaaauuaaaaagaaauaaaacagcaggaacccaaagaaauuuuaaaugauuaacaaaauuuuaaaaaaguaauagccuagaaugacaaaaaagaacuuuaagaaaaagaaagacagacagaaaaggggcauagugggccaauuuaggagcuucaacauuuuucuacagaaaguuaaaaaaaaaaaaaaaaaagagaggagauaauggguugaaguuaucaaauuaugucauagaauuuuccagaauuuaaaaguuuucaugugcuagaauauacuaguuacacagcacaaggcacaaaaaaaucaaaaaggaaaauugcaguuagacacaccuuugggaaacugcaaacaacaaaagauaaauaggugaugugguuaggcuuuguguucccacccaaaucucaucagaauuauaauccccauaauacccauaauccccacuugucaagggaaaggccagguggagguaacugaaucaugggggcgguuuccccaaugcucuucuugugauagugagugagaucucacaagaucugaguguuuuauaaggguuuuuucccccuuggcucagcacuucuuccugccaccuugugaagaaggugccuugcuuccccuucgccuuccaccaugauuguguuuccugaggccuccccagccaugcugaacugugagucaauuacaccucuucccuuuagaaauuacccagucucaggcaguucuuuauagcuguaugaaaaugagcuaauacagauaaagaaaaauuuuuuccugagagaaagaaacaaggucacuauauuuguuuccuagggcuguuauaacaaaguaccacauacuggguggcuuaaaacagaaauuuauugucacacaguucuggagggaaauccauaagcaagguauggucagggccauauucccucugaaaccugcaggggaacccuuucuugccucuuccuagcuuuuggugguuggcuggcaaacuuuggcauucucggcuugcagcuacauaacuccaaucccuaccuucuucaucacaagaaauccucccugugugucucugucgucaguggguccuucuuacaaggacaccagucauauuagauuacuggcccauccuuuccagugugaccucauuuuaauguaauuaguuaagauaugaauggacacuauuuccaaauaaagucacauuuugaaauaccaguuguuaggacuucaagauaucuuuuuuggaggagacacaauucaacccauaacagucacugacacagaaauaagaaucagguuggcauuaguggucuuguuagcaacaauaaaugcuaauaacaugaagcaaugccuccagaauagguaggagcucuguuuguuggcagaaggccucagacccucaccacauggaccugucuguauggcugcuugguguucucacaacuugguagcuagcuuccucuaaagcaagugauucaagaaagucaggccgaaaucacaaugacucuuucauccuaaagucacauacaauuguuuccuauugguuacacagaucagucauuuugugagggaggagccuucacaaagagcugaauaccaggaaaaaaggcucuuugggggucauauuggacacaggcuacuacagggagagaaaaaauaacauaaaugagccaaauuuucauuauugcaggaaaucagaagauaauguauagaacugauaaaucaaaaaguagugguuugcauacugguuuaagguauggagguagucaguggugugauagagccagcuugaacaagcucacaagauccaaauguuaaauuuucagaaguuuugugagcugguuaauaaacauagccaugacuaaaaaucaaacuguaaaacuuuauaaauacaaaauuuauauuauaaaaauuauauucaaacuugucacuuccaaauuacuuuacuaccuuuuacuguuaucuacauucuugagaaugauucacaccuauugcauccauauggcagcaugcuaugcaauggaaugcuacugcacguccccucccaacugcaugcuucgcuauggcaaauuggcgacuuguaaucgagaacauuuacaccacagagaucauccugcaccgcauauaagggcuugauauauugcuuuguugauuggauuuaggaaagucauggagaaacugucaauaacggugauuccauuuaaaacugugugauuuguguggccacuaaaauauaaauagcaccaaaaaaaugagaaaauaugcuuccuguucaaaaacuguuauguauuguagcaaaaaaaaauucacaucacugaugaauggucaaauuuagacauauacuucaucauuuaauuuguaucuuauauaaacaaaauauaucaaccaacauuguuauugggacuaaaccuggagagccagcuguuaauuuaccagcacauuguuagagauaacaaaucagaaaacuaaaaccuaagaguucaaaguguuuacuucugaggagagggacuagggaaggcaaaggguggagcagggacuagggaaggcaaaggguguauuucaagcccuuuuuaaauuauuuuugaaaaauguacaaauacuaguuugaauggaaagcuuuaguuuuaaaaaguuugcauguaauuuacaaaauucaauguaaagcaaacguuuaaauuuacucauauaaacauuuuuauuuguccggccacaaguuuugagagauuagucuucauuggucucucauauuucuguauaucuugugagcagaggccauaacuacuuuuuuguuuaugaccagcuuuucaaggaugcuuauauagagaagaucuuggaagauagagauaaugccucccuucaaagcaaagaacagguuugcuugcuauccaauauaauaaagauagugucucccuucgaagcaaagagcagucauuccuccugcuuauuauaaaagauugggguugucuaaggcugggguuccucagcgauaaugcaaaucugugauguguucaacauucaugugggcuccucugugucaccucagugagguccucugugucaccuccugguggugaugggaguggggcaggggagcugaagcaaacaugaaacuugugccacuuccuuagacaggaaucucaugucucuuggcauuauuuaugaaacugcggaagguuaauuucuuggccugcaaguacaguaaaauucaaccuuucaaaauguuuaaaaauaaaacccuaaaaauccaucaaauuaucaagaaaaaaaauuauuuacuuucuucguguuuaucucaggcaacauaaguaaauccucuuuccuauauuuauuuacuucucuauggaauguuauaaaauuacaagaauuguggcuuaacacuuaauacugagauacaugaaaaguacuaguaauauaaacugaaauaauuacuuaagaaacuucuccccacaagggauaaguaaagauuugaauugcuucaauaauuuuuggaugccacaucuuuuacaaaauauuuacacuaaaguuaaaauuuauuuaauugaaaauaaucaauauuaaaauauagaaacaacuauaaauaaaaauaaagaaccaaacaaagaaauagaaaacuggacuuugauaugaaaaaucaacaguaaggguuaauguaauauaaaugauacacaaaaccuucacugauauuucagggggaaaguaaaacaaauaugaugucauuuacaaucacccuuuuuuucuuggacaauaccaggagcuauuuagaaugaggcaaaauagggacuuacaugcuacuguugagagugacaauuggcacaucaccuuggggagcaauugucaacaccuagggaauuugcagaugcucauacccuguaucaguagcuacacuuauaggcauuuauccuagagaauaucccacacauauaccugagagcauauauaccaugauguuugaugaagcauugcuuguuuuagugggaaaaaaccuaaauaaccuagauauucguuguagaaccacauuaccagaaagcugugauuuauguggcuuauucuuccagugaaaugucauauagcaguaaacaugacugaaauagagcuaccuacauuagcauaaaaaauauguugaaagaaaaaaagaaauauuuaaaaacauagaauaucauugcuauaaauucuuaaaauauagaauauaauaaugguauaaauuuggggguauacaaaaggaauacaguucaaaagacugcacagaaauuauuuacaccaacuuauucuguaaagaaagagaggagaagggacagauauacgcuuuuauguaucuacaauuuuauuuucauuaaggcaaauauggcaaauguuaauagcuguuuaaacuugguggcaaauauauagauauguguuauauuauuuuuuguaauugucuauauuuuugaaauguuuuagagaaaaaauuacuuugauaagaaaggaaggacaggugugguggcucacgccuauaaucccagcacuuugggaggccaaugugagcagaucgcuugagcccaguuuaagaccagccuagaaaacuuggugaaacccugucucuacaaaaaaacuagccgaauaugauagugugccuguagucccagcuauucaggaggcugaggugagaggaucccuugagcccaggagguggaggcuguggugagcccugauugucaugccacugcacugcagccugaaugcugaaugacagagugagacccugucucaaaaaaaaaaaagaaagaagaaagaaagagagagagaaaaaacaagaagcaaaacacauguugcuaauuuuuaaaaacuuaaaauuugaaauauucaaauuauuuucuguuucauugggaguaggcacaaaguuuaguuguuauuguuguuacuguugguugguauuuuuaugcuagguuuguauugccugugcccaaauaagugugcuuaagacaauauaaaacauguuguuaggaucuguaaaauuaccaaaugacaacauauucuaucuaguacaaagauaauccagucucuucaauuuggguguguguaaucaagggugccuagacagguguuuaacucuuucuucccaccgcacaccggaaguauaaagaacucagaaaagacacaauuaccucucacuacaguaugggcaaaaguccaucuuccuguuauuagaucauugacuuuaccucugaguugccuaaagugucagagagauuccuuuucauugaaauaugugaauaucacacaaaauuuuuaaauuauggguauugcuaauuaaguauuaguuauaaaucacugcgucacacaguuaaaucuagugaaugacaucaacuauauacauauuguuugcaaaugugaguauugacauauuaaaaugauagagauguuuugcuaucaccaauuaaauuaguauauuaguacauagcuacauuagaaaaaacuuaacaugauugauuguuuaugaaaaacagcagcuaaagaccagaaauucuuuuuuuuuuucuuuuugagacggaguuuugcucuuguugcccaggcuggaaugcaauggcgugaucucagcucaccgcaaccucugccucccggguucaagcgauucuccugccuuagccucccgaguagccgggauuacaggcaugcaccaccacgcccggcuaauuuuuuuguauuuuuaguugagaugggguuucuccauguuggucaggcuaguguugaacuccucaccucaggugaucugccugccucagccucccaagaccagaaauuuuaauaggucaugauuuugacuaaaacuguacugcuuucuucaggggcaagcacuuuuguuuguucuucuuaaacccaaugcuauuacauguuagcauuaucaggguccaauauaaccaccagauccuuuucuuguaauaaauguuuauauggguaaagggacagaacuaauaacacaucauaauuucauaauauuuuauggcuaguuuagugauccauauaaauuguccuagaggucuaaucauauuauuuagagagcagaugcugcacaaaaagugcgacgguuuuuuuuucacaguaagucuccagugaagcugacuuauugucauaggguucaucucuagggaggucuggcauucaguuucaaaacgauuuagaguccuaacacugucuacaagggcauuaauaauuugcaugcugugggaacuugucuacagugaacuagacugaaaccauucuguauuucacauuaguacuagagcagcuguugauguuagcaguauuaaucacaagcaacuuggacuggaaucaaagugaccuagaagagcuacuuucuacaucuugcuaugaauucccuagggcaaagacauuauguggcaauauguccacauuaaaagaaaguauauccuuugauuaucucuuauuccaguagagucuaugacaaacaagggaacugcaucuauuguacuagcuaucacugucuggggauggcacuucaaaacugaaaaagguaaauuuucccccacaagaaaugaugcuauuauuauuaaguuacuggaucagugaauaacauuuuuuuuuagguucuccuuguauaagacuuaaauacaagauaaaaagaagaaacuuuauugacucauaaguaaacuuucagauuaggagaaauaaaauauaaaagugcaaaaacagagaagccagggauguuucuuugcaaguguuuuccauuuuccaggugaauaauaagaucuaaguuaagucugaaagauaaugcacaaugaaaauaaacucuucuaugccuuuacaaccacacaugaggaaaugguuugauuugcucaucccaguggauauuuaaguauugucuuuacaaaggauacuaguagugguauaagaaccaugccuguaugacagggguucuuuguuucaguucucagaaggggaagacaagaaaaagguuuugaauuugccacaugugauuuuaaaaaaauguauggugggaaguuacuguuuguaaaggagagacacacugaaaaguuuauggaacuuugacauuacauuagagcacugaacaggaccaguacauaauaaauccuuuggaacuuguuaaucaaaagugcagucuauagaccagcagcaucaacaucaccuaguauguaggguuguaguaucucaagcuucauucuauaccuucuaaaucagaugugcauuuuacaagauccuggagcaauucaacugcacauuaaaguuuaaaaagugcuacucuagaaugaguuaaaaaaacauaucagaaggcuuucuagagagcuguuuacuuuccuaaagggacagguggcugggaggccuaccuguaauuuguguuaaaagcuaaaaaaggcuuagagcacccagaagcuaacagucaacagaucauuaucauuauuauuaucaucaaauacaugaugaaugaauggccuaaucuucuaggaauaaagcauguuuuaucaaagccaguaugguuggagaaauugcuauuacauuuaguuaugacugguggugaucgcagcacaucaaaaagggacuguuucaagcaaagccuucugaagagcaugugauuaauuaccuggggagaagaaaaggcugcauaaagaaaggcgucucauuaggaguuuuaguuuuagccccuagguccaagaaaacaagaaagcuauagcuuucuggguaacguagagaggcaguucucaaaggaugguguggaaagagucuguacccaagaacauauuccuaugccucuuaacuaauuuauaucuccuggcaugucuuaaaacaaugugacauauuauuggaaugucuuuugcuaauauaacauuauaacaaauuucuuuaugaacagcucucuuguagauacuacagggaauacauaaucccuauuacugccuuaauuuuaauauuauuaauccuagcaaaacaugugguauauauuagacuccucugguuguaaguaauagaaacaacuuaaaauucuuuggaaaaaagaagagcaauuuauuggcugcguggauacagaaaggggauuaaaugacuuacacauauguaugacaggaugcagcuaggacuuagaaccaacuggaaguaggaaugcaaacauucccaguucucucucucucucucucucucucucacacacacacacacacacacacacacacacacgcacacacacacacacucuuuuucuggcuuuuaacuucucuuaucuuugagugggccuaauugucuuucuucuguaagucaaauuuuguccauguguucagaaacaagacagcgauuccacuugaguuguacuucuuauaguuacuaucguugaaguggguuggcaauacauucuguguucugaaguucaaaauuucaggcaagucuuauauuucucaguuuaaguuagaugcuauauguagaccaauuagcuuucacccugaaggggcucuuguaaguaucgagcucugacucugaauaaaaugaaagcuauuagagaguaagaacaugacaauuuuauagaaacuaauagcuagggggaaaagaagaacaguuccauaaagaggaagaacugaccagaaaaaaauaacuugugucucuuuacaacuauuaccuaauugcuaacugaacccuuuuaagaacccuguaaaguauguuuuagauacuuauggaucaauuauuauuuauauuuacagcugauaauugauagagucuaccagucugacucuaguuccugcacacuaaugcauuuugcuauauuaacuccuauauauguguauguauucauucauuuauucuacaaauguuuguugaauggcugcuauugcuagccacucuucuaggcucuagggcugugcugauuaaaaucauauacuuuuggagauuauauucugguggagaaugccagauaauacacauaacaaauauguacaaagguacaauauauacuaccuaucuuguaugugaucaauguuacaaaaagaaagaaucagguugugguaucaggaguguugaggccaugauugcuguuuugaaugaggaguagaggucuggguccacguuaccaagaauguaauaauugagcaaagacuugaaagaggucaggaaaugagccauggcuauauacgggagaagaauuucccaagcagagagaauaacucccaagcagagagaauaaaacaauuguuuuugugauugugucuauuuucucagagagaaauauucaaggaacauagugucucuggagucuccagaaugaaguggaaaagggggaagcagaggauauaauacuggagagauaaugagugaaaugggggggggguuagauagcagcaggcacugaggcuguuguauuauuuuuguuuuuguugccaaugaaaugagauuuuggagaguuuugaacagagaagacaaaugaucugauauacuuuuuaagauaauuuuucuggcuacuccuacugaaaagagacaagaguagggagacagcuaugagaaugugccuuucaguaaucugacuucagggagcaaaaucaccaauggccccagcugcuguguucuguaaucuaucacuaccuugucuggauccucuuccaaucaacaccucagagaaggggaauagauuagaagauuugagaagaaauauacuugaaaagaaagagaaggugugaaagauucuucugacaggguugucuauauggaguaaauggccuuccuauagguuugcauggaauuguguguauacagacucaucuaaacagauauauggaagacaaagugcaucccauucacaguagugauccagggagaguagcguugaagaguaggguagaacugagguaggacucuugguuuuuauuuuguaaauuucuauuuuauuugauauuuauaauaagcuggcauuacuuuaaaaauuaauauguguuaaaacaaauacuaaauaaaauauauguuuuaaugaagaaaugaaaauauuucuuucaauacauguauguagcaauuaacuaaauauauaaucagugcagauauucucucuccaaucuaaggacacugaagaaccuugccugguaaucacccaugugaugggauggacagaucugaagcagagauggagucuccuaacuccugauucuucucuuauuucuggagaaauaagggucuuccaccucacucccuaacuuugauaucagaacuaggagagauaggguuuugugaaccuccccuuaaacagaaucacaugcacuacuauguuauuuuaaaugauauuucaagccugaauauaaaggagcaggagaaagcacuuuuguuuguucuucuuaaaccuaaugcgauuaaauauuaguauuaucugggucuaacacaaccaccagguauuuuaccuguaauaaauguuuauaugaguaaaggaacagaacuaauaauagguuauaauuuuauaauauuuuauggccaguuuagugauccauauaaauugcccuggagauguaaucagauuauucagagagcagaagcugcacaaaaaguacaauuuuuuuuuuuuucgcaauaagucuccagugagccuggcucuuuuccuaucccuagcagaauccuacguuuguaaagauuaucacagcuguguccuguaggggacucagauacccaaugucuugccaagauauuugcauaguagucagcuuuuaguagccaccauuuucuguuaaggucuguguccuugagaaaauauuuaacaguugcacuuaaugugguauccucuugagauuuaacuguuguuaauucuaaauuuuuacugugacuguugcagacaaaucuggggacuuauucacaaauuugccauccuuugauauucaguaauaacagagucaucucuuuauuaguuuccaaauaguuauuucauacuaucuuuccaaauguuuaauuaggaucuugagaaacuauuauuaguuuucuuucaugauagcaugaccuaauguauugauaacaugacucagaucuugaaucuaaagaagaaucuuagacauauuauuauuaacagauaucaaaaacauagagacauucuucaaaacuaggaaaugccagcaugcaaugaagggagcauuuaaauacuauagacuaaggguguuuacugauauaaauucaauguauuaauauuuaguauagcgacaaaugucuucuaauagucauaaugucaaugccuccaguuuucuugauauguguaaugaauuguauugagacauuaucuuauuugacucuucuguaguuuuucagauuccugacuaguucuuccuucuugaaaccccuuuaucuucuaguuucaacuaacucauacuuccuuagcucuccucuuaagucucuaauugaugcuucauauucccuuuggugggauauucuuuccaauuuuuaauucauuuauuaaauaagucaaauugauugaacaucuccuauaugaaggacuauaguagguacuaaaacugcagcaagaaaaaaauucaacaugguuuuaucuuuagaaagcauaaaauaaguaucggccuucucuagaguuuuauccuugcugugcuaucccuggacgauuucauccaguccaaugaaugauugaugaauucaugccuuucaaaucuguaauccuguauauauccugauauacauuauucccacauaaccuacugauccugagcagcuccaccugaguaucauuugucuauccauccauccauccauccauccauccauccauccauccaaccauccauccauccauccaugcacuuaaucaacauauauauaggccauaaagguaaauaaaauaaaaccaaaacuuuguucucaugaaauuuggaauaaauuugaaaauguagauaauacaaaagaaaacaaauauguaauagcuuuagauugugauaaaugucauaaaggacucauauguauaagauauuagguagcugugcaagagugguuauuuuagauaguguuauaaggaaaugccccuaaaagaugacauuuguuuaggaucagaauaaaguacuggagugggaaaaucaaagaacuggggaaagaguaucccagaugaaauggacuuucuuuuucauacaaugaaaauaaugucagugcagcuagaauggggcaugcaaagggguaaauucaaaauauaucacugauaugcugcagagauaaacaggggcagaucacauaaagaguuuguaguucauucuaaauaagguggaaagacauuggagguuuuagcucauaaguggcauuaucucauuuacaucuuuaaaagugcauauugcuugcuaaaggacauguuuuuuguuuuuuuuuuguuuuuguuuuugagacggagucuugcucguucacccaggcuggagugcaguggcgcgaaagugcugggauuacaggugugagccacugcgcccggccaggacacguuuuaaaggaggacaguagaggagaaacuaguuaguuuucuucagucaccuacuuggauuucuauuaaccuauuauugaagcacagguaugagaugauggugguugagacuaguaugauagugggcacgucuauuuauauaaauuuaugggguacaaguguaauuuuauuacauaaauauauugugcaguaguaaagucagggccuuuugcauaucuaccaccaccagaacaauguacauuguacccauuaaggaauuucucaucauccccccacuugacccccacccuuccagucuccauuuucuaccuuuccacacuauguccauguguacacauuauucagcucccacuuauaagugagaacaugcaguauuuauauuucugugucugaguuguuucacuuaagacaauggccuacaguuccauccauguugcugcaaaagacauuaauucauucuuuuuuauggcugaauguauuccauuguauauauauacaauagucuuguauacugacuauacaagggagagucuugagaaaugauucuacuuaagauagaacugacaggauuuguuccuggauuggauacuagacagccugaaaagagaauaagauaauuuuuaggguuuuguaugacuaacugaacacauuacuguauuguugacugaggugaaaaagacugagggaaaauccauuguggguagguuggagaaaguaaaauuuauauuuuggaccuuuaaugucuguuugaaauguuuuauaaacuucuaggaaggaauaucaugcagucuuuguauaaaugaucuggagcaaaagggaaaggucuaacuugaauauauuaauuuggaagucaccagcauauaaagaugacauuuaaaaaaccauacugaauaagaccauuuaggaaaagaauauaaauacauaagagaagaggccugaagacugguuccuaggaaauuccaacacuuagcagcugggaagaagaggaauuagcaaaggagacuaagaaguacuggccauuaagauaucaaaaaauauaaaaagaaaaaaauguccuuaagacauaguuguacauuuagcaaacagaugugauagaaacccauucuguauaucauaaguaaaacuaccagauccaguauuuuaaaacaucuucuauauacacaguugagccugaugaaacauaaagggauuucagaaaaucuguauuggauaggaaaagucaaguucguaaggguaacugaaugauaaagccagugacuuccuugggucaauccuagagauuuaacugcuuaggacagaacagaagaaaauagcugggaucaaaagcauauaaagaagcaugagguguaauacaaacaauagauaaaguggcggguacacaugccugucucccuaucuugccuucacauagaagaaaaaggaaaaaaaaaaagugaugaauaauuggauuggcucucucaacauucaguuuacuccccuucuauuggagaaguuuacucuccuucuauucucuauuggagaaucuaaaagcucaauuuuuagauucucuggaagccaugguccugugugucaauuuauaccagguauagaaggcagaaaugaagcacucuuccuguggcagaugcaacguucacacaagcaccaggaauauuugcagcaacugcaguccauguuuaaaugucuagaaacuagcuucuugaggauaagguaucuguagcagcccagugguggggcaauaacaaaaguuauucaggaccucuguaucguaaccaugauggggugauuuugaaagucuaggcaugcccccugauuuccacuucuucggcacuuccaauaauuuucugagcaccuaguuccauuuauuauauucuuuacugcuugaaauacaaaguauuuccuauuuccucuacuaaacccugacuguuaaaaacugcuuuagaaauaccuauuuauauuacgcauaccuuaugguuggcagcuggacuucgcaacaucugugcauccaaaaacacaagccaaagaaguuuuaagauuacccaguuaaucaugaccuccuccagugaagaaaaggaguaacacaaaauguaucucuugagaacucacuucaacuucaggccucaaauaaauccacaaaaauguucaacuaacucacaauuaaaaaucucuaaagaaacaaucaaaucaaugacugugagugauagccagcaaaaaaacaaaagugaacaaaagguuccaguaucaaaauaagaaagaauguuaauaaugguuucaucagauaagaucauauaguaagcacauuuaauaaguuuaaagaagaaaaaugaggaaauugaaauaugacuaaaaaauaguauacuaucaaaauuuaccaggaauaauugaaacugaauaagagggagaacuucuaguaaugaaaaauguuauaauuagaaacuguaguuuaauuaaauaguauaauacauauaacaaaauagaaaauuaauaaucuauauuguaaaauuuaagaaauuaccuagaaaacaacagagggagauaagaaaugaaaaauaugaaaaacagguuaagagauguacagcuagaaagaauagucuaucauagaaccaacugcauuuccagaauuagagcagagugaaugagucagaaccaauaugaaaaagauaaugauugagaaacuuuuagaauuaguaaaacaugcaaguccucagaauuagaaaucuuaauaaguuccauguaggaagaaagaagacacauuuuaaaauauuauggucgaaaccaauaagaacaaagacauaacauaccagaaucucugggacacacuuaaagcaguguguagaaggaaauuuauagcacucaaugcccauaagagaaagcaggaaagaacuaaaauugacacccuaacaucacaauuaaaagaacuagagaagcaagagcaaacacauucaaaaguuagcagaaggcaagaaauaacuaagaucggagcagaacugaaggagauagagacacaaaaaacccuucaaaaaaucaaugaauccagaagcugguuuuuugaaaagaucaacaaaauugauagaccgcuagcaagacuaauaaagaagaaaagagagaagaaucaaauagacacaauaaaaaacgauaaaggggauaucaccaccaaucccacagacauacaaacuaccaccagagaauacuauaaacaccucuacgcaaguaaacuagaaaaucuagaagacauagauaaauuccuggaaacauacacccucccaagacuaaaccaggaagaaguugaaucucugaauagaccaauaacagacucugaaauugaggcaauaauuaauagccuaccaaccaaaaaaaguccaggaccagacagauucacagccgaaugcuaccagagguacaaagaggagcugguaccauuccuucugaaaauguuccaaucaauagaaaaagagggaauccucccuaacucauuuuaugaggccagcaucauccugauaccaaaggcuggcagagacucaacaaaaaaagagacuuuuagaccaauaucccugaugaacaucgauuugaaaauccucaauaaaauacuggcaaacugaauccagcagcauauccaccacaaugaaguuggcuucaucccugcgaugcaaggcuaguucaacacacucaaaucaauaaacauaauccaucauauaaacagaacgaaagacaaaaaccacaugauuaucuccacagaugcagaaaaggccuucaacaaaauucaagagcccuucaugcuaaaaacucucaauaaacuaguuauugaugggauguauauaaaaauaauaagagcuauuuaugacaaacccacagacaauaucauacugaauggacaaaaacuggaagcacucucuuugaaaacuggcacaagacagggaugcccucucucaccacuccuguucaacauaguguuggaaguucuggccagggcaauuaggcaggagaaagaaauacaggguacucaaucaggaaaagaggaagucaaauugucccuguuugcagaugacaugauuguacauuuagaaaaccccaucgucucagcccaaaaucuccuuaagcugauaagcaacuucagcaaagucucaggauacaaaaucauugugcaaaaaucccaagcauucuuauacaccaguaacagacaaacagagagccaaaucaugagugaacucccuuucacaauugcuucaaagagaauaaaauaccuaggaauccaacuuauaaggguugugaaggaccucuucaaggagaacuacaaaccacugcucaaugaaaugaaagaggacacaaacaaauggaagaacauuccaugcucauggacacgaagaaucaauaucaugaaaauggccauagugcccaaggaaauuuauacauuaaaugccaucccaaucaagcuaccaaugacuuucuucacagaauuagaaaaaacuacuuuaaaguucauauggaaucaaaaaagggccugcauagccaagacaauccuaauucaaacgaacaaagcuggaggcaucacacuaccugacuucaaacuauacuacaaggcuacaguaaccaaaacagcaugguacugguaccaaaacagagauauagaccaauggaacagaacagagcccucagaaauaauaccacacaucuacaaccagcugaucuuugacaaaccugacaaaaauaaaaaauggggaaaggauucccuauuuaauaaauggugcugggaaaacuggcuagccauauguagaaagcugaaacuggaucccuuccuuacaccuuauacgauaauuaauucaagauggaucaaagacuuaaauguuagaccuaaaaccauaaaaacccuagaagaaaaccuaggcaauaccauucaggacagaagcaugggcaaggacuuccugacgaaaacaccaaaagcaauggcaacaaaagccaaaauugacaaaagugaucuaauuaaacuaaagagcuccugcgcagcaaaagaaacuaccaucagagugaacaggcaaccuacagaauaggagaaaauuuuugcagucuacucaucugacaaagggcuuauauccagaaucuacaaagaacucaaacaaauuuacaauaaaaaaacaaacaaccccauuaaaaagugggcaaaagauaugaacagacacuucucaaaagaagacauuuaugcagccaaaaaacacaugaaaaaaugcucaucaucacugcccaucagagaaaugcaaaucaaaaccacaaugagauaccaucucacaccaguuagaauggccaucauuaaaaagucaggaaacaacagguacuggagaggauguggagaaauaggaacacuuuucacuguuagugggacucuaaacuaguucaaccauuguggaagacaauguggcgauuccucagggaucuagaacuagaauuaccauuugacccagccaucccauuacuggguauauacccaaaggauuauaaaucaugcugcuauaaacacacaugcacauguaugucuauugcggcacuguucacaauaccaaagacuuggaaccaauccaaauguccaucaaugauagacuggauuaagaaaauguggcacauauacaccauggaauacuaugcagccauaaaaaaugaugaguucauguccuuuguaaggacauggaugaagcuggaaaccaucauucucagcaaacuauugcaaggacagaaaaccaaacaccacauguucucacucauaggugggaauucaacaaugagaacaguuggacacaggaaggggaacaucacacacuggggccuguuguugggugggggaagcggggagggauagcauuaggagauaaaccuaauguaaaugauagguuaaugagugcagcacaccaacauggcacauguguacauauguaacaaaccugcauguugugcacuuguacccuagaacuuaauguauaauaauaaaaaaaagaaaaaaaaagaaauaagaaaaaauaucccagaaaaugcaggaagaaagauuguuuaauuaaaaauauuaaacuuauggauaaaucuaaagaaaguauugauuauauaaaaauaauauuuaaguaaaaauuaaaauaaaucacugaauagaaauuauaaguaacaacgcuuuaauuggaauuaaaauauucuaggucccuguauuguuugggaggaggguaaagaugucaauuguagaacugaguuaaucacaaaugugaaauuucugauaucuaaaagcauagaaagaaucugucacuuccaucugaaagauauuuagaaugaggaaaaugaaaaccuagagaauauaauaucccagaagugaauaaaaaaaguauuucaaagaaaaaaaaacugacaacugugugagguaagaauauauuagguuuaaaaaguuucaacuauuggcaaucuuuucaaaaauagggcugaaucuaaaaugacacaugaaaucaugaaaucguguauuuuuaaaauuuguuuuguuuuuaugcaaauacaucaaacucuacuuaucaacgauuguacacauccucuucccuaaaaauauccuucuuuccauauuucuuaucucauuaaauuauaccaucaccuguauaacuaguugcuaacuaguuucaaacauauuuugaaaauaggauccuugguaaaauauuuugaacaaauuuguagauaucaggcuuuuuuuuauaauuagggaaauacauuuaaaagcaaaugcauccuguauguuuaccagcuagaaguagacauuuguagugggcucugugaugugcaguccugaccaccccuucucaggauuaaaaaucuuauucucccagcugccaagaauuccgugugacgauggcucucaguggacauucuccauuguggauggcuucaggugaggaaaacugcuuuuuucaaggagaguuuaccuucaauuauagaucacaguaggaauauaaggccacaucagcuugcccaauuuggggcaacuaugaagggugacaucuaucuuuggagugcuccacagcucuuucugcaaaaucaucuuuccuuccuuccauguggauaucaagagaacauucuaauaaauaucuuauauauuaauauauaucucagagucugcuucuagggaaaucaaacuugggacauuauuaaaauaucacagauauauacauuuaaacaguuugcaugagauuaaaaacuauauuaaugaaauaauauggcauaaauuuccauuacaauaggaaucauguuuggcaccuucuauuguuugacuuuuauaauauucuucauuuuuuugcuguaaaaaaacccagcaauauuauaauucagcuaugguugacucaugucuuccucuuacauugagaaagaagaaauaaagaaagggagggagggagagaggcuguaccuucuagcauagcuuuaguccauagauaguccuuagauaucugugaauuccagaauucccacuaguggaccucaaccuuggcugcaccucaaaaaucacuuacagaaguuuaaaaaaauguagaugcugucacauaugccagaauuucugauucaguuuuucugaagugcuauucugguguucauuuucuaaaauguccucauggguuaaaauuccucaaaguguugagaaucacuuauugacacagaauuuuagaucuucaucaauuuaccaaccucagcucuuugaccuuaucuuuuaugacucucuaaugcaaucuugccugucuucuuauauuuccguuaguaagguuucuuuuuuaugccaauaaucaucgcugacaugauuaccuguccaccccuuauccuccacuuacuucauguuccuuacuccaauugucuucuucuaacaauugauuuaagacuuaauguucuuuaaaagccuuucuuucgcuuuauuccauacagauccuuuuguuuguucagaugcuuguagugccaaaguuuauuuaaggcaccuccuuauagauaguuauauuagauuuuuauugcuguauaacaaauugccacacacuuagcagcuuauaacaauaccgauuuguuaucucacaguucuauaggucaaaagucugggcagccuggaugguuugcuuagggacucacaaaacugaaauuaagguauuggguaggcuggacucuuaucugguauucuaagaaauaauccacuuccaaacuuauucuaacgguuggcaaaauucuguuauuuucaguuguaggacugaggccauguuuuccuugaugaauuucagucaguaguuggucuggcucuccuagcgccuuuccuggaggcugcucucagguccuucccacaugcaaugcaugccucuuuugcacugagucuuucuaaugcuucgagucucucugauuuccuccucuacuagucagagaaaauucucugcuuuuaaaagacccauaugguaggucaagcccaccugugugaucuuccuauuuuaaagucaccuaauuaguaaccuuaauugcaucuguaaaaucccuuuugccaugaauauaacauauuaaugggggaaaaaaaacaaaggugagugucauggaggucaucuuagaauucucccuaccaaaacaguuuacaauuuuacuauuaauauuuuuaauguguccauuugaguuccugagcuaaauuaagaaauugacaagggacaguagccucuauuuucuuaugaaauaaaacguaagaguagucucuaacaucucugcacccaaauucuuaucuacugagucacuaauuuaugaaaaacaacauauugaauggcucuguguuuaaggucaauaagaucuuugcucauuacauguguguguguacauuuugaauggcuagcauucauuuuccccuuccugaaaguacccauguucuuuuggggagauacuaaguagugugcuguaaucagcuuguuccagcucacaagaaccaaugauuagcaucccuacccaacuccacauacugucacacugguagcuuaaaauuacuauuacgauuggaguauuuacaugauggaaaucuguaaauccaaaacaaaacaaacaggguuuuuugggggugggagagaacgaguuguucaacauauuuaucagcauauuacuaaaaauaaauuuugccuaauuuuuuauaucuugcuugucagaauaguaaauccagguggcugccuguggauaucucaucucaugcugugacuccagccaugccuugccccucaccagcucugacaccagcagaaggaggagauauggcauaagccuggacaacagaugcuucucuaagauguggacucuugaaugagaaacacaaggauagaaggaaugguugaaacauacuuuaaauggaugagugguaugcucuugaauuauaucucaauaaagcuguuuuuuuuaaaaaaagauacuaugugaucauuccugccaucccugcuuccuagucuuccagagcaguuaugcucccuuuggcuuucgagguuuaauucuugagacuccucuuaaugaguccagcauacauucagcaaauuacuuuuugcuuuaaguagccuaaaucuuuaucuuguggcuugcaaguuagaaacuaacuauauaauaucaauuucaagucuacauuaauaacaaugaaaacaauggcuucuuuggaagugaccuauuuucaacauaaucuaacauuaauucacaaacugguggcauauauuugauuaucuaucauuauuccauaauucauuucuguaagguuauguucauuauuauuauauuuuuccaggucaucauguauuuuagaaugauacuaguuaaauucucugaaagcuaauuauucaacuccuuacuaaaaaaauucacacaucauuuaaaucacuugagucauuggaaaguuuacaaggcuaacagaaaaauaauauaugaaaucauguaaaauuauaaauuauauuguuucuauuaacuugauguuucccagucucagguuagaugcucuucaccaacugcuugaagaaaguaguaauauauauauauauauauauauauauauauauauauuucacuuuuaaagggaaagauaaaacugauuuacugcugagaauuuaaaauggaauuuugaaaucccauucuuccaauuguuuaaauauauauuuauuuagugagagaaaauugugcacuuaacaucaaugcaggaaacagacacauaaccucucuucacuacuuaaagagauaaaauaagaaggugauugacacaccagcaauaaaugccacccagaggguauacucccuauaugaagagaugacucacaggaaauauaauucugcucacucgcaaagaaaauaaauuggaaugugauucaaaauguguagacauucauauucuucaacugaugugauuuuaaaauaacaacaggaaauuaaaugcagcauugcaguuuggggauaaauuucugaaagaaacucuauuuaauagauagagaaauuucuccaaauuucaguauuauuagaauuguggcagacaauucaaauuuuauguggcacaaaaucauaacguucucuucuauaagcugucccuugucuguuuguuuuuuaaacagcugucgacuuguucuguaucaucaauucugguaguucaggauuaauuuucacuauuaucaguggcagagcaugaugguacaauaagccaaaaugacuaaaagcauuucaaggaaaaaaaaaaaaccugaggagaauggaagagaaucucuauacgcaagcuaaucccuuaugaacagcagauuuggaaacugccugcagguaauuacauucagguaacccgaucugaaaaugccaaguucacacaaugguucauuuaauuccaucuggugugcaauaauacauucuuuaauggacacauugauuuaaaagaaaaaaaucaccucagauauaaaaagcccacauucgguaauuaaaaaauauuacaucaaaaauuagaaucucaaaaaugauccugcaaugcuuaaccuauaaaaaaggaaauuaagguaaugagcuuuagacuucucauaccuaaaucccuucuuaguuauggucugguuucuuaguaaggaaugcauauguuaauaugaagaauugagucaggacuucugauaccuugggaggaaaaaauaaauugauuaagaacauauuuaaaucauuaaauguacucagaaauaguuugaaaggaaacauuggcucuuggaauggugccaccugucaucaggauagaaauggugcaaauacauauauguauuuaacacagcccacuguugcucuccuuucaaaucugaaauacagccaaguaacuugguucucuaaacuaaugaaucacaugugaccaaaaucaccuugauggauaauuugggagaaaaaagccguguauuuguccuuuuaaggaaugugaauucugccuuuaaaugcuuuuuccaucagagcucuaagcacaugccuacuuaauccuccuuuuuaauucucucuucuuucacugaaaggagcaggguaaaaugaaccuccuguuuggguaauucuuuuucccugugguugauauguguguuucccauuuccuaauacacugaugacaacaaaaggcuuuuuucuuucuucuuucauucuuuucuucuccuuccuuccuuccuuuucuauucuuucuuucuuucuuuuucuuuuccuuccuuccuuccuuccuucuuucuuucuuucuuucuuucuuucuuucuuucuuucuuucuuucuuucguucuuucguucuuuucuuucuuucucuuucuuucuuuuuuuucuugccuuguugaaaugcaacaagccaggcuggaccuacuacaacuguaaaaagggaauggcuuuuucuuucuguuccaccuccccuuuuugagauuauuuuccccaacuauguucuuuccagcuuccaaaaccaaagucaacaccuagcccucucuccuuccuuuuggaugugcccuggaaucacccagguaugccuccaccacacuccagcagcaaacuuuuucucaagucuccucaucaaaaacuacauucuuaguuugauuaucucagauccuugcucucuuuaauacaaauuagguaauuugauaaauucaauaugcaaguaguuacuaguggguaugucaauggguuauuucacuuaucaaaaugcauuacuuuaaggaccuccuggugucagugccugaaccuaaaguaggaacucuguuaauaggaaauuaaguuacuauaauaaaucaauucuuuuuaacacuuaguauaggagaguauguaacuagugcauuucaggguaaugagauaaaaagauaguucauaguuuucauuaauucauucauuccauaaauauuuauuaagugccuacaaugugucaggcagaguuuucaccacuugggauucaacagugaacaaagaagacaaagauuccuacgaagagagauuacaugguggagguggugucucaugcaggaaaugagacaaacaauaauaaacauaauaaacauggaaauuuuauuuuauguuagauugugauaagugcuacaaaaaauauuaacucagauuaaagaagaauuaggagggggacacuccuagaaacagaauagaauggugguugccaggggacaguggguagggaaauggggagaugcuggucgaagcauauaaacuuuccauuauaaaauguguuuauauauaaugcuguacauuagauccccauagcuuaugauauugcuuugugucuccacccaaaucucauccccaugugugaagcgagggaccuguaauccacauguguggagggagaaaagugauuggauuauggauuaugggggcaguuuccccucaugcuguucuugugauggugagugaauucucaaaagaucugaugguuuuguaaaugguaguuuuuccugcauacuuacaugcucucucuuacaugccaccauguaagacacuccugcuuccccuucugccaucauuguaaguuuccugaggccuccccagccaggcaaaacggugagucaauuaaaccucuuuucuuuauaaauuacccagucucaggaaguuuuuuauagcagcaagaaaacagacuaauacagugacuauuguuaauaacacuccuauagacuugaaaucugguaagggaguagauauuauauuaaauauccugucauaaaaccaaaaaaacaaaaaauggcaaauaggugagaugauagauguguuaacuaacuugauugugguaaucauaucacaauauauaucuaugugugauguagugugugugugugugugugaaaucaucguguuguacaucuuaaacuuauaaaaauuauuuggcaauuauaucucaauaaaauugcaugaaaggaaaagaaaaaauaaaggaggagagggguaguuguacuauucaauaauacaaucggggcaggcuuauuaauaagauaaacuucaaggaaacaacgaaagagcuaacagaguuagccaggcuauuuugccugggagaacauuucaggcaaaggucuuuagaugaaauuguaaagagaauguuccagugaacagcaaaguagcuucuaccugcaguagagugauccaggaauggaauacaauguguaggaaauucauugugaaagggagcagagaguacuuaugauguugggucuuguaggacauuggaagaauguguuuuuuucauucuucuucuucuucuuuuuuuuuuuuuuuuuuuuuuuuuugagacagacucucacgaugucacccaggcuggaaugcgguguacgaucuuggcucacugcaaccuccaccucccagguucuagcaauuauccugccucagccuccugaguagcugggacuacaggcacaugccaucaugccuggcuaauuuuuguauuuuuaguagggaugggguuucacuauguuggccaggcuugucuugaacuucugaccucaggugauccgcccgccuuggccucccaaauugcugggauuacaggcgugagccauugugccuggccaaugucuucauucuuauacaauaguuccaagauauaauacugugugauagccuagugggacucauauuuugagucagguagacuuuuuacacaugcuagcugcuuauguguagggcugauuuugcacaaucugugcaucaacucaaagaaccauuacagucacagcuuauuugacuguaggaauucuaaaccaacccccuuaugaaaacugcaagaacuuaaucuguuuuugcuuuaaaguuuccucucgcucuuugcauaauagcuuugaggauaucuaguggcaucucauaacugauuaucauauuacuuuaaaaauguuucuucacagugaauuuaauguugaaggcauacuccauacuaguacuuagcauaaaacaauauuugagucagagcucauccuaagaauggaaguauguuugaauauaauuguaauguguuggaagucucugauuccuuuccucugguuaauaaaagaguaaguuucacauaguaagagagacuuagagcuguuguuaacaaugaacuauauccucuccuuuagaacccagaaggcacuagguaaguauccuuguggauguauagaaaagacacacuuagucauuucaacuggcauuauuccaggaaguuuuguucuguggcagacugcugugaagagggaauggugauuguuacuucaagucauuccucugcagaaggacccauuugaaagcaugacuacugaaggagaaaagagucacagcucuagaguggcaguucucucugcucccuuaugucccuuuugaaagcuguauaguucugaaaucugcagaauacaaggcauuucagauuaugucaaugucccuuuuuccugcagauuuuuuuccuauuugccuguuuccaaacagccuuaugugaaaaaaaaaagugguauauaacugauggagaaauauaacuuuaagacaaaaaucuggacuuuucucaauaaaugauaagccauaguguaucuuaguagcuaagcauaaguucauauccugcugcaauuucuuuuuccaugucugagcuauaaaauacguuugaaaaauuccuaugaaacuccauauuugagcauuugucuuuggcauauauucuuuuauauaaauuauaguuauuaaugaaacuuccaugccucccuauacacuuggggcuucaaacgcauauuuaaauauuaacaacgcucugauuaaggugcagaaacauggguagugaacuaauggaaacacuuugcucuuguuuugcuuuuauauuauauucaucaaaauuccaauuagcaacaugagaaugcagcaugacuuccuauguguauucuaguucacuuauaacuccuuccguuuaagggguuuggggaaaagaaauauuuuuagcauugaaauggaagcagguuuugaaauagucauuucaggugaauuuuaaagugacuacuuccuugauggguugaaauuuuacuucccuacccucaacuuccgcauuuacaauuaaucaaacaauugauguuuuucuuuuguuuguuuguuucaggcuuguaccugcuaguucacuugaaugcuucauugcacuaaugagcuccaggucaaaaguuuuugucccuguauaugccagcuaugucuggaggaaauuuaguacagagacuucaaaacacaauccaauuuucagccaaauacuugcauuagaaggcagcguaacucuucgccuuggaguauuacagaaaaacucaaacuuaaucugcauucauacuaauuaugcaaugauaggauauuuauauacuuauucacauuuuucccaacauauuggccuucuaugaguuaacuucuguaaguuccuuagggccauggucugugccugcuguuugcugauuauaguaaaugaaagaaucaauagacacaaggaaggaaggaagaaaucacagaggaugaaaggguguauuuaccuuuuucuuauaaaauuauggagugauaauggaagcagagaauauacauauauucaaaucucuccugccuaaaaauuuuacuucucacauuucuacauuaugaauuuaucuuuuucuucucuuucucaucccaaauuauugaacuaccuucauuuuuuauccauucacuacuuuucaaccuucucuguuuuuugccucaauaacaucaccaaaaccgcucacgcuaagauuaauaaugaccuugaaguuacuaaaugaauauuucaaaguccucauaugauuuuaacacaaagcaucauuuggccuuguugaucacucuuugcuucuugaaguacccuccuuacccucuccuguucauccucauacauuucuaaccacuuuacaaucuccacugaaugcucgucugccaacaauaaccuguuaaauguugagguuucucaauacucugugcuaaucuauuucuuuucucauugaugcucucucccaguaaccaguacagccaauuugcuagcuugcuuuaaaaaguaaucccugccucauuuuuuuucuugcuauacauauaucuaacuacguguuugcuugagaauuccaaaggcuaaucuuaaagcaacucaggcguaaaguggagauggcaguuaaaguuuucucccuucugagaagaaauuggugcacaguuaauccauacccugaccuaagcaaguugacaccaaggccuccagaugguucauuauucaagacagccacuggaaaaugacaagcagaccugcaaccuacaucacuccugcacauaguuuccaugccgccuuccucuucaaaccccauuagccagccugagaauuugagauggcuuuuugagaccugacuccagcugucucuucagcugcuagcacuucaauaaaccucuuucuucccaccaacucuugauucuugugucuggcuuuucaaguggggagcagccguacaggaauucaguuccaucccuuggcaaucuugaacagaaccaucuccagaucuuuaugauaaucuauauagugauuacuccuaaauuuuauacuaacccucugaguuccaauuguuuauucaacaugugcauguggaggucucaaaagcuaccucugagaacugggaccacaguugucuuguuuguuccaguaaaccuauacacagaaaagauaagacuguaauccuauaaauaacucuacuguuugcuucaggaaauucuugcagaucaauuuagagacaacagucugcucaccugaaaaagucugccuugaaaaauccaccuuaaacuccuggaucccagaccccaaaauuuaauaaaaucucauuucugacuuucccuuuuugagacaauaaaacucuuuccaguaguuucugaaugcaauuagguuccaauacauuuagcauugcuuuauuaacagguuguucuuuuguaaucuggggaauucaacacuuucaacucaauuugucaaacagauuuaaggauuuuccacacaaaccugcucaucuuucuguguucucaauuuuauuuuauuuuauuuuauuuuugagauggagucucguucugcgcccaggcuggagugcaguggcacaaucuuaguucacugcaaccuccaucucccggguucaagcgauucuccugccucagccucccaaguagcugggacuacaggagugcgccaccaaaccugguuaacuuuuuguguguguguuuguuuuuaguagagacagaguuuuaccauguuggccaagcuggccucaaacuccugaccucaagugaucugccugccuccaccucccaaagugcugggauuacaggagugagccacugugcccggcucaguguucucaauauuaauaaaccauaaaaacauuugacuuuggaaaccaaaaacuuauaggucuuuacuuaucuauuuuugcaucuacuaaauaguauugcuuugcaugucuaguaaauaucuguggaauaaacaaacaagauaaaacugauaaugcuuguuguaucaaaaucucucauuacccccuucuaguggaauaucaggggagccagaagaagagguaucaguggagagcugugucccaccccaccuacacaaggcaguaagcauauauacacccugcacaauauguauaaacaauuaauaaagcaaagcccaucaauuuuaucauuaucauuacaccacaauaauuguacauaauuuuaauaauaaauucucuuccucauaaggggaauaggucucaugcccucuuccugcacuuaacuuugccauuguugaauuuuaugucaaggagauuguuuauugaaucuuuaaaacugcuacucccaccauugggaaagcugccaguagguagcacuagauuuucuugaucccuuuacucauuucaaaagcuagugcuuuauucuagaauugauagacagcuuuuauucuuuggaagagaaguauaaaaccucaggauucucuuugcagcagacucuccaguuucauucauuaauucuucuucuuuuuuauuuauuauuauuauuauuauuauuuuuugagacaaggucuugcucugucaccaaggcuggagugcaguggcucugucuuggcucagccacugcaaccucuaccucucggguucaagcaauucucgugucucagccuccugaguagcugggucuacaggcaugcugaccaugccuggcuaauuuuuguaauuuuaacagagacaggguuucgccauguuggcuaagcuggucuggaacucuuagccucaagugauccaccugcuuuggccucccaaaguguugggauuacaggugugagccaccgcacccugccucauucauuaauucuugaaaaaaugauugagcacaauuauaugccagguccuauuuuaggaggugaggaaacaacagugaaccuaaaggaauacauauuugccuucaaggagcuugcagucugaugugagauucaggaaaccaacaugauaaauauauaauguauuauauacacuuacugcuagauaaaauauuuaguauguaaaaguaaaagaaaauaaagcagagaaggggagaggaggugucuauguauggaggagaguugaacauuuuagauaguguggcuguuggcuaaaaaucuguuuguagcuuaguaaccacuuauuuauuucagauacaaacuuacacccacccucaaaauauuucuuaaaguuauagugauaucaaguuuuccuucacaaggaauauuuuauacucuguugacuucauuacaugaugugaugaaggaagcaacacuucaguugcuuagaguugugagaacaauuuuuggaaaaagucuuauugcauuggugacagccauuuuguguacauuguaagaaauucuaguuuucaguaaauucuccaaaggauucacagacuacuuauucuauuuuucuguuuuuccuuucuuauuacugccuuucuccauuauguagaguuauucaauauuuuuuuuagccuguugaaacccuuuacuaacauguggaaaaaagagacuuuuccuugcuuucauuaaguaagcaguguugaaccugcagccgaagcucacuucgacugaguuuacaauuuguguaacaaggaucaguggcuuguucuugaagacguucaaucagcuaggaucaacacucagaaaaaacugcuguuuuaugaagacccuaauacucacggaaaugaaugugaacuauggaaacaggaauagaauugauuuugaacuguaauagauucacaggucaugcuagacacuuucgaaaccacaaaacacagcuuaggugaaacaauaaaaauaaguuaagauggucuuugucaaaggacucgacacugaaccaucacuuccggccagaucuucuuucuaaaggaaggaaaggggguaugcagagcaacugaauucccuccaaucauaggagcacugaggguagaaaguccauuuuuguuauuauggcuauuuacauuauuuucucugauaguaagcugugaaauuuaggaagauuuugccucuucauggaucaauuauucauuggcaguacauagaucccuauguugaauugauaucuacuucacagaccugaugucuaauaugaacaggccucugguaauaaaaguuuuuaaaaaaaaaaaucagaaagaaauuaauacaauagguauguauuuguguuuguaaaacuaucucgaaaaaauuaaaaaugcagcuagaauuaaaagugguaguaaagucaaacaguuuaccccuuuccuugugaaugcugauuauuguguacacuuuagggaaauaagaguauagagaaaaugguuuggguuaauaauaaguuaugaaauauuuggaauggaauuauuggcaauuuggaaaguuaauuauuaucauuaaauuuaaguuauauuucggguaaacuauguuccuuuugagaggagggagaauuaaaauuauuauuugcaaaauauuuuccauucucagguuaauaucuggagguacugauggaagaaucugcaucaagaucccugcauggaggagucugggaagaaucauagacaaugaaagguaaaagucaguucaaagagggauuacuaaaaaaaauuuaaaaauaaacaaagcugugaagagcugugagcuacuauacauucuaagauuguuuaggucaaacugguaagaaaggaaaaaaaaaaugacgagaaaauuuagaagcuaaagccauuugcugcuuauuuuccagauuaaaaaagagcauuuaaugucacucauuaguauuauucccuuuccuggacugaaauucugagucugaaaaauaccacaauaccacaauagguuauuucuuuuuuuccuuuuccucuuauuuuuuuuuuuuuuauuuuuuucuuucugagacggagucucgcucuguagcccaggcuggaguguaguggcgcuaucucggcucacugcaacauccaccucccggguccccauucaagcaauucuccugccccagccucccaaguagcugggauuacaggcacacaccaccaugcccagcuaauuuuuguauuuuuaguagagacgggcuuucaucauguuggccaggcuggucuuaaacuccuaaccucguaaucugcccaccucggcuucccaaaguguugggauuacaggcgugagccaccgcgccuggccccacaguagguuauuucuaaaaaacacuauuuaaauuuacauuuuaucaaguaaaauauaaaccuuuauuauaguuaccaagaagucauugguuuggaaacaaucacaaaagaaugcaagaaagaacaagaacgcccaaaagggaagaaaaguuuugccaguuuguuuccauaauauugguucuaucaacucaauaaacauaaaugcaucaauuaaucugcuucucuauauuauuuuuaauaacaguaaauaauccccaucuauuaaacguggaacagcuauuuuuaaaauacacuucaaaguguauacaauuaucagucugcugaagguauuccuaucuuucuuucaucucaauaccccuaccaccaacacaagucaucuucuccagaaaggcuuuguuuaaucucauucuuugguuaccuuuucuugcuaauagcacuuuaggaaaauaucuaauuuucuuccaccuucccuuccucucccaugucacaucucugccuccagaucacuguauuccagaagugaaaaucaauuuccaacauaguguaggggaauuuaauaagcuucugagacgaaugaaaugagcaaucucacaucuggaaaauguuuaaugaaugaagaaguuuuuuuaaaaucagcauccuguuucuaccuaaacauaaaagcucuucucuuagcccaaccuuuagaagucagcauucuuuugguagucucaacuccuuguuaucucuggcuuagccugggcucucucuguuucagggaaagaacauuuuguuguuguucugcugugcuuuaguuuggcaaacuaagaaaaagaaaaaaacauugaaaagaaaaaucguaacguuaacaaaguuuccaacuucaugcugcagacauguauauaaucagguaacaaguguauguugagguaauuuaguuauggaaauagaaauccaaguagaguccuaugggaauuaauuucagauggggaagcgugaggauuuggccauugaaucacauagaucguuaacuugugauuuauagacuuuugacucuggaaguagucuaauggauauagaucagagauguauuauguccaaggcagacaacuucaugggaaaauuguuaaaauaauccaggcaagaggcaauaaaggccugauacaccauccaaacuauuuaauaagaaauuaugcuggcugcuccuguuccauugacuugguuuaaccagccuuuacuugguccucagauuauucuuuuuauuugcacucuaaauuccaacgauucuugcauuguuuccauauucuuuuucuguccaauauuucccuacccaaacaauugugcuauuucuaggaacucuuuuucauaaucucacuaguuugguuugcauauucuucaauuaaaccucucucaauauugaaagaaccuccuaaaacuauccuuacucuacccuaagcaucaucagccaaaguugucccuuuguccagagguuccuauccccuucacccuaaauucagcuuaucuuuccucuaacccauggacuuaguccaugcagauuagcauauuagagaaauucauccaaaucaccccgaauuguggauuugacucucuuugaagcuuuuuaaaugcuuguuuacuuucacuuuacuacaaguauuucccugucuauaaacuugacaacuacauuuaaccuuuuguucugcagucagcuuuagaggagaaaggugcucuuagcuacagcugucauuucuaugagcuuugccccaugauuuccucccugauaucaagaggcaaguccccucauuuuggggagucacagaacucuauuacugucuaaaucuaccagguucauuaaaacucuuaaaaauauuuuacuaacauuuuugcauccacaauaauuuaucacauuaugaauuuggacauuuaaucaaaauugucaaaauuacauuaaaagaaaaacccagcagaacaacaaagaaaucucauuucuuggaugucauuguucaaauuuagcaaaauaucucuucuugcaaaauaauucauuuauucacacaucaaauugcacucucuguuaacuauacauuuuuacuagaaggacacgauuuggccuuccaguaaaaugguauccucuauguagcuuuuuauuuguugcacuccuucuauucaauuaaaaaaauauuugcuaccuauuacacacaaagcaauaagcaugcuguuuuguuuuaguuuaauuuuuuuuucuacugguguccuauuuguuuuuaagcaaaaaauguuuuccccaguuuaauaaaaagggccucuuuacauuccuuguaguguguguuaaaguacacaaaacaauguucuuuugcugaaacugguauuauuuucuugauucucuuugcaaaagcaacauuguuuuuuucauucuuauugaacaucaaaguacuuaucaaaggcucugaagugugaccaaucucaauuuucccaaagagaagccauacuuuuccuaaggggggaaaaaagcaccucuaguaaaaauccuauauuugugguguugucuugucuguuugacuaguguuuuaacucucucuccacugcauucuuuuucuacaauuuccuugauauaguaaauuccagguuaauguaacauagauaacaguggguucucuuauauauauauauauauauauauuuaaaauauuauuuccaaaguauugucuuaauuuaaaaaaauaguucucgauuuuaaauuaaauuucagauuuuacgaaaauaaaguuaaguacacagguuuucuucuaaguggaucaguguaauugauauguauuucuucuaaguggaucaguguaaguauuaauauauauuuuuaaaaauuuccuuuaaaguacuuuuuaaaauauuugcuuugcaauauuuaauaauaauucugagguuggugaaugagaaugcaauauaagcaaugagaaaagaaaaauauaauucaauuaguauacucagagaaguauuauuuuuaaaauccucagauaaaauuuguaaaaauuaaaaagcaauauuuguuuuaugaaaugguaauaccauuucaauugucauagcuugaguguuguuugauaaagcuaagaagagaagaaacucauaagauguaugaguaaucuaaaccaguucuguaagucauaguugguaaguuuagauggauggauggauggaugguagaauggauugcuggcuaaccagauagauggauagguguauggauacauaaacaaaaaaacacacagaggcagacagauacccugacaggaaacaugagucuaugaaucagagaacagagcauuuauuauucacacagcaccuuagcauuggcuccugcgcccugaucaccacaaggugaugugaugagagccugauauuacucaaugcuaguagugguguuaaacaggagaaugagacuugaagcccacgaaggacaguggcauaucagcccauccuaccccaagaaugacaaggacccuacucuagaauguaaacaauucucuggaaauuggaggggaaguucucucucuaucacacuggaauauaaaugaauggcucuggggaagauauauuuguaaaucucucuggaacaaugcuccguuuguagcuucuaggacauauuuugauauucagucauucugauaugguuuggauuuaugucccugcccaaaucucaugucgaauuguaauccccaguguuagaggaggugccuggagggaggugauuggaucauagggguggauuucucccuugcuguucucaugauagugggugaguucucacaagaucugguuguuuaaaaguguguaacaccucccccuguuuccucuuccuccuucucuggucacguaagacaugccugccucuccuuugccucccuccaugauguaaguguccugaggccuccccagccaugcuuccuguacagccugcagaacugugagugaauuaaaccucuuuucuuuaaaauuacccagucucagguaguuguuuauacagcaaugugagaaauggacuaauauacauucuuuaaccaaguuucaucagcuuuugcuaaaaaagcccaggcucuacagaaacauggaaauauucauguagaaucacuuucuuacaauaguaaucauuauaauuagucucucuuuaaaauacuguguaguuggauauauuguugguuuuauuaggaaaugagcauaaaauaggaaacaggcauaauagccacuuucaauaaaguagccuaugaaacugccacagaaaauuagguuuuuauacuuaccuuugcaaguguacagaagaugaauguauaugaauggucaaauuacuugaaaaugaaguuuaccuguaauuccaaauuuuucaguugugcguacauauguauguguauuacacaaauuaaacauuauaaguggaaaacaugaauauuauguucgcauugcucagugagaguuacucugccuguuagugauggggcauaacuggcauacaggaccuucugaagaccccuggcugcuguauucaugcggcccauggggcuuucagccacaguuuauuccaaguaaacgguuuaaaauucuagcuuuauucacugauuaccuauauuuauuuccuauagagaagacaguauugcaacuguuucaacuguuuacaucuggcuuuagcauauuuuuagaagccuguacuguacuugauaauaauacuuugaacagcauguauaaaauguuuaauaaugcgaagauaagagaauugaaaaaaucugaugguuaaagaaugguugaaagcaaaaacauaagaacaaauuuuaucauuuaagggaaaauacauauuuuuucuucuuugaaaguaauuuuucccuucucugagcucucauaagauuuuauugguguguuucauaguuccucuuauacacuacaguguaauuaucuuuacuagauuacagguuacuuagcgacaucuuuguauacuucauagcuucuuacaaaaugccuuauguagguggcucucaagaaauuugucgaauuuccugaguuuuauuuuuauuuuaucauguuuuguuuucugguugacgaucaaaaugaaccuccuuuuaucagaacacauuucaaaacaacaacaaaacaaaaugaaguggcuguaaucacucuaauucaauaauaaauagguggauaaugugagacauuguaaauauauuaaauaacuuugcugauaucguaagcacugacccacaauacguaggauuauguaacuaagcauaaaaauaacuugugugguacuuugauaaaccacaaaauggaaucuucaaauuaaacaguuacuguuuuaaaacaagccuaauaugaugaugaucaccauuucuguuuuuuugauauuaucaucauuaacaucuguuuucuuuaguguagaaaugauuccaaaaggcaagagauguuuaaaacuacauaaugcuuuuagucucuuuacuaauucauaauauguuguucuucauguuaacuuuuaacgaaucccaguuuaaacuugaaaguaaaaaauaugagaaaauaacuacuuuuuaauuuaggaagucccacaguguggagcuuguuacuccccacauaauuauagguuaaauauauaaacacuuuuuaaagacuaguuuagauaaauugauaaaugguaugucaaaaagagcuuauuugggaaguaaagacaguuuacaauuaaacauuuaauaucuucuuaaaaugauaacguuuguuuccuauuauaaaaugcuucauauauauguuuagaaaauuuguguauugagggaagagagagaccuucucauauuguuuuauauuguuuuauacucaguaccuguuuuaagaaaaaacaacaaggcaguaaaaccaaagacaggcagcccggugucaggcccgaaaacaggccugggccugccuggccuaaacccaguaguuaaaaaucaacucauaacuuagaaacugauguuauucauagauuccagacauuguguagaagaacacugugaaacucccugcccuguucuguuucucucugaccaccggugcaugcagccccugucacguacugccugcuugcucaaaucaaucacaacacuuucaugugaaaucuuuaguguugugagcccuuaaaaggggcacaaauugugcauuuggggagcucggauuuuaaggcaguagcuugccaaugcucccagcugaauaaagcccuaccgucuacaacucggugucugagagguuuugucugcggcucguccugcuacaguauuaugggccaauaguccacaaagugucaccccaagacuuuuuggaguucuucaaggccaaauauuuuuccuaauaauaguaagauauauuugccuucacuauguugauauuuguacugauggagcaaaagcugacauggguaaaagugcuguaccucaacacagaucaaggcugggcacagacuuuacugguggacacugcauucuucacuacuuaacacugcuaguaugaaagaaaauaaaagcuaaguucacuuaagaauguccuugaagaaauagugaacauuauuaauuuuauuauaucuugacccuugauggggucagcccuaauauauucacagguuccauaucugcagauucaauaacuauggaucaaaaagauuucaaauauauaugugcaacacaacaaugaaaaauaugccaggcaugggaguaccugccuguaaucccagcaaacucaggaggcugagagaugaucacuuaacccaggaguuugagaccagucugggcaacauaaggagaccccaucacacacacacaaaaggaagagaaagagaaauauaauacaaauaaagaacaaauacuguauagcaacuauuuacauaauuuagagaugauuuaaaguguacacgagaaugcauguagguuauaugcaaauacuacuucaucuuaaauaagggacuugggcaucugcagauuuggguauuugcagagguccuagaaacaaucugcuguagauaacaagggaaauuugcaguuaucuucuaauauuauguguaugcaugaagcauacuuguauucuuaugccuuaaauaucugggacucuuacagaaggcacaauacaaaggaauaaaauaauuaaauaccuugaaaauaauucaaugauuuaaaaauacagauugcaagaggagaagguuaaagaaauccagauuuaauccuuuuuuuauauauauauuuuuauuauacuuuaaguucuaggguacauguggacaacguacagguuuguuacauauguauacaugugccauguuggugugccgcacccaucaacucaucauuuaacauuagguauaucucuuaaugcuaucccuccccccuccccccaccccacaacaggccccagugugugauguuccccuuccuguguccauguguucucauuguucagauucaauucuuaucagagaaagauaauuaaacggagaucacucaacuaagacuuuuuuuuccccguuucaaacagcaaaaugcgcuuacauacucauuuaaauugaauucauaaagugaaaccuaaaacagccaguuugugguuaagucuccucccuacuucuugcccuuacuguaacuuccucaggccuugccuuucuacugcauuuauauguagauacaaauaguaucuguaucuauuuuccucagggccugaacuaccugaaugcauagugggcuacgagugccugagaauuaaagguucugggaauagcccacgacugauugaaaguugucagguacagaaccuaaaugaauucuaugcugccuuccagaguucccuguaggauuacauuccaauuccuuauagcagugacuuguuugaaaacaaauucuuuauuggcugccuuuauuuuucuaucauaacuacauuuuuucucuuugacaaaaguuuauuuuauuuuagccuauuucauuaagaaaaaauacugcauauuacccauuaaucucauuucauuacucacuaaugagucccaacugacauuuugaaaaacccuagcuucugaagauaaaaugaugagcaaaagcagaugccauguaucuucaaagaaucuuagauaaacauaaaucaaaucauuucaaaaguuaaugugaaaguuaccucuguaauugcugcaaagcaaagguacauggaauuaagaagauaugucaggaagaucugcacuggagacagggaggaggaacaguaaggggaggcuuccucaagaaauggugauuaagcugaaauuugaagaaggguuggaguaaauucugaggauggcuuauuuagagagaauaucuuugugagaaguuggacauggaggguguuauguaaugaauguuuguauccacccaaaauucauaugcugaaauccuacccaccaaugugauugugcuaaaagggucuuugggagguaaauuaggucaaggugauuuaggugaagcccucaugaaugaaauuagccucuuuuaaaagggaccauagagagcuugcuagugcucuuuguggcauuugagggaacagccaggaguuggcggucuguaaccugaaaguggacccucaccagaaccugaccacacuggccuccugaucuuagacuucagccuucagaacugugagaaauaaauuucuguuguuuauaagccauucagccuauggcacuuuguuauaauaguuugaacuaacuaagacagagacugaggaagaaggagacaucaagaacaacugcuagauucaugguuugcccaguuagauggaugaugaugguguuugcugaacagggaagacuaacaaggaccauauuugggcaaagaugggguggaaauauccuaaaagcauuauuaaacauacugcuuuuaaaguauccaugugguaaacccaagaagguaauuagauaaggggaucuggauuccagagccaaagucuaggacuuaaauaacaauugauuaucugcacaugguacaguauagaaaaaaagcaaaagaaagugaacagaaucugauaauauuguguuauauacuuccuauguaugcuccaucugauuuccuaagugaauuuuaagggguucuuaaauaaauuuuguacagaaaauuggucaagugaaagagaauaauauuuauguauaaaaaguuaaaaagacaaguuguacuaucaaaccugaagaaaagauauuugccugugaucaugaucaugauauuagccaauacuauguagcuggcacaacauuaggcccuuuauaugcaauaccauuauuaauuaacaaaaucauauggaauagauagcccaguuuuccagaugaguagauagauaaaauaauuacuucaagauuauaaaucuaaaaaagcccagauuagggaucacuacauugagcaugucucauugcagagcccgaauuucacugugcagccaaaugcugucagacaagaucuuugaccauaugcuuuccucaaaagaaauauucucuuuuaagcugcuacacuauaucaauccuaugaguaauuacucuuuuuucauauaaaaggauacauuuucauauauauaugccaguuaaaaauuaugaugcuuauaaaugccuuuaauggcgauagaauaauaaacauaacauaaaaggucuuaucgguaauuuuauuguucauuuacuuauucauucaucaauauuuauugagcaccuacacauguaucacguacugcucuugaugccuacuaugucagacagcccaugcguaauagaaaugggaauucagaauaaguuuccuugaccuugucauggauuacaggacaaaaaaguaagacuuuuuucuaucaucucucuuuucccucugaucuuuuuauaauguaugccauagauaugaccagggcuuaaaugauuuggaaagcaaauaaagagacaagcacaugggaauugguuuuuuaauugacaauaccaauauauguuuuuaaagaauguaauaguaaaguaauucaaaguuuuggaauacaauauagggggaaucacauucagauauaagagauuugacuuguaagucaaacuggacaaauguaugcaaugcuuugaaaauuuauucacugugauuuuugagaacaacgacuuacccuuguagacaaagguaaaaacaaaauaacaaaauugucaaaaaguauuuagacucaggaaacuaucucuugcuggucagauucauucaaguuucuuuuucaaugcaaaauaaucaaauuaaccuaccauaagugguuugguuaaacauguaacagaaaugaauagauauacauggccagagagugaaauauaugaaacuguaaucauauauguuuguuuguuggauguuugcauguaaaagaaggaaguucugugaguuugacugggagauacaguucccacccuugccucagcugcugcucucuuucuuugcucaccuuuacagaaacauucugaaauagguaccuuuccuggauccacuucaguuaggcuuugcuucuuguaguaggcugaaagauagccaccuagagauaccauguggaaccauaaguuaucuuucaaggaaaaugggucucuacagaugggauuaaauuaaggaucuugacaugggagauuauuuuggauuaucuguggggugggagggggggauccguaaauccaaucacauuuccuuauuagagggagguagaugagauuugauauacacaagaaaagaggagcaaugugaaaauaaagguacagauugaauuugaguggccaccaacaaaugcauggcagccacaauaaacuggaagaggcagguuagaggcccuggacggacuauggccugccaacaccauuaucucaaccuagugaaaccccaguauuaaacuucuggccuccagaacugugaaagcauacauaucugcuauuucaagcuaccuauuuuugugguaauuuauuaggacagccauaggaaacaaauacagcucuauuccaaaauaaaaaucugcuguagucaaauucacaaaugaauuagcagcuaaauccaacauacucaaggcuaugcuaucugacgugguugaucauucccuccauuuauccuuuaguuggugugauggucaguuuuauguaucaacuaggauauagucccaguuauccaauaaaaugccaaucucaguguuuuugugaaaaugucauuaaagccuauaaauaauugacauuaaaagagagacuuuauccaagaucaucuggaugggucugauucaaucaguugaacagccuuaauaucaaaacugagaaugucugaagaagaaaaaugagaaggaugaagaggaggaggaggaggagcggggagaggaggaggaggaggaggaagaggagauauaauuccacuuguggacuguauccuucacucauccccaaaaauuccagccugccauucuugacagccugcccugcagauuucagauuugccuaaucugauaagccaauucucugcauaaauaucuuaauauacauuuacuacuacuucuguuucucugguugaaccccgauugauacauuuggcauugaggauaucacacuuuccuggcuuuacuccuauuugaacagcuguuucuuuucagucuccuguacucuuuuaucuucauauuucuuaccucuuaauguuggaaaauccaagacuccacauuuggaccucguuuuucucgauuucacucacuccaugauuuauuuuaaaucuuccccaugugcugaucccuuugaauuuauuuuuaaucuccagccuggaucccuucccuaaacuuucauuuuauucacccaguugccugcaucuccaccuuaggcuuuuacuaggcauuuuaacauaagauuuaauaucuuuagauuucugucuaaaucuggauuucucaucuucuucagucuucccuuucuuaguaaaggacaccuguccuuccuguugcucaggccaggaucuugaaaccauacuuuacuucucccuuuauuucacacccuauccgauaaauuaacaaauaaaggaacucuauuuuugaaaguuaucacaaacagggacacuuucuccuacccuguuccaaaguacgaacugggcacgguggcucaugccuguaaucccagcacuuagagaggcugaggcgggccgaucaccugaggucaggaguucgagaccagccuggccaacauggcaaaacuccaucuguacugaaaauacaaaaauuuaccugggcauggugguacgugccuguaaucccagcuacucgggaggcugaggcaggagaauuguuugaaccugagagguggagguuacagugagccgagaucacaccacugcacuccagccugggcaacagagugagacucugucacaaaccagcaaacagaaucaaaaaacaaagugccauaauauuuuacuuauugcauuaauauccuagauguuuuuucuucuguccuugcugccauguguguguacacacacacacacucucucucucucacauacacacauacaaaugcaucauuuauucuccauaggcuaguuagcaauccuuguaaaacauaaauaaaauuacaacauucuucugcuccaaaccaucuggaagcuucuugauuuagaguaaaagccaaaguuccuucaaugacuagccugauauggaucaccuccacugcugauuucaacuccugccacucuuuuucugccucccugagacacaaccacacucaucuuuucguuuuuuuguggagcaaacaaggaaaaugcaaggauuuggaauuuauugaucccuccucugcucacuucacccauguccuagucccacauagcuuguuccuuuacuuuuaucucagucauaugcuccaguaucaccucaucaacaaugucauccauguuaauucuagucaaaauuauaaugacuuucccuucaucuauucacuauccauugucccugcuuuacuucuccccacagcauaaucgccgucugugaucaguacaugauauguuauguguucacuuaguuucugucuccuaccacuagaauauaaguuccuuaauaccaagcauuuuuuguucacugccauaucauuuggggucuaguacagugccuggcacauaguaggcacgcaauaaauaguacaugaaugaauggaugacugagugagcuuuggcuuaugauuggguggauccauaagccaauaugaacaaauaaaagaacauuuaauaacacagccaaaaacaccuugagaggcuagccauuuuuuaucuuauuuuuguaguguugcuuauuggguugauuucccgcaaauuauuuuggcaacaacuacuuuguaggcauuuuuuuuuuucaauaaugugucuuucgggauauaugacuaccuauuagaucucuuuuuagucugcuugauguuaaaggucuaaggauggaggaggauuaaaaaagagaggucuuagaacaacacuguaacacuuuguuucaguuagauauucaagacuaaagaauucacuuauuuugccuuuaauucacuuauuuuugucuugaacauuuuuauaauuaacuucguuaaauuucucuuauuccauaaaguuuauuuuuacuuauuaguauugaaugugccucgauuagacucagcagcguauaacuguaugggagcggauguagauagcuguccagccacauaaaugcuccugugacugguggagaacaccagcacaguagugacuuagugacuccaguguuaauugaaugaauauuuuaccucacaauuuuuuuucugacuuggaggcacaauaauguaacuguauuaaaagaacaugccgugcaccuggggaggaugggugguuaagagcacucuaaggguuuucacugauuguacucaggggugcagcaggacugauuugcuucacauggaugaauaguuugacaccuuguugcuuaaaaauugcuuauguuuaaaguacacuccacagcuaaagggcuaugcagaugccacauuacugaauagcauauggacaucuccggggcuguuaaaaaugaucacaccaaccgucuguuuuuacuggggcuuacuguauuuauacaguucuaagagagaagauuacaccuuccaauguagcucaggggaccuauauuaaggaggaaaggaagcagagaaaggacuugugaacuugcaagccaaacuuuauguuucaguaauggucucuuucuuaacaauguggcaguuuuaaaucucagaaaggccaacauaauuuuaagauaaaaaccacuauuuuuaaaauuuauaacuuaagucuuuaaaaccucucacuauguacaguuugguggcaagaauggagugacuggcauuuuuuguuugaacagcaaaacucauuuaguugcuggcacaaauuuauaugaguucaaaaauuguccccagcuuuguuguaacuucagaguuucuaccugggaaagaaaagggccuaaaagaauagcuauguuuucccucaauaacagaaggaagacuuuaccuucugugaccccuuacuucuuaguucuguucauagccuguaucuuuuucuauuaccaaaccucuaaauuucuccugguauuuaaaugguccacagugucaagcagcaugcugagcacauaguaccuccucaguagagcauagauaaugugcaagacacagggcugaggacuauggggaagacaguaccccagccccuuauauuuaugccagaagauauggggagaaggacugcagcuauuccucuacaaauuuuuacuacagcaaacaccagaugaauuguacaacauaaguuucauucaaauuuguccucugaguauguaaaaucacaaguccuuaaucaccaagagcaaaaacaauuucugagcagcaucuuguggaauaagugacuuaucaccaucauaucacauggugcucucuuggccccauuucaaccaucuuaugaguaacaauaaaacuuuacauaauaauuaauaacaauauauuguauucuugaaaaaugccaauaaaguagauuugaaguguucucaucacaaaaaugacaacuaugugugguaaugcauaugcuaauuaauuugaugcagccauuccaugacauauauauauuucaaaacaucauguuuacauaauaaauauauacaauuuuugucaauuaaaaaagaaaaaagaaaaaagaaaacacgugcacacacauaaacaaauuuacaaaggccaucuugaggcaggguauguugaagagaggauauacaaaaucuaugaguuugucacacuaacaaaauaaguauauacuuggauuuacaugcuucucaguuuuaaccuauuuaaagcaucuggaaagccaagugaucuuuaucaguguuaaaaagcccacuaguaguuuaucuuaguugccacacaauuauguauuuuuuaauuaauucacuuuuugaaccuaguuuuggaaaauuguaauuggauuaauauauaguguuuacuauacgucagacacugugaugaccacuuaauucuaacaaaaccaaguagaaaguccuacugcuuuccucauauuaugaauuauaguuuaguaaugcuaaauaacuugcccaaacuaaacuaaaccccuauuacauggcaaaaucaaaauugcaaccuugucccuugacccuaaagccuauccucuggccugaugcuuuuugacauaagaucaaauagggaaugagaaagaugaaaugauguaaugcucuagagguuguagcuacauauauauaaaauauuuuaaaaauuacuuguaugccggccgggcacgguggcuuacgccuauaaccccagcacuuuggaucuggugggcggaucaagaggccaggauaucgagaccauccuggcuaacacggugaaaccccguaucuacuaaaaauacaaaaaauuagcugggcuugguggugggcgccuguagucccagcuacucaggaggcugaggcaggagaauggcgugaacccgggaggcggagcuugcagugagcggagaucgcgccacugcacuccagcuugggcgacagagcaagacuccaucucaaaaaaaaaaaaaaaaaaaaaaaguaacuuguaugcuuuugaacccuuugaugguaagauauaaaugaagcaucuuacccuguguucagaguauucagaauugcaaaacacagaauauuauuugaaaauguuacuguggacaaaaaaugaccaagauagaagccaagaauaagagaagggaugcugaugggaugaaaaaagaaaaaagaaagaagaacaacaaaaccacaaauacuaccagauaaaaacacauaauauuuaaucucauuuauguaacuuuuuguguagguguguucaagagagaauaaauauaaaaaugcaugcauagaugacucuuacuaaaguguuaaagaaauauaagaacaaagccaaaaguacaaaaaagaaaaaugaaaaauaaaucacuugaugucaucaccugacauuaaagaugaaauauaaacauagguauaagcaaagguugagauuuuagugaccucuagauaucaugaaguuucuaauuuuuuaaaauuuuuucuaauuuuuccagagaaaucucuguuaaaaaucagaaucaucuccuaaaaccccagcucuauccgaacaccucuuucuaccccaaacacacucauaaacacgcacucauaagcaaucacauggcacagaauugcuccuacuaaaccgaacauuaguaucaguccuuuagcuacauugaggaacuugaacaugaaauuuauuuuuaacauacuguaaagagauugucauuuuuaugaacuaccgggcaguuuugccagauuuuaaaccuguaagugauucaguggcuuacaugguauauucuuuaugaagacaaaaggaaacacauuucucucaguuccaggaauaauugugucucuaagcacuuuaauauacacuggaaaucauguaacugucugaacucuaucuuggcugccagaaagagugaugucaaaccauaauccuaguuuuauauuuuucuuaucuuauggacuucuuuacuccaauuuuuuucccuuauuguuaguuguuuuaacauacgaacauuuuguaagaccuuuuaaauauuucagcaucaauguagguuauauguacguacccacaaauaacaauaauggccugggaacaagaagcggacauaccaacacuaacuguggggcacacagaagaaaauaggccuuagcaacacagacuaagggugacugcuuagucugugucgcuaagaggaauuuuaaaucaauauuacaacuuauauucauuguauauuugcauauaaacaaccuacauauguauauguuuucauuauagaaacaaagccauuuuuauuauuuuaaauuaucaaaauagaaaaucccuaccaguaccaauauguguguaugccugaacuggaggaaaccuaauuaacuauuauacaaugggaaaagccaggcagccagcauccuuuaaggaguucucccuacggcaucccgauaaggucuggauuugccacaugcccuaaugcauuccaauaaacagcuuuaugauguaauaaguagcuauuuguuugcuuuugcacugaauccagucucuuaaaaaaaagacaggagaaauauuuaguccuauuuucuucaacuaucauuuuuucuuucagaaguuuauuugauagucaguaugauaauagaaacuuaaaagguugauuauguucucauucaagcaaaacgacuacuaguuaaucaccuaccuaugaagcuucuuggcaccaaauuuaccaguuuuguacaaaacacugcaggaucaucaacaaccacuuaugacugacaaacauauacaaugaauuuaucauuuaaaaaauagucuuacccaauuuuccaaaagguuucuuauuauauuacagccuuuuggcaaaauaaggcauguuguuucacacuuaauaaaacaaauacuauaccugucuugaaagaaaauugcaggaaaaaauuuagagcacugagaaagauucagucaaagaauagaaaaucaaccuaguauuucaagagagugaaacuacuucucacuuuaacaagacugcuauucacacaauacagggaaaacauaaaaauuaagcauagaaaacauaauuauuagagggaauucaggaaacaaauuuuggaagcccaauggaaaagguaucuuuaaaccuucacaagaauauguuagaaauauuagaaacacaaauuuuuacucugauacaacauaucaauguaugguuagcagccccaugcaaacuuauauaaaaggauagagucucauuuucaauguaugcaauaaaaaguauauaggugaggaagcccaggaaacucagaguuauuagcaagccaauucucuuuggacagauggagcaccugaggcaguuagacuccauuucuccugcaagauaguggccaucuaagggcagugauggauacacagaggcaggagaccaccuguccaucaccaacagcaucaugaaugccccaggaagugcauaugaguucugaagucuuggaccccaagcaccagaaacccagcugacacuugugugaauagaaaugcucuauuuggauuuggcucaaguccaugguuuaauaauaauuuugauugcacauuauuauuuuggaacuuuuuuauauuucuaucaauccaacugcugcaucaucucaacaguaucuuacuggaaacaaugauaauuucaagcuguugaugccuguaucucugucucuaauguaaaaggcauuaaaugaagaacaauuuaacaucauuuaaggauaucccaauaaaauauaauuugaaaagacagcaaaucuauauuuaaaaauuuauuggcagaaacacaaaucuuaaaaauaaauuuuaggaaauauugauguguggggauaauuuaucaggguuagaugucucuauuucuaagucauuuagguuuaauuauuagggagagcaagguagagaaagggagaauaguggccccuaauuuaugccuucauccuuucaacuguuuacucaaaacgcauuaugagcuuuuaugcuaauaauauugacagacugguaucaauggaacuuguguaauggagaaaucccaucuagguauugccuccagaauuggcaauacaguaucagaacaauuaucaagugaauauagugaacaugcucucuuuaucaagugaauuuagccuuuccuaguuaaacaauaaaauauuaacauagccauuuggcuaaaaugcugaugucacauguuuauagauuaggaaaauauuuuaaaaugucauuugaagcaagaugaaaagaagcaacuguccuuucauuaaguuaaacucuucuaauacucccuaaauucaguauaauuuuucugaauuucuccuugucauagaaaauucuccgaagacauagucucuucucucaguggcuguagcacuacuagaguuaugauaauaauaacagaguguuuguuugaaacugauuuuugaggguuugucugacugugccucaggauagcacuguggaaacucuuuccucugcaacuuucuaccugccuaaagugaggcucccaguucuucuacuaucacuguugccuuggauaaacaaguaauucagguaaggccugauacuuccuucuucccaccuuucuaauccagacuuucucucauaaauaguaaaaacuaaaugacagaaaaacaauuuuuccaacauucuucauaagccuuuacaacuccauaaugauauuuuuucccaauaggguaaucaacuuaaucaauuacuugguggcuaagcuacaguaucugcuuaccuuucuuuucauuuuuuucucacuuaaguuauaagaaauagaaggagaacaauuuuuacugaguuaucuacuaugauugaaggauaacgcuggguaucauauauauuuuuucuuaccuugauuucacaauaauacuaucauuuuucucaccuuaagaauaaaaacacuucagcuagaaugaagucaaaacacugauuguauaauauuauucuaauuuuucuauauagauauuaguccccuaauuauuaauuucagaagaaugcugaacuucauucaaaagaauauaauuuggaaaauaauuuuuucagaaggcaaagaauaguccuguggaaggggcuuaucuaaugaugauauauauauaauucugguuggauuaagauaaauuccacaacuaaugugggaacauacacacacacacacacacacacacacccccacacacacacacauacacaaaagcuuuuccccauugaggggcucacaauugaaguuuccggaggugauggucuuugagaugguucuuaagugauacaguguguuuugguaagacaauauuaguguuuguuggugagugaggcuuggggaaguuauggcaaggaagcucccaggagaaguuaauggcaaagcacaaagaggugaggaagggugauaugaacccuggaaggaguaugcaguucuuaaaacuagaaugcagauucaguccauaaauagaagaugaauuuguaaauaaguacuaagcuuggacaugggacaaauaaaauugauaauacugggagccaaucauugguauagauuuuauuggcuuaaucuaaauuuucugguuaauccaucuuccuaauaggcuacaauugguucauuuauuauugucaggucaacguucuagucaucuucauuuacaaauaaugacuucagagaacaacuagcucagucuauuuuuauaaucuauauaagcuuucuguuuauauaauaauccuauuauguuugauuuuuacaucagucacaacuuacugaaauaguuuacauaaaaucaauggcauauucuauaugcagaaaaaguuuuuuucugacauguauuguuauuugaaaauuugauacauguaggcauaaauuauaauuucacuccaaauaaacuacacagcuuauugauacuuacagcguauuaaaaucuuaacacaaaauaauuuaaguagacuaaaaaucacuuucccaggauuuugaaagaugucuuuguagaucaaauucagagugcaggauuuuauuuucaagcaacauaaauuguaugauuacaaauuaugcaaucuuaccccuauagcaguauaaauaauuauacuauuaccaucaauucuugacuuuuguaucacuccaaaugcuuauuuaaaaagacagaauuuuaauucauauuuuagcauuugaaauauuaugauauugcuaauuuuaaacaaguuuuuaaagacuucauuugcuuuuagacaaauugagaguuuauacuuacuuucccuuucuuacauaaaauauucuauaaaaauaguacacauagaaaaaaguguauaaucaucuauguuuuaaacaucacuggaauuucacagugucagcuauuuaguauuguuucuaacaugucaaauaggacaggcaaauuaucuuaagacaugggauuuaaacaaguacuucuugauauuucuuauuuuuuaaugcacauguuuuauuuuuuuccuuuuucaugauaaagguuuauauagaaaagauucacuauuuuucuuacacagaaauauaaaauaacaagaaguaccuauacauaguuugcaaaagcagaaguaucagggcauauaggguuucucaaacuugaauucuaauguucuaugaaaaaguuggucuuuaaaggaacuuaagugcacagacucaugcagugaugugaaaaauacuauucaggucaucaugaauuuacuugagaaauauuuuuuauuacaaaaugcucucuggaaaacuagguauuaccuauuggauauaaaauaacauagguugcuuuuaauuauaacacuuugccugugauugcugguauaguauaugaagucagaugagauauugagagaccaaaagcuuccuuugguuuaaaaaaauuaaaaaauuccaacaucacugauguaucaguuuuuccaguucugcaauuagcauuuauucacuuacucaccuacccacucacucauucacucauucauccaauauuuauugaguaucuauauggcccagauguuguagauauaaugacugauuuauuuugaaggaaccaagucucgcugaaaagcuaaauauguaccgaaauauaauaaaauauguucuuuauuauucuaacuguauuguuauccauauauuucauacaaauuaauuauauuuuuccucuauauaauguauacauucugucaccauauaauuauauauuuaaaauuugguauaauucugcaaacaaaauaauguacauuuauagacuccaagauuucaugcuaucuucaaacaagguggaguggggaaauugaagauauaauccuucuguuguagucacauaauugaaaaaugugcuuuuauuuauuaauuuauuauauauuuuaauuauuauuuuuaacuucuauuuuaaguucagggguacaugugcagguuuguuacauagguaaauguguaucauaggggguuguuguacagcuaugucaucaccgagguauuaagccuaguacccauugguuguuuuuccugauccuuucccuccucccauccugcacccuccaaugugugccccaauguguguugauccccucuauguguccaugugaugacaggcuuuagugguuggaucuagcucuucuaauauuuucaauuuauauuuaaagaaaugggaaguaaaaagagcaaaaaauguuguuauguuuucauuuccacccuuagaugcaaaagaaucaagcuaucauuauauagguauauuagggcuguaaauugaagauuuaaacauuaauaaaaggagacaagaagcugccaguaaaaagauaagaaaaaguagaaaaucugucaucuuguaaggaaaagaaaaucaaacuagaugugaaaaaaugauuguuaguuuaaaaguaaugaacagugaaaccuaacuauaaaaucuuuaacacuuggaacuacauaguguaaccauuaauauacuucuaugacacacaauauuauagagauugagcuagguccuccaguguaaacuacuacccgcagauaaguuuuggaauguuaaugaauucucuaaggccacuggaauguauuuguuuucugaaagaguagugaaguucaguggucacuaaacucccuguucaguuuuccaaauaaccugaaagugcucgcuuagccaccuauggggauuuacauauuuugaaaaaguaggcaauaaaucaggaaagucagaaguaguauauaaguucuucucauugcaccaguguaccauccuagagccccgacuacucagggucagugugccaauuuccugggacaauaaggauuaacugcaccuacacauucuccaagcugauaguucuuaaaauuuauaaaaauuuggcauuuuuuaaauacacauuccuaggcuucauucucagauauuuuguuaucuuuucuggguuguguauucaggaauuuguaauuuuuaugaaauucuaaggugauucugauauguuaggcauugguaacucauuuugagcagagacggaaagaauuugggagcuagaauuauauauaaauccauauuuguuuccagaaagaaaacaaguuucauuuguauuuuuuaaaagcaacuuugaucaaaauugacaucaguggcuguggauauugggucauauaugauuacauuaauaaaaugaaacaguacauaacauuuaagauagcauccuuucccuucucauauacugugaacacaaauuucaaaaaugcuuugcgaaauuagguagggcaagugguuguggauggaccuaagagguugcccaagauuguuaacugcuuuggguaugauaugguuuggauguuuauuccuuccaaaucucaugcugaacugugauucccaauguuggagauggggccuggugggagcuguuuaggucauaagugcagauccuuccugaauggcuuggugcccuccuugcaguaugagugaguucuuccucugaguucaugugagagcuggaugauuaaaagaguguggcaccuccacucucaacucuugcuuccccucuuguuugugacaugccuguucacgcuuugccuucugccaauaugguaaacuuccugagccccucaccaaaagcaggugaggggccuguacaaccuggagaaccaugagccaauuaaaacucuuuucuuuauaaauuaccuagccucagguuuuccuuuauaaauaacacaagaacagauuaacacaggguaguacuaugauuugaauguguccccaaaagcucauguguuggaauauuaauccccaaugcaacaauauugagaggugggauguucaagagguaauuaguucaugaagacucugcuaucauugauuaaugccauuaucacaaauguuagucuguuaucuggagaguaguuuccugauaaaaggaugaguuugacccuuaucucauccccuuuuuguacggucuucugcucuuauguuuucuuccauaagaugaugcagcaagaagaaccucaccagaugcagacuccuugaucuugaacuucccagucucuagaacuacaauaaauaaaguuauguauuuuauaaacuacuccaucucugguauucugucauagcagcccaaaauggacuaaggcagguacuuuuaauuguuuuuacuaccugagauaagacuuacacaaaaguuaacauuuugcugccaagauuuuuuaaagcaaagagauccuuaaaggaaaugaacaugaauuuucucccuuauagauugguuuaaacuuuguggccuacucuauacaguagaaucaauuuccagagcucauauuaaagaauaaugugacguucaaaaaaguaaaaggaaagaaauaaauacaacucauuuuucuucuguuuucuccacuaaugagcaauagaaugaaaauacaagaauauauuuuguucuauuauucaacuuuaacuguauacauaaacuucaaauguuaugguaagacuagugaauaaaaggggcuaguuugguuugcuugcuuuuuagcauuaaucuuuuauagaauagacuguuaauuuucuagaggguuguaacuugcuguuauuucguaauauuacaaagauaaucauaaaucuuaucuauaggaaaaagauuuacaugauuccuagcuuucucuauauauggucaaaguuuugagaauguagaaugaggaauuuuaagcaagaaggaacuucuuauauuacauauuuaggucacucagagcagagaaaauacucagccaacuauacagcuuuggaacuauucaaaggcaagaugaagaccuaaauuucccaaacuuccaauucucuaagauugcuucacuauauuaugugaauugcacuggcaaaguuuagagacuuagguuacuuagguucaagaccuaguuuuuccauucauuuuguagccuuguuucugcuaaagaauacaaguuaaacucuccaaugccucaacaugucgcuuaaagucgacauuuuaaaauggcccaucauuccugcaaugacuguucucucccuguuuuuucucugacuuucacucuugcugcccucuucagauacacccauacugccauccuugucuucguuacucaaggacacuuuucuuaggccaccgcagaaccuuagcauuugcuguuuccuauaccugucaaguauuuuccucugaucacuguaauuuauuucccucacuuccuuccaauuuuucccaaauaccuguauauuuucucugaggccuucucuaguuauacugugacucuccacuccccucgugcccccaugccccucauuuauuauuauuccucuucucugcuuuauuuuucuuuaaagcacuuaucaaaauaguauaauguaucauauauguguguauauauuuauauuuaguuuguguaugugcauauguguaaauuuuauuugucugucugccuucaccugaauguaaaccacauccccaggguagggauuuuuguuuauuuuuguguauucuguacauucuguguucugugccuagaacagaguuuuggauguaguaggagucaaauauuuguugacuacugaauacaguacuuuauuauccucagaccaauaaaccacaauaaagagaaaccaguuuaaauugcaauauuauuauauuugaauaauuacucauaucuuugaaaauuagauuuucuucaagauucuuaagagaucacuaaaagugguugacuguuacauaaucuguuucccauaaucaggauuaaccagauaacaaaaauccuccucccucauuuaagccauaaaauagaaaucaccuacccaauaagugggauguaaaccacauacucaagagaauacagaauaauaaaccaagauuuaugaaaaccaaagaguacagaaaauaaaaaagagauaaaggcauuauauccuggggaaauuuauuuaauauuaaauucaccauuuaucuuucuuagaaaacauuuuccaaagcuuaagaucauguuuauagccuaucaguuucauaauucaacagaagccuauaaggcagaaaguaacauagaaaguacuucucauguauuuguauauaauuguuuaugccuguacaauaauaaugcauuaaacuagaaauaaaauguguugcauggcuaaguagugguaacuauuaaacguguugaccagugcaauggcaggaagaaaggccauugaggacucccuaaagagggcccaguuuaugauauaaugcuccaaaucuuccaaaaucuaaauuuccauauuguuuuguuuguucucuaucucucaaccuugcaaucaauaggucacaaaauccuaucacagauaccaaacuucuccuggcuuccauagucuuaaaccuagcacucaccauuuuuugcuuguacuucugcaacaacuucauagcucccugccaaacauuagugcuucucuaagcgauccaucacauugcugccauauacaucuugcuuuacacucacaaaaaccugucacaugggguaaaauccaaacuccgcaguuucgcauacaaugcccuucaaaauggaaacuaauuuuuccagucauguauacuaugcuugcuuuacucauacuaagauccugauagaaaguaucacagagcccuaaauuuaaugugacucuguuuucuaacuguauuuguccaaugagauauauucagaauuaaccugccauucuuaacccauaauaacucuguucauucugaagauauauaaaaaaaguaaaggucuucaugaaguucaaaggucuuuaaacggagcaaaaucauuuuuauaucuuaggagucgaaauaucuaaaauucaagcaaacauauaaauguagggguaguuucucgacucauaauagauuauguauuaccugaguucuuccaauuuauagaauuauauuaaaauuacuucuagaucucaguauguuccaaaauaaugcugaaaaaaaaccugucaauaucauggcugaguaucccucaaauugcuuaggaugaccuacuuuuuguuuugauggauaagcuucuuucaaaccuaaagaguaacagaaauguuuacgagaauaaaaccaaagacauuaacauauugaugucagauauauugccauuuuauguucuaguacaguauuuuguguacucguagugugccuaagugaaguaauauacaacugaauaauuuagauauguaauuuuaaaguaaaaauuuuauuaauuauauauauaguauuggaacuuguaaacaaacucaagaugccauauacuuaaacauuuauuggaauuauuaaaauauuugggacauuuuguuauuuauguaacuaaagugcaguacuuuaaaaggguaaucaaauauaauuaauuuauaaaugcaguuuuuauacuugaagguguuuaauuguuuaaaugauaccaauauuauucaaagacuuaaaagcgguuguuaaaacaaugaguggauagggagagggaggagaggagaggagagagggagagagagacugagacuaaagguuuauaacguuagagguuuaauaagggagcagauauuuugauuugcaauuuuaauauauuauacauuaauuuuuaaaggcaaagaaacuccuacacaguuuuuuucuguucacaaaaaccaccuuugaagacaucagaaagucauuaugaaauaaucuuuaacuucuuuaugcaaaguuguucuuccuaugaucuuauaauaagaguuuuccuauaucuguaaagcucuuuuuucuuccaguuaaaauucuguuuucuucaguggacuaugagcugcuuaaaaucuuuuuuguguauucauuauauacucaaauaagguuuaauugaaugaauugcauccuucauccugaaacuauuuuguggauaaugggaugcuuuguucuguccauacacucuugcuucucauccugugucaccauuucuuccucaugcccauucggcauuagccuucccuagcacuaagagccauuccuccaccccguguugcaccauaaccauuucuuccucugagaccuacucucacaguuuuaacgacuaucucucaaacccauaccacuacuucagucuuugccuucaagcgccagucucacauuucugauuaccuaccagacauuucuauugaggugucuugucucaccgaauaacauguuuuuuuuuuuuaaagucaaaauuauuucuucaaagccaaauuauccugugguuuucucaguuuuuaacaugagcaauacuauccuuccaguaaccuacuauggaaacuugaaaucauuaucgauguuucccuguucccauccauugccucccauucuggcauguaaaauuugguaggaccauauacugcccaugucugugucuaauccagucaaauuuaucugcucauuuucuucagaugcaaucacauuuucaccuccauacccuuguucauaccucaaaucccuugucuuuucuucucuaauuauggaaauccuauaaaucuuuuugugucuuauagugucuuuagaaacuucucucaauacucaguuucauagugauuuauacuuccuugaaaauucaauacguguucccucuguucauucauucauuccuuccuuugaaaacacuauaaauacuuacuauuccagacacuaugacagugacuaacagaugcaaagaggggcagauacuuuaggaaugacaaaugugugaaaggggugaaguggggauaggaguggugguuuuaaauaagaguugcuuuacuuaaauacaugcaaugaaaauaugcauaucauauuuacacuuagcuaauauguucaauguguaauuaaauuuagaaagcaauaguaaauaauuacauaauaggugcauuuuaaaauaaucacuguauauuaaaauuaacuauaguuauuuuaaaguuuucauagcaaauagccaaaaaguacuuaaaauauuaacugaccacagagauauuauuaaagacaauaagacgauggaaagucuuaaagcccaaaugucuugugauuuuugauauaaaauuaaauugaaauaucuuuaauaaguuagaaaggugcuuaaaacauuuauaguggaaagauaaaguaugcgaacuguuaaaccuuuauuuacaaauaugcuaacuuugccagugucaggucccugcuuauguuucauuguguuacaauuaucaguauuuuguaagcaaaauaauggacauguuauucuauuuucaaagauuacuuacuuaauuaaaauucugaguuaagcaaaacaaaauacaauaaguuucuuucuaagcauaaaaggacagguaaaucuacuuucaaacaagguagauaacuuacuaguuuguauuaugcaucaacuaugggaccuguaacacuacauguaaacauuuaugcaucuguauccccuuuuccacuagauaauaagcuuauagagacuagggagcauaucaaauaucuucuuaaauccauuuugcuuuguacaguaccuuauuaaaauauuuauugauggcuauggaagcagaagguauuagguaaauacuuccucugcuuaaagaaauuauuauaagcuuuaauaaagaaauaaagcuuaggaguaaaaguuuuacuagccacuccauauuugauuuaaaaguggcaauacaguacauauaaaaaaagguaucugcuucacacagguuuuaggacacaaguucaauguacaaaaaucaguuauauuucuacauacuggcaaugaacaaucaaaaauaaauuuaauaaaacaaugucacucacaauaguaucaaaaagaacaaaauagaaauauauuuaacaagaguaagacuuguacacuggaaacuacaaaauauuuuugaaagaaauuaaagaucuaaguaaguggaaagacaugcucauguauuggaagauaauacuguuuaaaugacagugcuucccaaauugaucuacagauucaacacaauccccaucaaaauccuacugcuuaucguacagacgaucauaaaguucacauggaaaugcaagagacucagaagagucaacaugauccugaaaaagagcaaaacuggaggacucacacauuaugauuucaaaauugccacaaguugcagguaucaagauaguggggacugguauuaggacagagauauguacugaugaaauugaauuaagaguucagaaauaagaacucauauuuauagucaauuguauuucaacaaagggccaagaccauuccauagggaaagaauagauguuucaacaaauggaacuggaauaaacuggaugucucaugcaaaagaaaaaacuugggccacuauaucauaucacauacaaaaauuaacucaaaauauaucauagaccuaaauguaagagcuaaaacucuaaaaaucuuagaugaaaauguaagagaaaaguuuugggaccuuggguuaaguaaugguuucuuagauacaauaaaaguucuaagcacagaaaaaguauagauucaaaaaauauaaaacucuuauucuagaaaugauaacaucaaggaagugaaaauaaaacccagaggggggcagaaaauauuugcaaaucauagaucugauaaaggauuuauauccaauuuauauaaagaagauuuacaaccuaaaaauauagaaaaauaacccgauuuaaaaugaucgaaaaauuugaaaggacauuucuccaaagaagaucuauaaauggccaacgagcacaggaaaagaugcuuguuauuaguuauuauaacuaugcaaaucaaaaacauaaugagauaucaccucacauccacuaggauugcaauaauaacaacagcagcagcagcaauaauaauaagaaugauaacaaauaacaugaaauaagugguggugaagauguggagaaauugaacccucguauauugccaauggagacacuaaacaguauggucacuuuggaaacuaacuugguaguuccugaaagugguaaacauagaguuaccaaaggaaggaucauuucuauuccuagguauauauauauauauauauguauauauccaacagaaaugaaaaaaauuauguccucauaaaaucuugcucacaaaguucauaacagcauuauucauaauggaggaaaagcggaaacaacugaaauguuuauuaauuaaucaauggauaaauaaaauaugguacaccuagacaauggaauauuauuuaucaaugcaaaggaauagaaguaucaguucaagcuacaacagugguaaaucuuaaaaauauaauaguaagugaaugaagccaguuacaaagaucacauaucauauguuucccuuuaugugaaaugucuagaauaggcaaauucauagaaagauaaaguagauuaaugguugucagaggcugagaaaagggggaagucgggggugacuacuauuggauguacaguuucuucuuagagugaugaaaauauccuuaaaauagauagcccugaggguugaauaacuuuguggauauauuuaaagcacugaauuuuacauguuaaaagcauaaacuuuaugguauuugauuuauaacucaauaaagcuguuauauuuuuaaauauaugaacuugcuucaggaaguagaauagguauuuuucagcaaauaagaaacaaaaaaaauucagagacuagacuuugugacacguacaugaugucuuuuucugaaaagcuaaauuauaucucaagauucuaaccaugcagcaggagccagccuuuaugcacagccagccuuccuaccaaagaaacagaauucuuugaauaugcuucaaaguuucuuaguuccuacugguacauggaagaaagaaacaagaagauauagucucugucacucgggcaaauguuaagugucuaugagcauuuuucauauuguaccuaaaaccuuguagaaaugagaagugauaugaaaugaaauucaugaauuacccacaugcaguaugagaccauuaccuaauuuugguagugauuauuuacuucuuuuuucuuaaaucugcuaguaauucuucugagaaguuacaguaaaauugcuuuucaacuuuucucauuuccugaaauccagucucguagcuuucaguuauaauuguaggacagaaaguguaaaguaauaacaauaauacaacaauaaaaccccgaagugccuuugguguaaccgaagguguuacaaagugccuuguuaagcaaauggcauaauuaagauuuaacugugucuagaacauuuuuaaaauuuaaaucuugauuuuauuggcuacuaucaaugccacugcaggauuuuaagaauauuaauauuaugauaaaaauaugaggaaacaguuuucaggugcaaauauauuccgauaacaucagcuauuauguuucaaaauaguuacaaaaauauaugaaguuuaaaaacaaaaaaagaaaaaguauuuuuucaaagaugcuaaucauaaagaucuuaauuugcauuauaauaucggcagauucugcauuauaaaaagugaaauagcuaaaugaauacuaagugagucccaaaugugucucaccaggcuaaaaucaaggugucugcacagcuacauucuuugggaaugaaaaggaaaauuuaucuuuugauaauugcaauuguugguagaauucaguuccuugcaguucucugagguuuuuguuaucuugcuagcuuuaaacugagagguauugccaccuuguaaaggcauccacauuucuucacucauggcccaaucccuccaucuucaaauucagcaauggcagggccugucuuucuuagggcacaucccucugaucucccuucugucuccccuuuuucccuuuuaggucccauguuaucacucuggccuuacccagauaauccucaaucccucauuuuaaagccagauaauuauagccuuuaauuccucuuucccauauaauuccucuuuccccauuacauuccucaggaauguaacauaugcauagguuuggaggauuggggcauggauauuuuuuggggggggggauauuauucugacuaccacaaaaauauaaucaauguaguugaaaaaugaggggaggguauucucuuucuuccucaauuaaauaauuuuucuuuuuaaaaaugaaaucauucagauauuuuccuuagcuuuuucauuuagauagagauaagagaaagagaucugggauaccuuagaaguaaaguaaaagucaaacuauuucuauucauucauauguaauuuuuauuaacuacuuugugucaaauuguagacuaggcauuccauaaauagaaauaaaauagagaaagauccugccuucugcaggcauagagucuagugagaaaaaugaacaauaacugcauaaauacauauauaaauguacaauuacaauuuauaaugagugcuauaaagaaaauaaauagcauucagugauagagaaaucugcugacaggaugauggugcaaaggcagagugaacuacaaaggauggucaaggguuaucuuaacugguaaugaccugcaagauuucauuuccagacaugggagugaggaaucccuccauguagcaaacaauuuugucauugaggcaucuuuuauuacagauugcaccaaugugaccuaaggaaaugcaguaugagaccagcgaaggaccaccugcagaauaaaaaguuaaaaaaguagaaaacaugccuuugcaugucgacugccacccuagcucuugcuggaccauuauuacaguagucuccacaccagucuucucacuccugccauggcuugcuggcaucuauucuuacauaucagcuagaauuaucuuaaaaaacagaaucaaaaccagccaggcaaaaccaccccucuggugaaagcacgugaauggcuucacauagcauucacggugaauaguucauaguugcaagucuuuggaagaucuuagaaggcccuauaugaccuccuucucagaccaugcacucccuugcgcuagagcaucaucuccuaccuagcacauuucuuugcucacugcuccagcugcaauagccucuuugcuuuuugaaagugcacccaccucuggcccuucugcucagcccagcucuaguauggccuacauaacauacagcagcucugguuccuaauagucucugucuuguugucugucuuaacaugccauauuuauauuuucacaaaguuugccaccugacauauccuuuuauuuguucuguuuguuuauugccugccuuucuguauuagaaugaaaguucgaugcaagaagugggauucucugauuucuucccuaaugaauuccuaucaaugccugaggcaugguagaaggucaauaauuuuuacugaaugaauuaaugaaaacagcuuucaggaaaauugcaaaggcuacuucuuaccuaaggagcugugcccuuggguaagauuuauagauagucaucuggauucugguccuaacuuaaaaccuacuucaacacauauaauaggucacucauuacccuuaaucuucagguuauucuucuauaaaaugaagaaaauuauuucuauuuuaucuucagaauauuuaggaucaaauaagagaauacauguaaaauuauaaaaugcuacaaagacauaaaauguaauuauucaucuguguauuucuuaguaguuuauaauucuugacuuuuagcuuuguuaauguuagauugcauaagcaacauucauaaaguacaauaaaaauaaucauauuuuuugcaucucagaguacuuucaaauuuuuucugcuggguuaauuuuuccuuacuuuucaaaaaauuuagacagguccuaugaccuuucuguguauuuuuaagcaauagagugacuuaugaucacauucuuaaaauucaacaauuuuaaaaaccucuaaccuuagugaaaauucaaacucuggcccugguuagauauugaggcuucuacccuccucuaaucugggccuuuugcaggugggaaaucuacagcugggaaaauauaguugacuuuuucucucauuaucaggccaugacuaugauuucugcucccucagcuuccuaaccgggauugcuggcucccucagguuuggagcacagaaaggcagaagaggaaaaccccuucauuguuccugguccuagauuuacaacuuucaugcguucucuggagaccaugacauucccccaccucccagcauugcacacauuuuuauggauguucucauuacacagaguucauauuuauucuaccaguuugcuagcuucuuccugaaccccuggcauucuaucaggaccuucagauucucucuacugagauaugucuacgugcuucagaaugggaccagguugacccagacaagagauauucugucuucuaaauggcuuauaucugguccaugggacacauauauaauuuccacauaaacacugcgaguucaaaucauauaauguagccucaaucuuuccuuuaauuagcuauaaaagcacuuagucaaucaugcauaaauuuuccagguaugaaaaaaucagucacuacacuucugaguccuccaaccuauagaaaauacauauuaugggccgggcacgguggcucacgccuguaaucccagcacuuugagaggcugaaguggguggaucaccugaggucaggaguuugagaccagccuggccaacaugguaaaacccugucucuacuaaacauacaaaaauuagcugggcauggugaugggcaucuguaauuccagcuacucaggaggcugaggcaggagaaucacuugaaucugggagacagagguugcagugagccgaaauugugccacugcacuccagccugggcaguagaaugagacuccaccucaaaaaaaaacaaaacaaaacaaaaacaaaaacaagaagaagaaaauacauauuauguuauccucucucggucgaggugaggcugaauucuucuccagcucuccuugguaggauaggaugaugugcuguaacaguaagacucguaacacauuaagagcuuuuacagagaagucuucuccaaaaugucucuaaccuuuggcagacuuauguucuugauguaaggacauuugagaauaguauaagcaguuacuauauccuccuuugaugauuuuucauuuuagaauuuuaucuauuuuagaguguaaucggcauugcaucuuauugcuacaacuuaaacuuuuucauuugccacccuuuuacauuuguauuuaaaaaauccugcaaccucguguguguguguguguguguguguguguguguguguguguguguaugugugugugagagagagagauuauauugaaguccuaucugcuuugguauaguuacuaugaugauuuuauagcugaucucuuugccuauuuuuucuccuucuucaacuauaucuuucuaaagucaacuuccuuaacuucucuaugcauguaaguuacuugcucagaaaauuuuaaugguucccuuuacuuacuggaaaaaacugaacacuucagcaucccuaugucuuugccuuauuguaaguauuuaacaggagaugauuauggcaaaguuauuccuaaaggauuauagaaaucauaugcaaauagguaaagaaaguauuucaaauggucaccacaaauuuuacuccuuauuugguagugcaccaaaaggcauccuaggaugugaugcucuuuuccauugccuaguguccaggaaaaaacaggauauucuuuuauaaagacucaagucccugaagggauauuugauuaaaguucagguucuaaguugcagugaauuuccuguguuugcugcuuaugacuaaaucucccaauuacuuuuccaaagggagcuaauuaguaagaauuauccccucaauggauuuuacaaacagaaagccacacugaaugucuccaaucuccauuuaguuccaggaaauaacacuucucuaggaccauuccaaauguggguugagauuuucaguugccacucaguaauguuugauuccuuuugacuacugauuugucuugacacuucagugagcuuugcaccucauaugaaguuggcugacaagaauauguuggucuacacaggcuggaccuucuaauuuuagaccaaggaauuaaacuauuugcugccuuagacaaugacuuaauugcuucuccacauuaggacagugauuuucuguaaaauaaaauuaaccaaaaacuuuuuuuaaaaaugccugauccuauuucuagacucugauuuuauuaauuuggggugggaaacagacauuggcauuuuuuaacagcuucccaggugauuuuaaugugcaaaaagauuaagaaucacugcauuaaacugacuauaauuuuauuccagacauggauauucuagucuuccuagcauuuaauaaaauucuccugaaauaugccuggaugugacccugaauuaaaagauacugacauguuaaaauuuuuuguauuucaaaauuacauaucuguaagacauaugguuucaggaaauagauucagucauuaucauaauuuuaugauguccagucauaaaacuuguauuucucuccaucauuuaaaaauaggcucaggaaagggagacucguucacucaguucuccaucaaucuaacauaauuggccgugggcuaccagaaucauacaacaagcauuuauuucuuccuauccuaauucagcucuccgagaagauagaugugcuuuagcucagugcuuuuauauuuuucgagacaagauaccugcuaucagucaguuuagauaugugguuauaauuuaauaaaucuuugacccacaguuauucuauauauucauuuauauaauuauaucuucugugaucccucuagccugaguuagguaaaauguaacauguaagagguggcagacauuaugaaaucuacauuuucuuuaaaucuguuuuuauuucaugaaaaucauugugggaggccccauuugaccuaaugauguaguccuauaaaggcuugaauuuauccuaacagaguccuuacccuauaguuuuuguuauggacugaauguuuguguccaccucaaaaauucauauguugaagcucuaaccccaaauauauuuggagauggggccuaugaggaggugauaaagguuaaaugaagucaugagguggguuuccgaucaacaggauuggugucccuauaagaugagaccaaaaagcucauucucucucucuccacaagugcacaaugaagacagagguauuucucuuucuugaguguuuuuccccagaugguggaauggaagcuuuguuagcaccccucacccaauuggaaacagcaaaauaguguguagagauugauacugugaacuuuuauccaagaaggaacacaggaguucaacauuaaagcaaaagaaaauuuuggauaacagaaaaaagaaaaugggcagaauccuuuguggugagauccagcagaaaauugugaguaaauuccuagugugugagagcaggugagugucucugcaauacacauucccaccagauagccaggcaauccaggccgcaggggagcguccugacccuaccacaccccagaucugacuuggggaguagcagagagacggagcaggaaugacacuaggaaggaucucacaccugggugccacaccaauccuagcucagagagggcuguaugggaaccuaagcagcuagcaggaaugacagucacugcuucagagugucuugggcuggguuuugugaucuugucuugaauuagggaggaacucccaaagccagaacugagaggugacugugggaugggcuccagcaugggcccucaaguugugugcuuccccuuugugggacuggacugagaggguuuuagccugagaggugugguuuugacccggguggcgaauguggaccuugggcaguuacguggucugaaggcaaauugugugugacucagcuaaguauucugacuuagcacuagcuuuggguggcgggagaaagcccugccagguuggcaguaugacagugcaucaggucccaauaucacuugcuaggcuguggaaaccaggcugcaccucuuucuccaugcugggucuuugacacagcagugguugcuccacccccugcuggggcauuucuccagaggcccgaggacuguccucugauccccauuguggccagcacuugugcccaucauuggacuugagugcaggcuuucccagcccagcccagcguagaguuagugggugcagcgcaccagcauggcacauguauacauauguaacuaaccugcacaaugugcacauguacccuaaaacuuaaaguauaauaauaaaaaaaauaauaaaauuaaaaaaaaaaaagaaauguguguacuauucaauggaacacuauccacccauaaaaagaauaaaaucaugauuguugcagcaacauggaugaaacuggaagccauuaucauaagugaaacagcucagaagcagaaugucagauaccacauguucucacaaguggacacuaaauaacauguauacauggaaauagaguguggaauaauagacacuggagaucagaagggugggagggugggagaggggugagaaaugagaaauuacgugaugaguacacgguccaagaauucgaacaguauuuguaaucuuucuaugccacucaccuucucauugacuuuauucuaccagucugguuaucuccaaaacccaacacuacacguacuucugggcuuucauucauaaagccuagacucaagaggaaagagauccccuuuuaacaaguuucccuuauaaaaacccuggaaaaggauuccaguugauaauacaccuguaaucccagcacuuugggaggcugagguggguggaucaccugaggucaggaguucgagaccagccuggucaauguggugaaaccccgucucuacuaaaaauacaagugacauguucauuacugggccaauugaugggguucgugugggaugccaugauuggcuggucuagcuugggucauacacucaaccuuuugggcuguguguguaugugugugugggaggggaguggugaacagguggauguguguguguguaaaaauaauaguaguuauguucugaauauauaaaacaacacagguggcuuauagaguaggucuagggauuauagugcuguuuuucucuccuuuagcaaacaguguuacagacuacauuuuaauuagccuucuaugaaauauaguuuaguauacaguagguccucgaauaaaauuguuuuguucaauguuguuuuauuauaauguugaugagaaaaaaaauaauuucuggccagagccacugucuguuuggaguguacauguacuucucucauggguuuucucugaauauucguuuccuuccacaucccaaagaugugcacauuacaugaauugacaugucugaaugauccccgucugagugaguguguaggagugugugugcccugugauggaauaguguccuauuagagucaguucccaccuugcucccugagcugcagggauaggcuccagccacccaaaacccugaacuagaauaagcugguuggaaaauaaaugaaugaauacaaaugauuguaaaauaaaaauucuuaaaggagauaauaauccuacaaaugcaacaagaaaugaugggguacuaaagcucuccucuagucugccauauuuuucauuguuugauuuugaacugcauggugggaaggggugcuccuuaagauuuucgcuuuguaaaccuuuauuccuucaguggacucaccaccacaaucacugucacucacuaauucaccaaaauugaguaaauaauuaccuuacuuguuuuuauuuaucuuucuuaaaaguaugcauaggucacauuuauuucaauguuucauguuagaauuguucugggucuuuauuuagaaguuugguaauguuucucugaccagaaauaugcccuaagaacuuagcucuuguuuauaucaauuagccuaugggaaaguugguuuuauuauauguaauuuccuuugaaguggcgguuuccaagaacccagcaaugaccuuaaguaaggauuuacuauaguuucuaaauuaaucauuuuccacucauuugauaagguggcucuucagaauguccacaacuugguuagauugaugagauuaggaaguaaagaauuaaauggagagaagcuuuccuaaaucuuguaaguaaaagacagcaccugccuccaauuguuauaaauauuuuaaaacauuuuuugguuuuaaaacagauuuuuuaugucucaacugcagguaaauguacaccuuaucuuuccaguuccugauuugacaaaugagcuuuaaauaguuucaugagggaaaaaaaccaaaauagaauccugaaaagacuaccaguuacguaugcaauuuuaauuuuauaaaaaaauuauaacauuaggccaggcgcgguggcucaugccuguaauccccgcacuuugggaggcugaggugggcagaucaugaggucaagagaucgagaccauccuggccaaaauggugaaaccccgucucuacuaaaaauacaaaaauuagccaggcaugguggcgggcaccuguagucccaguuacuugagaggcugaggcaagaguaucacuugaaucugggaggcagagguugcagugagcugagauugugccacugcacuccagccuggcaauagagcaggacuccaucucaaaaaauaaauauauauuauauauauuuauauauauauauauaucauucaaaugauauauauauauaauucaaaugauauauauauauauaucauucaaaacucaaacauaacuccuugugggggacucaggaccaauaaugagauuaaaccuaggcacugaaauuauguccucaggagaagagaaauuguaggaacacagaaaccaaaagucauccauggagcuuauuuuucccagguuucccaugucuucguguaagugcuuuggauuucacauacccaagagauuuucagucuaaaguuuaaaaaucuauccucaaauagcuuguuuugcuggaaagcuuacauugaaacaauaauuaagauuauuuugccauuguuuaaaacuucaaggggucuaauuauugucaccuugguaacuguaauuuugcugugaccuuaccuggaaaaacucauacuauaauuuaaguaaaauaaagaagucaucuuccuugaaaugacaaaaccauuccuuugcuuauaaauuaccuguuggauucuuagugcaaucauuaaugaagaauaauuagagaaacugcuuucaauauuguauguggucaaaguuauaaauaagccaaaaauaacauauucuuugcacgugucaaugaguacugcuagguuuuugaauuucuggacaaaaagucugcacuaaacuugaguucaacauagaagcccuacaauuagcugccugaauauaaccuguguguuaauagcauugcaaaagacaaguucagcaagaauggucaucagagaucagaugauaauuucaagcuaugcaaaaugcaacucuuuucugaacugcccuaaaacaaacaaauucauuucaaugacuugaaacugcuuucaguugacuucuaugcucccauuucauagcaauuaagauaagcauauuucucuauaaugauguagagucauugccacugaccaguaguagccugcuuucgaaggauaaaacuuuuggcuuuucacaaagguuucuaacuaaguaguuauuucugacaugucuuuucaaauuacccacucuaaccccuaaagaaugacaagaaaaugaaaaucugcaaauuaaaaauaagaccaucagucaccuagacucugucaagaugauccacuaauuauaagccaaaugaacuauauugugaaacaaagaugaaagcaagucaucuauuuaauucaaauauaauauacuaagauuuuaagcauacuuaaaauauaauacauaauuuaaggcaucauaaaucaaugagaaggauauauuuuuccauauauagaaaauuauucaauuauuuuggaaaaaauguccacuuaauucuuuauagaaugccauacaaaaaaaaaucucagauggauugaaaagauaauuguaaauauucaaaccacacaaugggggauggaggaagcagaugguaugagucugauaucuugcugaguaacggcuucauucuuuagaagucaguagaagaaaucauaaggaaagugauuugacuguauugaaauuacuacuuuuucuaagucaaaacaaaauaaaucuaaaaaguaaaucauccauuagauaaacaugauuaaaaaauaugacaaaagauuaaaauccuuggcauggaaagaucucgaaaaauugauuaaaaauacuaggcuuuuaaaauauaaaugagagaaaaauaugcauaauuagaaauaaaagagaaaaaugaauuauuugguacuaguaauaacagaaauggaaacuggcacuauuuuuuuccuauaguuaucaaaaguuuacagcaauguaacuccuuaguagugauaaguggaacaaggaguuacauuuuuguaaauaggcacuuucauaacuucuggugaaagaguaaaacggaaaaaaaaauuuaauaguaaacagaaauaacauuuaaauacuuuagaaugcuacagacuuuaguauagcgauuucauuuuuuuuagaaaucuauuuauugcauuuauuccaacacuuaaaagggcaaaaauggaaaaggccaaaaaaugaagaguuauuggaauauuugcguaaguuaaaugauaacauuaaaauacauuuauagaguuauaaaacguauguaaaauaagaggaaaucaucaaaauaucaacaggaauuuuauucaaaguaguaagauuacgaaugauuuuucuuuuucuuuuccaaguuuugcauaagaaguagguaaguuuauauaauuagacaaaaagaagcaauugauuuaaaauucccuguaaaucaaaguggaaaauauauguauauaaugauuugacaaauauccaauucauauuuuauguuuucuucuugaaucagccuagaaacugaagacuccauauuugggccacaauccuuaauauucuucauaacugccucccugggcauuuaugguuuacguucucagcuuucaucaaaaaauuauuucaaaacaggcuuauuugcauuugguuuacagaagcuguugaagagagugaaguccuaugugaggcacugcuuuagaaaggaaugcuaagaagggagacuggcuugucuuauugcccuaauauauaagaccuaaguaacuggucaaauuuuugacuggguuucugaaagccugaaaccaaauucuuaagcucaaauauaguaacugauauuuuuguuaguuuucccuuauuagguauugacuuuuuuuacuugcuaauuuuuuauuauacauuuaauauuuauaauauacauauuuuauuucuccaaguuucuuuaaacccuuuguggaagaagccagaagcuggacggauaagaucaggggucaguaaacuaugguuuggcccuugagccuauuuugguucaguauuugagugaagaauucuuucacauauuuaaaaaauuaaaauacauauauauauauguaacaugcauacauacauauauacagaaaacauaaacaaggaagaauaugcaaaagagacauacauggcccacaaagccuaaaauauuuacagaaaaaguuugccaaacccuagauuaaauagacggcuagaugguuagucagcuacaucuuuagaguuucucaaaauccuccacuacaggaauacauacuccuauacaaauuccucuguuaauacaauauauacuccucucuuuauaauauauuguucaaucuauuauaucaguuuauucaagcaucuauccaagaguuauccucuuaaauaugccaggcccacgcaucucucuauucuguauauacaggucauuccacuugaaauuuucuuuacccuuuccucuauuauuuccugguuucccuggcaauuccagccugagugagugcuuaauuauaggauuucaucuagaacucacaaccuguaauguggcacuuguaagaaccugucacuaauacugaguuagauuguguacaugacuugucccacaaagaggcuguaagccacuuaggugcaaggaucacauuguaugucuuuugacaguuccuaauucccuauacuuugcaaguuuccuauaaagcacuuucguaaagugugguggaacuacagauacugcuuguuaaaaacacagauuuuugagcuccuuucgaaaagcccucaauuauaaucucugggaaccgagcuugaguauugauguuuuuuuuuaacaugugucaaaagugacuuuuaguugaacuaaaguuggagaaagaucuauguuuguugauucauuauagguauacuauaucaugcacaucuaacccucagucccagggaacuaugaugaagaggaugcccauucuacuacugauuauuccuuacucucaagaaugaaugccauaggccacagaaugaugugcuuguuaggccuuggaaguuacuuuuggcuucuacaggccaauguuuuaauuaggaccagcccaggaugucaaccauugaauguaauaaagaucucugcaguauaauucuugccacaccaugucucuuuuaucacaacuuuauaguuagaugauuucagagaaauugguuuauauuccauuucaccuaaauucacuauaagugaaucagaaacccuaugaucauccugugauuggccuguugaaaaaggcaguaggauuuaugaacguuggguacaaacuggcauucaugacuaccauaauauaaagcugacugugagguuacagagcaaugacuuauauuuugaguguuuugcaaagaccaaaugucacaacauaaagcugucagauaauuugaguauaaauaacaguugaugcuugaaugccucuuuccuuuacuuaaauuaacuuaaauuguuuuaauguagucguaugcaaaggcugucacccuuuuaaguguccaacuucuaacaaauaaauaaauaaauauauaauauuuaucuuguuauuuuaauauuuuuuuuuauauuuacuacaggguuuacuuggcuuuuaaaaauguacgcaaugugccuaauagauguauuuugauuauuaaaauuugacauuaagaaacuuuauuauuuuuucuuauaaagauaacauauagaaucaaaaauaauuuaaacuauauaggaaauuuuguuuccaaaauaauguaaaauugcuuuugugauaaacuccauggauuuacaguuuaucagaaugcuaguaagaaucauccucuccaguagggcaaaguaucaaugguuuuuauaacacacuuccaaaauaagcaugcauuauauguaauaaaaucacaauucaagguagaauaauuuaauagcggacacaguuuuuguacauaccuccuacguaaaauacuaauuuaccuaagucuucccaugaaaacuaagagagaaaaccaaauuuuaauaucacaugggcaauaagcuauguuuaaaaaauucucucucuucuuacucauuuaagugugcuuuacuaauagcaaaggcaguagaaauguacauauuuuuaacacaugcccccuaucacuuagacaauauuaaguauagccaucuucagauagucaagaaaaacaacuuaaaaccaaggugaaugaugauauguauguuuaaaagggcuauuuagccuaaccuucuuuauaaaaugaauugaaaaaacauaguuuuugaacuuuacauguaaccguuacauucacauuucuugugaaauaugggguaaaauauauuaaaaaauaacugaauagucaaaggcuuugcauaaaaauaaaaauauaaauccugaugaucaaugcuauuuuauuuauuuacuuaauuagcugugcacuuggcuuugaaaaucucuuuauuaaauuauugacaguauaaauuucauguauguaaaaagccuaucauuugguaagauuugacauauauaugcaccugugaaaucauuuuaaaaaaucaagguaaugaacacagucgagacuauuuugaaaaggaauauugauuucuuuggguucuggaaaacuaacuauucaaagacuggauacuccgggauuguaagugccuaacuaugauugauauggagcuguguauuuacagcaauaccauuaaaugauauucuagugacaaguuaaaucccuucacaguuugggaucuuaauucugcauggugcuguagggcaauccuuguaaggccaaccaacuugucuccuagguacuuguccuaucaucaugcauuuuuuucaucuauucacacaggauuaauugagcaaauauuuacacucugagaaugucaccaagaucaacuuaaagcaaaagggaaaaauaggcaaagcaucucuauaauacuuuuuuuucuuuaaucuuuuuucccuuucugugaagacucauuuuccugacuucgcugccucagugguacucuagucagcacaucaguccuuauuaauauuccucaccuggggccagauuuucccaguagagcccuguggucugauucuuucauucuguuuauggaaaagagaggauaauaaaugaaucuugcaguaguuguguuuguuaauuacuuucauguuguuuauagaaagaauagaucaauaaauaaauccaugcauuaguuguagugguuaauuauagcuuuaaaugacaauccuucagguucagauuauuuuaaaagcugucauuuaauauuaguuauggcacugcauaacuaauaacaaacuauuuagcaccuuauggauauuuugggucaagauaagcaccauccugcugcuuuucaaaucuuaucauaaugcacuaaaggaguaaugcauaaagccacauuugucucuuuacaacucugagucuuuuuuucaaaacaugucuuugaaauaauauaaaacaccuccauuuuuuccaugugucugucauuauauacaugaaaguaauauugauauaacuuuaauucuuucaugaguuuguccuccaauauaauuuucuuaaugauuucaguaauuuucauuagcuuuuugggagagguaacacuacuucucugacauuaugguccacuaaaauuuuuuauucuauuucacccaaacuuaaauaucuuugcuaguuuuuaucauugucauuuuuuuuccuuauugcaagugaaaaguuugucuuuuauuuccauccaauuuauuuuuguuaguuaaggcacauucacugcucuuuuauuaaugcugaaaacuuaauuauucaaacacaacaaaacuauaucuuuuuaaucaagaauuacaugcuuccaugagaauaaaauuuuuuaauguauggucugcaauugauuauaguauuaccaguauuguguguuguauuaguauuaccaguauuguguauauuaguauuaccaguauuguguguguguguguguguguguguguguauauauauauauauauauauacacacacauauuguguguauauguauauauacauauuuuauauccagagguaauaauucuauaaaaauaaaauauuuuuaugugguaaauccuuuauucagcaauaagcagugaauaaaauuauauuuuauuccuaugcguugcugaaguaggaauaaauuaggaaaucaggaaauaauaaauagauauuaccaaguagggcacucacacaucaugcuaucuuucaaaaaguauauuuucauuauauuauaugagaaagauaauucauaaaaugcugucaaaauuaaaggaagguauuugacauuuuaacauuaaaaauacaaaaugcauuggaauauuuuauuuaugauacuucuuuuugauaaaugguuaauauuaacagaauucuugaagauaagagaaauauauuuucaguuuauuacuuguaggcuuaaaugucuucuaucuauagaaacaaucucaauauuuguaaaguuaauagucuguauaaggaaaaugauuaaaauguuucuuaaauuaugccauuucuuuaaaaaaucacuaucuguagacuaaucaauaaauuuuugguuuucauuuucuacugaaugguaucuuaaacccaaugucauugcacugaagugaaaugcaucacucuuuacaauguaacagggcuacaucauucaucuaccucaaugaucuuuaaauugcuauaaccaagcuacaguaucaaacaaucaaaauuucuguucauuucuuggauaucucuuauauuugcaggcaauuucuauugcugauauuauuaaguaaaucagauaaacaagauuagaaugcuaggcacuacauauaugucauuuucuguguuucagaucauucggaaugagcuucauuuuucuuuuucuacuuauuauugacuuaaacguuaaguuguuagauuucuugcuucucuccugcuauuacugcuauuucuuuuuugucccacgugcaucaaaaaauaagcaaauaauauuaaauuagaugcuuuaauaaaacuauacagccaacauaaaaguaugucacaauccucuaauguuuugaauaacuuuagauuuugguaucuccugcuaugucacuacuuaugcauaagacccaagcaguuucaaauuguuuuguaugucugucacaaaacuauagcacacuguacagaauaacucaauucaaaaauauuugacccuuuucccucgcaguacauauuaguaauauagaauguauuuggucuauauugccuuuuacauuuauuuaucuuucuuuucucaaguggaugaugucuauauccauaucaucuaucauauuuauauuaucucuauuucuaucuaucuaucauauuuucuuuauaaaaagauuaccaauaguaaguacucaaaaccuuuggaugaugcuauaugaucuugaagcaaccugugacuuuuguuccucaauauaggucuaaccuugcuaugccaugauucacccaaauggcuucuuggaaaaggggauugauauaacagccccaucauauuuuugugugacuacauugugaccaaaaaaaaaaaccaaaaauuaaaaaucacacuuucgcuaaaaaacccuacuuaugauuauuugucuaaauaacauaauuuugaaaauacuucguccaaaauuacaauucacucucuagugcaccaauguauuuucaaucaaaauauauuucuguuagcaacaauaagauaaaacugaauaugaaguccucaguaaguuaaaacaugguugccauucaaaaaaagaaaaggaaagccuugaaaaaaugaacgggaauauuacuucuaccaucaaaaauguggacagugaaaaaaaggcuaaaaguuaaauauuacauaaaauauuguaggagaaagucaaaagaauaggaagaaguguagccaaaaauuauuuuguauuucagcaaucaggguuuucaagagaaaagcaugaaagaauugauuuaccuuauagaaaaaugugagcaauuuuuauaaguaagguuuuuuaaaauagauuuuuucuuggacuucaauaaacuauaacauaacuauaaaacuguaauuauauagagauugucuguacuuacagugugucuuaguccauuuuguggggcucuaauaggauaccugagacuggguaauuuauaaggaauaaaggucuauuuagcucauaguuccuuagucugggaaguucaagaagcaugacaccagcaccuucaucuuuucuggugagggcuuucaugcugugucacaacauggcagaaguucaaaggggaaguagacauguccaaagagacaagacccaagguguuggcuuuauaauaaccccuucgcacaagaacuaacccauucccaugagaauuaauccagccuuccgagagugagaacucacuuauuccagugagaaggcauuaaucuauucauaaaagguccacucacaugaaccaaacacauccccacccugaggaucaaauuuaaacaugaguuuuuguggggacaaaccaauccacaucauagcaaacacaugaaaaacaaaaacaaaacaaaaacguuuucuccuuuacuauuuaucacuaauaaguaaagguuuuggaauugggagaagacaagucuauggaaaagauaccuaacuagaagucuagucuuuuaacaaacuaaagguuuuuuuaagaaagccauucaacccacaaaacuuaggcacuauauauauguaagauagagauguuucaccaaaugauugcuaauuuuuuucuuaauguaugguccuucagaaauguuucgcauucaucagaaaaaauaaugccuacuuggaaaaacauuaguauguauaugaaugaauaaaauguucacguauuuauuuuuuaaaguagauacagcuaacacgagagcuauaagcuauaagaaaaagaaaauaucuggaagagacuauuguauaauuagguuaucuaacaccaacagcuagaaaauaaauagcauuuaggaggccugaauuucuuuguuuguuuguaaaagacugagaaugugacaaccacggaaaggaaaagaaggugaaacaaaucuuauuucaugacuuucaauaaauaaaaaucacguuggaaugacaacccaaccccugcauuguaauuacuuuguuugucccaagaauaauuauccaauuuccaauuugccuuggaagaaaaaaguauacauaaacguaacacuuuacaugagagaaagaaauaugcaauuucccccacaauccuaaaaaagacugucucuuauuuaaugaaagugcacuuauucaaaucauauuacagcuccaaauggcuauaaucagacauucuaaaaugcauaagccugucacugauagauuucucaucucauuuugggauauagauucauaacaaccuugaaagaaucaaaagaagaaauucucaagcaaagcauuucaaauacaauuccauuuaaaaccacaaaacuacuuugauucagguacuccagagcaauaaaacuccccauaguuucugauuaagaauugcuuggaaaaguuuucaguggauaagugguuuucucuucaugagcaucaagugacuuacucagggugauuauacucagcuagaugcauucauuuuacuaguuaaacauuucaaagcacaaccuauauuaauccaagcuguuuguggaauuauguuaaaaaugagauucauuucucacuuuugauuauuuuucaaaauccagaaauauuauuuuacuauuauaacaggauuuaauaacccugaaaaguguauuuauugaauuuuuaaaaaucaaaauucacuaccaguaaguaaaagccauuuuuugcaccugaauuacuaugauuaauaaaagugacucuaauuacucaaaaagagcaucuccaucuccaaacauuuaucuuauugaaaagaacucuauaaaaacucagcuuucuauauaacuuugguagauuauuuauuaaaucuauagagaauuuacuagaaagacauuuaacacucuagaagaaaugcugacaauuuaaaaucagaauaacagguccucaaaauauuuguagcuucaacaaaaucagagggaaaagaaguagagaaauaguaacacucggggaaccuauaucgacaaccuuaagugucaugaacauaauaauugauaguaauacuaugcaucuuaaaaauaaggccuuauuuuggaauaaaaauauuuaaauaucaccuugaaaaaggguccuucagaauuauuuggaauuugacagaaauuuugauagaauuugagauuuuauguguguguucacuuaugcucuuacggaaacuacagacauggauuaauuuguuuguuguuuguuuuuuagucuguauuacuucuucaguuauuuauauacuuauuuaaugcuuaguaaaucuuuggauuucaacaugguuacuaauuuuggauuaggaacaauguggacauucauguuuuguuaaaaccuuuuugauauuguggaaaucuuuaacuguacauuauuuuacauuaauuauaauuaaaaucuaaguagcaauaaauuuuauuuaaaacgaucuaauauuaauuuuuaaaauuagaacuaguaaaucuauaauuuuuaaauguucuuuuucagaguccuuaguuucaaacuuucaccaaaggagauaauuugaagacacauuucauaaauuaaaaauaauuuugguuaugguaagaacugaguuuuuuguuuuguuuuguuuuuuuagacagagucucacccugucucucagguuggagugcaguggcgcuaucucagcucacugcaagcuccaccucccggguucacgccauucuccugccucagccuccugaguagcugggacuacaggcacccgccaccacacccagcuaauuuuuuuuuuuuuguauuuuuaguagagacgggguuucaccguguuagccaggauggucucgaucuccugaccucgugaucugccugccucagccucccaaagugcugggauuacaggcguaaaccacuucguccggccugaguuuuauuauuauauguaaaauugccacacuauaaaguuucuucagaauuuuuuauucuaaucuaacauuggaauauuuccuauauaccaacagucaagccaagagccaaaucacaaaugaacucccauuugcaauugccacaaaaagaauaaaauaccuaggaauacagcuaacaagggaagugaacgaucucuacaaggagggcuacaaaacgcugcucaaggaaaucagagaugacacaaauaaauggaaaaacauuccaugcucauggauagaaagaaugaaugucauuauaauggucauacugcccaaaguaauuuacagauugaaugcuauuuccauuaaacuaccauugacauucuucagagaaauaggaaaaacuauuuuaaaauuuuuauggaaccaaagaagagccaaauggucaagacaauccuaagcuaaaagaacaaagcugggggcaucauguuaccugacuuugaacuauacaacaggacuacaguaauaaaaacagcaugguacuuguacaagaacagauacauagaccaaugcaacagaauagagaaccuagaaauaagaccauauaccuacaacgaucugaucuuugacaaaccuaaccaaaaaaaaaaaaaaaaaaugaaggauucccuauucaauaaaaggugcugaaauaacuggcuagccauaugcaggaaauugaaacuggaucccuuccuuauaccauauacaaaaaucaacccaagauggauucaauaauuaaauguaaaaccccaaacucuaaaaacccuagaagaaaagcuaggcaauaccauucagaacauaggcacgggcaaagauuucaugaugaagaccaaaagcaauugcagcaaaagcaaaaauugacaaaugggaucagauuguggaagacaguguggcaauuccugaaaguccuaaagacugaaauaccacuaaacccagcaaucccaauacuaguuacauacucaaaggaauauaaauugcucuauuuuaaagacaugcacacuuguguucacugcagcacuauucacaauagcaaggacauggaaucaaccuaaaugcccaugugguacauauacacaauggaauauuaugcagucauaaaaaagaacaagaucauauccuuuccagggacauggaaggaggccauuauccuuagcauacuaauccaagaacagaaaaccaaauacugcauguucucauuuauaagugggagcuaaaugaugagaaccacguguauucauagaggggaacgacacauacuggagccuggaaguggaggguggugggugggaggaaaaagaagaucaagaaaaauaacuaauggauacuagucucaauaccugagugauaaaauaaucuguacaacaaacccucaugacauguuuaccuauguaacaaaucugcacacccugcacauguacuccugaacuuuaaaguuuaaaaaauuggaauauuuacaaauaugguuacaaauuaauucaacaugauacaguuuugcuuaaaauaagcucugcuuaaaaugaauuuuauaaccuaguguuauagaucauaucuggaaauaaaucaauuuuugccauuuaaaaaaauagagcuucaaaaauuuuugugcaugugagguuauauuagagagaaauaaucagagugcuagugcuagagaggagcuacuucaaaucacaggcaaaauauuacucaucaucaaggucuaaauuacuugcacacuucugauaaacaauacacagauaauuuuaaauaugaaacauuuaaauacagaacuauccaacuaacaaggagaaaauaaauguuauuccauucauuuuccauagcuagaaauaauguuucuugaaugcaaggucacagaguuucacauauugugaaagaaaggcaugacuaaagggggacauucucaauuuucagaaauauuugccaucagguaaauaaggacaucuuuacauuaacaggggguauguguuuaagguccuaguaaaaauacugcacauuugaauaaccuccccucaaaaaccaggacuauaacaagaaacagacuauccacucacaaccauguuuuaauagacuuuauacuuuuuaaaaugaaggccaguuuucaaacagaauguuucugguuuuggcacagccuuucucucucuuucuauguauauauauacaugcaugcacacuuuuuuuauauauauauaaauauauauauaacauuauauauaugcacauauacauguaaacauauauacgcaugcacauuuuauauauauauaauauauaaaauauauaaauauauaaaauauauauauauauauguaaugauuucaguagaaaaguuuugcucucuggaauggcaacaauauguguuacuuguuuuuuuguaauauaccacuuuuuuuuugucaagaagaaaaccuuggaguaaacaguacccaaaucaauagcagaauuauuauuuuuuuuaugcuuuaaguucugggauacaugugcagaacuugcagguuuguuacauagguauacacaugccacggugguuugcugcacccauuaaccuaucaucuacauuagguauuuccccuaaugcuaucccccacacagcaccccacccucugacaggccccagugugugauguuccccucccuguguccuuguguucucauuguucaacucccacuuaugagugagaacaugcaguguuugguuuucuguuccugcguuaguuugcuuagaaugaugguuuccagcuucauccgugucccuacaaaggacgugaacucauccuuuuuuauggcugcauaguauugcaugguguuuaugugccacauuuucuuuauccagucuaucauugauggacauuugggcuaguuccaaaucuuugcuauugugaacagugcugcaauaaaaauaugugugcaugugucuuuauaguagaaugauuuacaauccuuuggguauauacccaguaaugggauugcugggucaaaugguauuucugguucuauauccuugaggaaucaccacauugucuuccagaaugguugaacuaauuuacacucccaccaacaguguaaaagcauuccuauuucuccauauccucuccagcauccguuuuuuccugacuuuuuaauaaucaccauucuaacgggcaugagaugguaucucguugugguuuugauuugcuuuuuuuaaugaccagugauaaugagcuuuuuuucauauguuuguuggcugcauaaaugucuucuuuugagcagugucugcucauauccuuugcccacuuuuugaugggguuguuuauuuuucuuguaaauuuguuuaaguuccuuuuugacucuggauauuaggaauacaacuuacaagggaugugaaggaccucuucaaggagaacuacaaaccacugcugaaggaaauaagagaggacacaaacaaauggaaaaacauuccaugcucauggauaggaauaaucgauaucaugaaguuggccaugcugcccaaaauaauuuauagauucauugcuauccccaucaagcuaccauuagcuuucuucacagaauuagaacaaaaacuacuuuaauuuucauauggaaccaaaaaagagcccauauagccaagacaauccuaagccaaaagaacaaagcuggaggcaucuugcuaccugacuucaaacuauacuaccaguuuacaguaaccaaaacagcaugguacugcuaacaaaacagacauauagaccaauugaacagaacagaggccucagaaauagcaccacacaacuacagucaucuaaucuuugacaaaucugacaaaaacaagcaauggugaaaggauucccuauuuaauaaaugauuuugggaaaacuggcuagccauaugcagaaaacugaaagcagaauucuuaaaaugggaaagaguaagcaucccagccaacccaaaguuucaaaaaaguuuuccuuaauaccauaguuuguaccaaaaacaaaggaacaaguaucaaucaauuuucagucacuacagaauagcuuaauuaggacuaaugucuuagugaugucuaaauagcuccaaugggucagguguccugauuaagaaggaaaauaaaauuacuggaaaaaacagacauaggaggcaauacaagcaucaguaaccuaaagccauuauuacaauuccaauuaugcauuacucacauggacauaauauucauuaguuugaaugagagucaccccccugccaaauaaaugaacuaugaaacuucuauuagcacuuuuugugaaauuaaugcucaaaacuauucaaauuuaaauuauauaaaaccuaguuacugcuaaaagagaauguguaauccccuugaggcguccagauaggccugagagaacaagauauauauaucuuucucucagacuacagagaaauuuagagagcagagaaagcagaaaauuugagguguaaugaaaagccccuggaauuuugguucaacagaaccuaucauaucaugaguguugucauguaauaaauuugucugugguaggcuuccaacacauaugggugaauggcuuacucuuugagucucuccuaucacugucugcccacuugugcaauuucugugaaauaaaccuucacuaucugucacuuaaaauuaaaucaugacaaugagaucuugcuaaaggaguacccauaugagcaaaugcuucuuaauucugugaauuccuaauauaaguucuuuuaauaauuauuaccauaguacuggguccugaacauuaguuaccacuaguggcugaaacuaggaauuagguuguucaguggauguuaaguaccaccacaucauauuguugaauuugagcuggacuggagcuucacugguguguguguguguguguaucuguuagauauuggagugacacagauuccagugugccccacuguugaugcucucuaguagagugggaaggaaacuaaacuuugccuccucuguaucagacacagucuugaacuccuaacccaacuaauccuaagcauguggacuacagaugacaccacagacuaucucggucucuuuaugagcauauucaugucugugaauguucucugagaguauggaugccaauaguagcuaaauuccucacaauuagcucuucccucaaacgugguaagauaucauaccaagguauugucaggguucuccaggggaauauauguauauauaaauauauauuuaaauauaaauauaugccauauacagagauuugauaugagagauuggcucacauaauuacggaggcuaagaaguuccaagauuagcuaucuggaaacuagagaaccagaaaagugggugguauaguuucagucuaaacccaagggccuaagaaacaagagagccaaugaugucagucccagucuggguguaaggcccgagaacuggggggcugauggugcaauucccagcuggagucugaaggccugagaaccaggagugcccaugucugagcgcaagagaacaugaauuucccaucuuaaacagggagcaaacuuacccuuucucugccuuuuuguucuauucaguuccccaacagauuggaugaugccuauccguaugggugagguaaucuuuacccaguacgccaauuaaaaugcuaaucucuucugggaauaccuuauagacagauccagaaauaauguuuuaccagcuaucuugggaccccuuagcccagucaaggugacacauaaaauuaaccaucacaacaagcaaacaguucagauuuuauaguccuucuagaaaagucguuccuauuuucaccaagacuuggacacagaauuguaccccaucagucaucuuugcuccacacuggagagguuggcaugaucccaaccaccagaagagauagcucccauucucuccaagaggcagugaaugcugcuuaccugagguagaacuccuccagaagugaucucaaccaaccagcugcuaacccuuccagaaacucagaguaacccuaaacaucagcagauacggguuauuuucucuacucugcagugaaaucagauaggcucccuaagaagcugaaacaauuugguccacagaauauacuuuucaagagugcaggguuccccuacccaucaagagacugcugggaucaaugauuuugagagucuaacucaaugguaauguuagaaaguauuagacugcauauccaucucaugacuuuaugguacaagcuauuuucuugaagacacaucagaauaaaagcugauggagcuaaauguauaaugauuauauauuauaaauaaaggagaaugggauaaagaaauaaaagcuauuguguucacaacauacuauuacuucauaauauuuucuuuucuuuuuuucuuuuuuuuuuuuugagaaggagucuugcauugucacccaagcuggagugcaauggcccaaucucggcucacugcaagcucugccucccagguucacgccauucuccugccucagccucccgaguagcugggauugcaggugcccgccaccacacccagcuaauuuuuuguauuuuuaguagaggcgagguuucacuguguuagccaggaugaucucgaucuccugaccucgugauccaccugcuucggccucccaaagugaugggauuacaggugugagccaccaugccaggcccuacuucauaauauuuucuagauucucucuauuauauaaaccuuccaagacacaauucauugcuggaacuaggacaguaauugaagauggcagauuuuccaauuaugggcuuaaacuauaaagacuggguuuaugcaggcuauguuuaccaucagauuuucuguuauuagauuuccauacaacuguagauauuauaguuuccaagccuugauuaacagacuuguagaauuuuggagccauaaaggacauuaaaugaaacaaaaaaguuaguguuucaugcuaucacugugacugucauguauaauccucugucaaccacaucuaaaaucaaguuacuuucaccaccucacauagcagcuucuugucagaauagcaacuagacuuuguaguucuuguguuggguugaaaaugaauucuguuaauuccuguauauuucugaacagguauuauuuuaauuuucccuuauuguguaaccuacaaacauaauuucaauuaauccuuacaaaaauccugagagauaaguauuacuauucacauguuacauguguuacauucacauauuauagaacuugaaacucaauuugcuuugaaguccaaagaucaaacaaucaguaagugacagaggcagaauuucaacccagguaugucuaacagcaaaggcuacacguuuuuccacuacagccuguuaaaucuagucucgcugugagacaauaaucuuaaaaguacaaauacuaaugguccgaauaaacuuguacuuuuauggguauuuccauuuugcuuggaauaaucaauuuaaguacucacuauuucccuauucacaacaaauucuugcaaacaaauuauacauauaucuugcuuaaccauuaaaauuauuguuuauacuuuuggugaucaagugcccaacucugauaggaauugaggauaaagaguguaacacccacuaacauucugguuaauuuaaaugcaaauaauuauguuucauguaaauagaagaaaaacaaggcugcuaaacuuacagaugcagagaagaaucuuauggauucuuacaucaguaugcacauguauucauuaguucauucauuaaauacuuaacaagcaucuauuauaugccauucauuaggaauacaacagaaaacaaacauaguucuugucucaugaaguaacauuguaaugggaaagacaaauuauaaaagaguaaguuaauuauauuuacauauacacauagaagaguuauauguauaauuauauugucaauucacaauauuuucuagauucucucuauuauauaaaccuuccaagacaugaauucauuguuagaacuaugacaguaaauaacuauggcagauuuuccaauuaugggcucaaauuacaacuggguuuuauauuacaaagacugauauaauaucaguuugcaaaaagugcuuuaagaaaacauaaaacaggguaauaccaaaagauaaaugucauuuuagauauuccagaaucagaauacaaauaaaaugcugaauacaagugcaauauuuaaucacuggcuauuugaaagcagagcuguucucuccuccuuauaaguacaaagcaauuaaagauuuuaguccauuaaaaauugguguauuuuuaauagauuacauaaucuauuaauuaauauauaauagauuauauaaucuauuaauuaauauauaauagauuauauaaucuauuaauuaauauauaauagauuauauaaucuauuaauuaauauauaauagauuauauaaucuauuaauuaauagauuauauaaucuauuaauuaauagauuauauaaucuauuaauuaauagauuauauaauauaauauccuuugcgaagcaguacauuagguuugcccaagaacacaaaguuguagacuuugugaauuuaaagcuggagagcccgaauaaagauucuaaguauaucugagaaaccacuguaccuaggagguaaaauaucucugacguacauuuuauuuuaccaacuuaugagaaaacacuuuuaugaagauauuaagcauuacuaugcaauuaagauugguugugaaaccagcuuuaaucagcuuuuccuagccuuauuccguuugugauaaaguucaaagacacuaagucuagaguauuacauuuuaauacuggaauucagucugcaauaauaugugagcagcacuggcaaacuuaacaaaaaugagacaaauaagcaaacaacauuauguaaaacucuucuaaugaaaaacauauauugauuccuuaaacguagaguuauuuaaucuuuacuuuuuaugucuucuuauaauaacuuuugcucaaauuaauuuuuuuuuuagaaauucuauauagugacuaacagaaacagaaauaaccacauucuugggcaaaauuuaaggguauagaaaaccuuagcgauuucaaaauuugacuuugaguuuuaccugaauuuaucuucaaggguauauacaaugugcuaacauguugauauaccaucugcuaaauaaguaccaccuuaugacaaaauagaagaacauguaaaaauuaucaaaguaagaaaguccuuaauuuagaugaacaucagugagaaucaaauaaucccuuccacauucucaccaaacucaaaaaaaugaaaccaucauucauacaaugccaagagagcaaagacuaguccaaaauuugggauuaugaauccuugguacaucacacauucaaauccugagcagacaaaacucuguuuaguuuaugagaccugacaauaccccugcuugaggugauaaggcugcagucuuuguauacacugagccacuggcagcagaauaaacacugacaacuugacaguccgucaacugaaaaaccauucacuccuuuugagacauggagaaacugggaguggaaccuucauuuuggacacacaucuaguaaaucuauauugcaauuguuugcgugguguuauuuuccuuucauaaguaucuuugaaagcauuauuauauggguuaauaccuauacaaaggaacugccccauuuauaaaaugagcuggcaagcuaugaauuaauccauaauacuuuuaaaauuacuugaguguuagaucuggaguuuuaaaaaaauuaguaauuaaauugcagcuuaguagaaaaauaauugaguuauaaaaaugaaaauuucaaaauuaagaaugcuuaaauuuguaaaacaaugcaaaaaaaauuucaagugucaaagguauacaagguaccauggaauaaauauuuauagugccuuucauaauaccucuauagugccagcucacagaacauuucaauacaguuugggaguugggacauaggaacauaaaaaaugaaauaauuacaggaguuauuacuuaaggacaaaguagauguaaucuaauguguaugauucacuaucauuuuaauagcagagauuuaacaauuacaaacucugaauucagagcagguugaaacaacuauauugaccucagaacuccguuaaaugacacugguuuuagaaggcuaaaugaagcucuccucugccacccucacaaacaucccuugaugagugccuagaaccuacccagccuuaggauaaugaauucaguucucucucuccccaaacauaauuucuggcucugaagcucucucacuuaauccauacuaauauacaagcucuucagaugugcugaacacacacuaaccucucgagccauacuuugucucuguuauacucuuccuuucuucauugccauucauguucaguuuagauuuuaugcuuugucacuucaaccauugccuugccaauguucuuaaccauacugccuuguuguacugcuaucaaacacaaagcaacacaauacaaaacaaaaauaacccgaugaagcuucaagccuacauuaauuuaaauuuauucagucugcucaaugcugcuggacaaacauccacaacuguguagauuaguacuacagugauuucuugaucucuagccucaugugagccaauagcccucccuggcauuucuucaauauucccuagucaccucucuuguuugccacagcagcuauuucgaaacuucuccacuguuguuaaaccuccagucucauuauugccaaugccuucugcugcauuuucccaauuagaagauaaucuugccuccuauuucuccaagcaaagacaauuuauuaauaauuuucuuaacuuccuaacaucaaacauaaagacuugcuugcaaacacagcauucuuuucuuaccccuaccccuuaucacccuggaaaaugauguuccccggugccuaugguuaaguacuccaucuaauucuugauccaauccucucuuuuccccuacuguaucgcuaucaauuaucaccuuucuuucuuauaucuucauuuucuucuucacuacuggcuuggucugugagcauucaaauauacucaaaucucuuacauuguaaaaaaucucucccaacaacuucacaaagucauuuaauuacuacccaaacauacucacuuuuuuuuuuuuuuuacuuuucuacuguugcuauuuaaacauauggcauuaccccucuacugaaauuucaguuauuaaugaaaauuaaccacaacuucuugugauguacuagacaugguucuggaugcuuugccuuguugcuaacucauuuaaguuaggccagcauaccuuaauuucaaaauccaacagaaaggacagcuuuaggcaaccucagucauaaguaucaauauaaaacccuuaugcaaggugguagcaaaucaaauaauuuuauguaaacauaagcauaauuauaauuuuacauauguauaagcaauuuuauauaaaauuaugcauaucccaggaacguauggaguuuccuuaaucugaucuaaguuaguuauaaauauauaguaguauagugguauaguggugaauguuuucucuccgagauugauaacgauccaaaaaugccuacuacuguuauuuccauucaacaucaucccuagaagguguaaaauaacaaaagaagaggcaaaaacucuuauuaauugcaaaugacaagacaauuugcagaaaauucacaagaaucuacaguugaauuaucagaauuaaaagucugagcaagagugcuagauauaaaaucaauauaaaauaucauuuguauauacagcagcaaacagaaaaugacauuuagaagauaccauauuauauuuauagacuauaauaccacucagcaauauaaauuaaaagacaaacaagcaaaauuauugacacaugaaaauaagaauguaccuuaaauguugagagaagaaagacacaaauguguaaauacuaccuuauccauuuauauaaacuuucaggccaagcaaacugucugugcuucuaauaauaaaaacaggaauaauggcacuuucugagugacagaaacauucaauaacuugaccugguuagugguuaaauuggugaaugcgacuacucuaagucauugugcacuuaaauuauaucucaauaaaacaaaugaagaguauugaagaguaaaauuuuaccuuuuucuuaccccguauauauauaaaaaaaaaacuucuagauagauaaaagaccuuaauuuggaaggcagaacuguaaaacccuuggaacauaauugagcauaauauauucaugacucugggggauagggaguaauuucuuagauaauacuaaacagcaauaauaauaaggaugaaaauucauaguuccucuaaauuuaaagauacuauaaauggcauugaaauaaaauccacagagaagaaaacaaaacuggcaaaaauuaaaugauaaaacacuaaaauucagaauauauacauaacuucuaaaaucaauuauaaaaagcaaaagacacccuucuccaaaaaaaaaauaaugagcaauuaacucagaaacaccugaagagccuaaauauguaggaaaaggugcagacuguuucauaaucagggaaauguaaauugaaaucaugaggauauaucauuauauccacccaauaaguuaauaaaauuuuaagucuuacaaauucaagacuugauuagaauguggggcaaugccugcacugcuggugguauguaaauuaguaaauuacuaugaaaauggguuugauguuaucugguaaaguucaagauaugguuucuuauauugcaggcaguucuacuucuggauacaaaaccuacagaaauacaccuacaagcauaaaaguauccaagauguauauccaagaauuuuuguaacagcagcuuauagcagucuaaaaauggaaacaaacugcaguggugugggacaaauccauacaauagaaaacaauacagcaauauaaaugaauaaacugccacuccauguaacaacaaggaucaauaacauaaacacacuguugaacacaagaagcaagaagaaaaggauauacgcauucuugagaccauucauaaguugaaacauugacaaaacaauuauauaaggauguaaacacaggugauaaaaacauauuuuaaaugcaaauaaauuaacaucguaaaaaucagucuaaauauuacacuauugacaaggauggucugacgguaaucagagagaagcauaugggaggguugagaauccuggcuauuuucuauuucuugaccacaguagugguucuuuccuuuaaaauaauucacuaaacuuuguguuuuaugcaguuuucuauauguuucauauuauucacuauaaaacaaaaauuuuaaaugcaucaagauaguuucauccauauuagcaugaauuuauugagaaauuuguauugcuaauuacuccucacuucauuuugucuagguuguuuugcaucuuacaucucagcacuaaaaauaccuacugaagaaccuguuacccuaaaugucaucaacuuuagacaguuagaaauuuacaguuaccagcucugcguacacaauuauguuagguuuuucccuaccaaauauagauagauagauagauagacagauacauagauagauagauagcaaauccaaaucauauauauauguguguguauauauacauaugauuugauauauuuauaugauauauauaugauuuauuucccuaccaaauauaucuauauguguguguguguauauguguauauauauaauuuggauuugcuauauauauauauauuauauauaucaaaugcuauaaauauauauauauuugauauauauaucaaaaauuuauauauagcaaauccgaauuauagaaacaucauuuauauaagggcguuuguauuucuccuugagaaaguuauugucccaguauuucaugaaacaucauuauuggcacucagcuucuucuuacaugugaucaguaguauccaacaagaguucauuuucugcaaacuauuuucuacauauuacaugacacauacagaagguaaaauacuguaaugucacaucuugcaguagacuuucugucuuacuauaugaaauuuauccaagcucuuauucugauuuuguacauguuacaaguuaaaaaccaagcagcuacaaaguguauaaauauuaaauuuacuauuuuauaaaaacuauuauuguaacaaaugaaagaugaugcuauuucccuagguaagauucagauuacuuuuuuccuuuacauuauucuaagucggaaauagaauuucuugcuuaauacuucugguaaauauuuaaagucauuucaaugccuaauuuccccucacccccugcuuucucuuucacacuacaauauugacuuuaauggguacugugaucauacugcauggaaaacaaucaagcaaaaccauaguauaggaaaaagcguauuaaucagugugucuugucuuacuuuucgaacaccucugccaagcucuucuccauaguugguuccaaggauuucaaaguggacauugggauugccuccauuuucuccaaauucuagcucuccagucaacccacuaacuccacccuaaaggagagaacagauacugauguaaaauuugagaaguaaaaaaauaaauaaauaaacauaaaaggaacuucuaggaacucuacuucuaucuauaaaauaauauuuaaaguaagcaauuuuuaacagacuacuuuuuaaaauagguacacagcauaaacaggaguacaguugaaccuaacuuuggaaauuccuuaauccaaucucauccauuuuucauaaaaacagaaauuuagaccccaaaagucaagugacugcucaaaaugaaaccauguuagagcucagacuaaguuccaggcucaaguuuuugccaccauaccuugugacuugaauggauccaucuugaaaacaagaugcuucuggagugcauaaaaucuauauaagauagauuucaacaaucuucuuuguucuagcacaauuccauucaauuuggucuaaaauuauaccuggggaucuuaaaauccaugguuucuagauuauuagagggugauuuuuuugccccuucuuuaaauauauuuuccaaaucaaaaauaaaagaaaguuaaauuaggcuugaaaucuguuuuugcucuuaacggguagugcuggcuguugagauucucugggaauuccaagcuucaucuuucauucaauaugacagauguucauuuauccaacagauggcaauguaggucauacuucucucuuucuuguuuaucauucuuuucucaguuuaguuuaucagucuucauauuauuuaggauuuuacaaaugaaaaucgcacucugagucacuucaaugcuaaaauaugucuaacuuaaaauuuuggccugguaaugacauuuauuuagaaaacaaaugaucucaguuuuguaaauuguuuuaauuaucaccucuaagauguugauauuuaaauauaucucacuugacauaaccugcaacuccguuuccagucuuuucuggcugguaguaauauuaugcuauuugcuuuuccuucuacuucauuugugccuuguagcccaaucaccugaugcaaaguucaugaugaguucaauaaacuauuuuugauugauguuuuccuaccugaaucacuaauuuuaauauuuaaucuauuguauuuuuauaauaguaauaaucaacaaaauuaauucuuuacuauuauucccuaaucagccaguuucuauuaucuaguuuuauuaauaaaaauccuaguggauuuucaugcaugauuuagcagucaagaacauaggucacacuuccuggguuucaccaauggcuucgggaucuacuagauguguaaaccaggcuaagccauuucauuuaugccucaaacacuagaucuguuaaaugggaaaauaauagugccuaccccagaagauuauucugauucuuauaauacauguacagaauauugaaaaguucuugacaugugguaagagcuuaaauacuauuaucaucauuacuuccacuguuacuuaauucuuuauuuuugaaggauuuuuaguucucuuagaaaucguuggcauaaucuuguuuuguuaauuaaaauucaguggguuugccaaaaauuauuauacgcuuaaauauuuagauggcuuuggaaaauauuuuugcaaaugucaacucaguuacauuucauugauuaguacuugaagagaaaaaaguuaagcagcuggucuaggauguauucacuccuuucacugguguguguauagggcagcaacugagggugaagguuggucuaauuucccugccaauuggaacuccagguaaacagacugguaauauuuacuagguggaagauuccuuaucuauacaaagcccuuagcaggauaucccaggcuaaaaaauacuguaguaaauaaacccaggaucuauggauuaaugguuuguggcuccucagaaaauguccugaagcuuuacauuuucucggguaaaaauggaaauguuucauaauguaaauccucccuguggugagaaauaaaccuaugaaaccuuccuuggagaccgaaucagcauuuccagugugggaagaaagaaccuggggagccaugcagaaugucuccuccuuuuucuccuuuguucccuuugauugcuuguauuuuugauaagggcaauauaccugauucuugccaaucuauuccgguaugugcucacuguuaauaucucaaaacauccaauuauauuuuaaagacugaaguaagugcagugcaucuuauuaucauuaguaucuccaaaugacaaauacuguaggaauuugauugacaaauauagcuuauauuacuacaaguaaguucaaaaacuuguguucagaauauuuuuauacaaguuuuucuuguucauaaucacacaucuaccugauuaauaucuucuaauuauaucagaaucuuaaauuuauguuuuaguagcuuauuuauacgaaaaagauaucauauaucaauauaauugcuacauaaaacuacuauaucccuaaaauguuuacacauuugagcacuagacuaaucugguguuguguuauuauuuucaaucaauacccacaugaccacuccaggucaugccuuuauccuuuacuuuaucuuccacugaaugacuuaguuuacuugaagaagguacagaaaacaauaaauugggggacuugcauuuaguuugcugcagcauuuacuuaccuugcucaacuuuaugacuuugugauuuaucuuccuuaugcuauauuccuaaugagccguuggcauguaaaaucagugaaaccuucccucaugaagaugucagggaugauucagaggucaguauuucgagcaaauaaacccuuuaacuaaaaccuauuguuauaucacccagacuuaaccucucugauuuuggauugccuuagaaaauuccagcgcuuuaaagcuuuuuuccaucuauccucaaauuaaccuugaaaacagagccuuggugaaaaugugugcuagccaagggguaaugaauggucauuauuuuugugcaugcauggugguauuuuuuaucucuuggugaugcagcagauuuucaacaauauaagcuaaugggacauugguaguaugaauaacacauacagauaauuucuaaacguccuuuaaauuggcaguaaaaauugcugccagaguaaaccuuuuuaaaaaauaugaaauaaaauuuguuuuaauuucauccauccacuugauauagaaauaccaguggacaucaaauauagagagcaaagaguagaaaaauuaaaagaagagaaucagagguugagaauaauuuaccacuggauaaugaguuucuaaaaggcaaaauguauuauucaccuauggcuaggaaaaguuggggaaaaaguaaaaaaaaaauuacugagacuuuaugucauucuguuuaugaugaaggaucuuuuccuacgcuugaaauggcaaaggaacuuaagagauacuuuuggaggaucacgugggacaucaaauauuuaucauacucgucuaauuuccuuauacauauuucuagguuccuuguaaccugcagaugugugugguaaccaaggauaaucuguuaauauaagcaugggcccagcaaggcagugaauacucugggaggugccagacucagcagggagcccugaugccuucauguuucaucagcaucagguucagagagaaaaaccccuaaccagaaaaauaccacauuuucuacccaacaaacaaauauuuuuauggguaaauagaaacuaagauacaagaugcaaaaaaaaaaaaaagaggacgacaaauacaaagaaucuaguuugugugaaauaucuaggaaaauuugaguugccauguaacauuacguguguguauauauacauauauuugcauauauacauauacacucaaauagucauucauaauagagacucacagccagcugagaaguaaacaggaaguuacaagcauugugaucaugcugucuccaucuuaggggacccuuaggcccuaagucaaccgguuaacugaggagcccaaacugaaaccuucaucuugugucucguauuuuuuccuuuggacuauguaaacuguguguucaauauaacauauuauauauagagaauugcucagaagggcauguugaacugaauuaaauuaaaucuauuccaguuuaccuacuuuaugaucaaaaugaccugaagcuggaguguaucuuggugaauugacaagaggccuauaccgagagcauggaugacaguuuuuaaauccccaugacaaaaaguuuauuugcacacauuuuuguaaaaaggcuaccuuauauuucaagacaauacuguuugugguaagccagauuauguuuuccuaaauucucucucuuuccuucagauuuguaaauucuaaaugauacauagugcuuuaaacaaaaaguaaugucuccauuucucuaaguaugcagacguuuuaaaaggccacaaaaccaaacaugacaacuuauuagaguucauuuugucccaaccauuaaccuaggaaucauuauuuuaaucuuugucuuccucacacacuuauuaaaucaccaaaucuuauuucaauccuguaaauauccucaaggauaucuacuucuauccaucccauggcccacaaccuaaccagguccucucuaaguaagaagauuagccucuuaauugguguucugucaugcagucagucugguucaauggcaguugcagaauucucuacuuggcaagcaugggauaaucugauuuuaucaccacccuguuuaaaauaccucagugucggcugggugugguggcucacaccuguaauuccagcacuuuggaaggccaagacagauggaucaccugaggucaggaguucgagaccacucugcccaacauggugaaacccugucucuacuaaaaauacaaaaauuagccaggugugguggugcgcgccuguaaucccagcuacucaggaggcugaagcagaagaaucacuugaacccaggaggcagagguugcagugagcugagaucacaccacuguaccccagccugaaugacacagcgagacuccaucucaaaaaauaaaaaauaaaaaaaaaaauaauaauaauaauaauaauaauccuucagugucacguuauuccuugaauaaaauuuggaaauuucaacaucguuuaucaaacccuugauggucuuucccccuuuuagcuaauuagaagccaugucucuauucuggcugccuugggcuuauuucaggugcuucaauguguuaagcucucuuuccuacaagccuagaaacauucuauuucauuugcaugaggcauucuuccuuccccuuuccuggaauacucuucauuuuccuuucuuggcuaaugcauacuuagccuaaacguuuccacuuaucuaucacucucaggccuaaguaggcccuccaaugacauauuucuagaacacuugguauuucuccuuuuguagaacaaaucaugcuuguaauuauuuuugauauuucuauuuuccuuccuuauucucugaucuuaugguacaacauaugguaguauucaauaaauauuuguugaaugaauaaauuaccauguaagaaaugguauaauuucaauauuuuuaucauuucaaaaaauacuuuuugagauaucaacauauaucaagauaacucuaugagauaucauauugauauauguugggcucaacauauaucaauauaagaaaauguacugguacuuaaauauuugacauauugcauaaacugauauuuucuauuuucccacauuccauauuaaaaauaauuacauaaauuuuaacagaaauuggucaauuaagacaaugcaaaagaauuugauuuaaagaucuauuacaauuuaguucacuuacuaauauagaauacauauaucaagauaacucuaucagauaucauauugauauauguugggcucaacauauaucaauauaagaaaauguacugguacuuaaauauuugacauauugcauaaacugauauuuucuauuuucccacauuccauauuaaaaauaauuacaaaaauuuuaacagaaauuggucaauuaagacaaugcaaaagaauuugauuuaaacaucuauuacauuuuaguucacuuacuaauauagaauacauagaaaauguccagugauuuuaugugcaaucacauaauuuugaaucuaagauuuuucuuagcuuuuaaaaaauuaaauaaaagagguaaagguguucuaaaauucaggucugauuuuauccaaaaauuauuuagugucuuacauuuacccacaaaauaauuuuuuuccuaaaucacuuuccagucaaaacaauuuuauguguucucugcacucugguaaucaacucuugucauuguacaaaugauuuagucuaauagauauaucagcuacagcauucuaccaccugaaauauccuccuuccauagcuuuauauauccuaagccugcuaguuuugaaauuuccauuaagaugcuaucaguuccaugcaaauauuucuaaucuauuuucuaaguuggguucucaaggaaacagguaugagauggagauuugcuuguaugcagaagguuuauuugaagugcuacugagagagcacuugcaauggagugagggaagagggacuggacagaggaagagaugaaaguuugaugcaaauacaauaccaguuuagaucauccaacguacuagucuguagauaacccuucauauuuguccccugaagaaaugaacuuagacauuucuaguuuugcaaugacuguucauuggauucaugcugccccuagaaagaggguggaacaauucccguccauggcaauuccugaacagaggcucagaugucuuucuuggcugugaagcaaguaucucaguauguaccacagcacauuacacucuucucuaagauucuacaguauccuauauuuaccacauuugggucuuuuuguuguuucuggccuuagaguguagcucuuuguauaguuagucaauauucacuacuggccucuaaauuucuuuuuuuuuuuuuuuuggcagggggugcgggguaauuccauaaaugaguuugcacaguacauucuacaauauagaaauuugauaaauaccuguuaaaagagugauuaauacaugaaugaagugcccuguugaaaauuguuucaguauuaaaaauauuaacacuaagaaaaaaaugaaaaaugauuucuauuuaaauauaguacacuucuguaaauaaaaacaggcuacucguguugcaaugacauggcacuauuccaagaagguagaucugcacugggcaaauugauuuauaaauaccccaggggagugguuuucaaauuguagcucuaagagcugauuguggugggugucucuggaaauccucuccuacuuuuuuccagaacagcucaaauuuauugauuauauuuauauaguuaaaaaguuugaaagcuugcucuagguuacauaacacuaacaaauuaaauuauacuacaugaaaacucuuucccaauauauaaauauaguuuucaugagaagcuacaacaauguaacuugucauaauaaacuaaagacugaaaaacaagccauauuaaaacuuaaauaggguuuauauaauauuaauugaggguguuuauucccaugauuucuuggugugcauguuuagccaagugacuuugacaggagugaauaaaaaugauugccaugaacaagaaaaaugguaaaugguaaaguacacagacaccaaauuagaaaccaaaaaaccugguauuuaaaacuaauuagcuacgcaacacuuaguacaucauuuaauuuuucugaauuucgguucuguacaccuaaaaauagaauaaaaagguuagauuaacuuuauugugacuugcuacucuauaacuguacaaguuacuaauaaaaacaacuuaauuacauaauauaauaaaacaaaaauagaagaauacuuucuuuacaaaauuuuuaaaaauccucuuuucagauaaugcuccugguauguuuaagaguauacuuguugcaugcugcuuuuuaagucuaugccaauacguaaaguauuagaauuggagugauuaauuuuauuugacagugauaucaauguauauuugaaaaauacaagagaaccaguaauuaaguuuggaaaguugaucaggucagucaaaaaauauaugaaacaucaauaucuuccuuuaauaccuacaauaaccaguuugaaaaucuaauggaacauaucucauuuaugauagcaugcacacacacacacacacacacacgcauacacacacauccuauuaaaguuuagaaauaaauagaaugaaaauaugugugaagaacacuauaaaucuuuaaucaggauuacaaaaagcuaacuauauggauagaugccauguuauagauggaaagacucaauauuuuuaaaacuauaauuccuucaaaaauaucauacaacauccacguaaauaacaauggcacagggcugcugauaauauuuggcaggaauaaacaggcaagcauuaacugcuaauuuuuaaaaaaagaaugaaaaugaggaggcacuuauucuaccgauucauauauuauaaagcucagguacacaagaguaccugagaaacagaaaccuugcccauuacuagacauuuauacuacuaugucaaugacauuauuuuuaauucuuuuguuucauuccccauaauaagaauagaaauuaauuuagggagagaaacuuguucucuucuugcuuguacuuugugcagcagcacacggauuuuuaauguguauguagcgugcccuuaauauaggcauuuuguauuuauuugaauguaauuaaaaauuucaacacuagaauauucccaucauaauaaagagccugaccucauuuguguugcuggcugcugacuucuuuuuaagccuuacccucccuuucuuuggccccacaucuguacagucugauuaagaaaggccauccuacaucuacuuauuugacaccuguaggaaacuugagcuucucaaaucuccagcccgcaugagugggaaccuuuugccagcccuaaccccuagucaacaaaaaggcccaggccacucccucuguuuuguccaaaccagccugaaucugucuggggccauucugcucuucuugggagucucuaugugaguaaugaacuuucuuucucacuuaauguguggaguaucaccagcauugacaucuaaauaggugaccaaaaacacucauaugaugcaaaaaguaauccaauuuuuuuuucuaaaaauccauuuuuaaagucaguuugaaaugugagacaaaaauauaaaauugaacauuuguaaucauguacauuauucaaacugaguuucuugacacaaagaauggauauauuucuuuaaaaugugacacuggggcagaagcugacagggacaaauguacacauagucccacaaaauaaaauuucauaauuauuguauuaaauaauuguuuugguuauaaauuuucuaacagcaauaucuuacauauugaauuucuacaugaaaaauacugacauauuauggugucucucuuuccuuccuccugauccucucacuaaaguguuuucuaagcaaccuccuaaacuauuauuuugucuugguaugaaagcuucagaagaagaaauauauucaggauccugcauccuagccaaaccaugaauuaauaaauuggcaggauuagaaucauguucaacaaccucccuuggauuuauaccugccagcucucuacauagauaaggcuggaagauuuuggcaacaccuugaggcuagauuagacuuauucauuuuucaguugaaaagucuuucucugccaauauauucaauacauuuaauucucaaguacuuuuguugauaacagccaaaauucucauuaaaauuauccuuggcaaagaagacacagcauuacuaugguuugaaauccccaccaaaacucaucuugaaaugcaauugccauuguaaugguauugagaaguagaaacuuuaagagauaaauagaucaugagaguuuugccuucaugaacggauuaaugcuguuauugcauuaauaacuauaauggguuaauugucacaagaguuugguccccuuuuugucucugucucaugcgcuugcuugccaugugguguccuuucaccuaggauaacccuuaucagaugccagcuccaagcccuuggauuucccaguuccagaacugugugccaaauaaauuucuguucuuaauaaacuacgaaguccaugguauucuagcagcagaagacaaaucaagagagaaaacugguaccaauaaguggagcuguuguuauaauaaauaccugaauauguggaagugacuuuggaacugcauaaagguagaggcuugaagaauuugaaggaucagacuagcaaaaaaacuguacugcugugaauagagcuuuaagaacaauucuagugaggacuuggaagaggagagcuguagagaaagucugaaucuucuuaagaguuuauuuaauuuguugugaccagaauacucauaaaaauacggagagaaaaggacauucuggugaggucucagacagaaaugaguaauaggguauuggaaacuggauugaaagccauccuugcuguaaaguaacaaacacccuggcugaauuguggccauauucuaggacuuuguagaauucagaacuuaggggcaaugaacuagaauaucugguugaagaaauuucuaaacagcagagcauucaggcuucugccuggcuacuuuuaccuguacauaacauaauaagaugugagaaaaauaaacgacuuaaagauagauuuuauauuaaagacagaagcagacaaaaaaucugaaaaacuuacaggguggcuauguaaagagugaaaaccuauguucagggacaggcaugguggcucacaccuguaauccuagcacuuugggaggcugaggcaggcagaucaugaggucaggagaucaagaacggccuggccaacaugaugaaaccccgucucuacuaaaaauacaaaaaauuagccaggugugguggcauguggcuguagucccagcuacucaggaggcuggggcuggagaaucacuugaacccgggaggcagaggcuguagugagcugagauugcaccacugcacuccagccugugcgagacugucaaaaaaaauuauauauauauaauauucaggagagaauaucaagggugcagucaaguacuauuugcuaaagauauuaacauggcuacaaaggagcgaugugcuauuuaucaggacaauaggagaaagauuuaaaaggaauuucaaaagucuuugaagcugcugcugcccucacagucucucggaaggcaaaaugauuucaggggauaugcccaaggcacucaucaugggcucccuguccagggccaccuagcaacucuucuccccuuauuccaguguaacauucuucaccugcccuaguuguggcucaaguggacccagguaaagcuugggcugucauucugcagagugcaaguaguaagcugugguaucaucaauaugguguuacaccuucaggcauacaguguaagaacucuggcuauggauuccuccacuaaaguuuccaaggaugucacaaagagcaugaagacucaggcagagacuugucuccagggucaaaccaccacagagagcccguacuaagacaauguugaguaaaaauguggguuuggacuugccacaaagaguuuccacuagggcaaugacuacuggagcuauggaagugggaccaucccuaagaccacagaacuguaggacuaaaacagcaugugacucuaaccugugaaagcugcagaagcuggguccagcaaagcccugggagcaggguugccugaggccuugcgggcccaaucccugucucagcguauccagaaaugaggacaugguguaaaaggauauuguuucucggcuuuaugacuuaauauuauuuuucguguuggguuuuagacuuacuuaggaccaguuauuguucuuuucuugccuauuucucuguuuuggaauagaaaugucuauccuaugacugucccaccauugcauuuuggaaguagauaaucaguuuugaauucauaguuucacagcuggcagaaauuugcgucaugaugaaucaugugagucucuuccauaucugauuuaaauaagacucugaaauguggacuuuugaguuaaugcugaaacaaguuaaaacuuuuggaacuauagggauagaaugaauauauuuuauaugugagcgggacgugaauauugggggucaaaggauggaauacuaugauuuuaguguccccuccuaaacucacauugaaacuuaauugcuauugcaaugguauuaaggauagggacauugaggugauuagaucaugaggaugccaccucguaaauagauuaaugcccauauaaugggaguggauuaguuauccaggaagucuuggcccccuuuuucgcucuaucuugugcagcugcucagcaugugaugcucuucugccaugagaugacccucuccagaugugggugccauggucuuggacuucccagccuugagaaucauaagccaaaaaacuuccauuuuuuauauauuucccaauuugugguaaucaguuagaacagcagaaaagggacugauacaaguaccaagagaaagauccaggcuauucucuauuuaaaauauuuauuuccucuacuucuaguuuuuguacaccuaguucacuucuaauauuaaaguuuuauauuuuacucugacuuuuuaagggcauuuauauuucaauugacuagcuauuuuucuuuggguuucaggaaagaaaggaaaauacaugcagaaagaaaaaggauggguaaaauacagaauauaaacuuccaaaugucugucuccuuuguguaaaggguauaggagaauuuguuuguuuuauuaaucauuucauuuuaaauccaagaggcgguacaagacaaauggaaaaugucaagaaggaugacaugacaaagagucuaauaaacugcagaaugcuuauaccacugagaggagcuaaacaacauaaacugccuucugggaauggaacagguagcuaagccaaacagauucacagcuggaauaagcaacacauggacagugaagaggaauaaugcaaucaguuaccccaaauaguucacaaaugcugcaacauauuaucuacuuaugaauccuauccuuaucaugagauaaauuaaaggccaucacauccagugucuuaccauguauauuaucuaacugaaaaagugcuaauuaagucuacuguuaauuuuuuuaguggauggcguguguuuuuuuaaaagccuuuuguauuuugcgacaggcaccaaaacaauuucaguaucucuaaugcuaaugacauagucaaguggguauaucucaaccacaauuuuuuuuacuugcuuaaaacucccuuauaaauaaauaaggaagccuccccuuuuuauauguugaugacucucucaccuuuuuucuuuuucaauauuuaauuuccccauuacacuguuuugugcuuagaauuuguagaaauauuaaagaggaaacccuuuuucuaaaauaugucaaauaauuauuuaccauauccuuuuuacaugaaaauuaagaaguuaccuucuugauggucuccaacauggagcgcccacccugccagggcuuugaguucuuucugauacaugacagacuugccaugcugugccacuuucgguccuccagcuucuuaugaaaagcauuagcaagcagaagcaccgugucauauauguaaagguuggaaaucugaaaagacauuagaaagugaucauuagaaucauugacaccagucaucaggaauaaggaaaaaaaauaauugucucaacugcuucuguucaugucauacauggcugguuuacuggguuauuaagcagaagguuucuuuugucauuuccugggcaauuuugucauugagaaugaagucuugucugauuguaugccucaauugcuuuuucagcuuauuuaggugugaaagagaagauuaaaaaaggaaagaaagaaauuucgacagagauaaggcuguuaguguuagaccuuagaaaaucauuggcccuuauuucucucugaggagguaagaaucuaaggguuuaagauuggaagggcaaacugaauaauacauuuucugaauauguuaaguuuuugcauucuaguuauucagauggaaaaauaucaacuugauuucauauaugaaugucauagguaccuaaaaaagaaguagucuacuguguguauuuuuguguauauggagauucuuaaaugaaauaaugaaagaacacaaucuuuuauauguauuauagugaucaaggaucuauacaaaauuauacagguauacacaugcauuacaauucauugauuucacaaauaccauaaacuauuaacuguuugugaauguguguuuacauuaauacuuucuucuucugaaacaaccauguuauuaacuucuuucuacauagauugaaaaauaaauuauagccaauuuuuugcuaagguuuuacuguauucuuacaauuaaguuucaccagaacuacuauuuauacugucaauuaaucaccaaaggugcuuauuuuucaaagaaguuaaaaauuuuuuggaaaacauaauaccaaaaggaauccuaggucaauaaaagcugcuucauguuauauuuccucugaaggaaaaacucuauauaaaauaaaaaaaaugaggaaucaauguagugaugaaaauuaauuccaucuuaaagcauuuguguuuuucagauuuuugaaaguauauuguuaucacgguuuuuccuaaaaacauacaggagacuauauggauuguccucggguuauaauuaaucauggaggaaauuuuuaaaauagucuacccacaucacaggaugguacuaagcuuuggcuauugagauaauuagagucugaugcaaugcacagcuuuuaauaagaacuuccuaacagugccuugugaguuuucuuuuacauaccauguaaaucuucaauccuuuguguuuguuaaauaucauuuuauauguauaauacuuguaggccuuuuuugaagagacauugaacacucaaugcauuacgugcaauacaaguuuguccuucauaaggaaguauuaggacuggcuauuuucacucccuaucccagccacuccccauuuugccugauaauuacuagauagacuacaaaagaauggcugaagucugcuauacagcuaaaacuaguccaugaaucaacauucagguuggaauuaggcaguaaagacccaacaggaaaauauagaaguuacaugaaggauacaugcccagggaaaucaaaauaauacacaaccuucuggccuuuccuaaccccuccugguucuacugccugaaacuugcuuccuuuuacuuuucuagcuuuauuuuacucuucccuuuggugaacguguauuuaagauuguugggguaucauugauggacauuuggguugguuccaagucuuugcuauugugaguagugccgcaauaaacauacgugugcaugugucuuuagaaaauguggcacauauacaccauggaauauuauguagccauaaaaaaugaugaguucauguccuuuuuagggacauggaugaagcuggaaaccaucauucucagcaaacuaucacaaggacaaaaaaccaaacaccgcauguucucacucauaggugggaauugaacaaugagaacaccuggacacaggauggggaacaucacacaccggggccuguugugggguugggggaggggugagggauagcauuagaagauauaccuaauguaaaugacaaguuaaugggugcagcacaccaacauggcacauguuuacguauguaacaaaccugcacauugugcacauguacccuagaacugaaaguauaauaaaaauauauauauauauauauuuaaaaaaaagauuguugggguagcaucccucacuaucuccuuaccuuucuccaacuaguuaacauuucucaauauuugguucaaagcuuacaugcuaggagaauccuacccugccaacuucugauuuucuuuccuuauccuacacaagguugagcaccucuuuucaucuaccggaacacacagugcauacgucuuugaaacauaucagaauacuaaauucuuuuuuaaaucuaccuuuuccacaaaaaaauaaauuccuccuggauggggacucauacuguacaucuuuucucuuccauuuuuccccguaauuuauuucucuaagacuuagccuagagccucgcacauauuuggguuuugauaaacaguugugaaguaaaagaagacgaaggauggagagaggagaaaaaaagaaagucaauuuuaaagcuagguguguuuggcagacguugagacacgaaaaaucugguaaccuggguucuauccaaaccugacacugcuggggcacauucucuuuugcagaccgugaggcauguauuuugagcaucuaugcuagucuuaaaggugagugcuucguaccuguuacaugacaggcauuuucaauaaaugacuacgucuccucauuuguccacauuccaaacugcaggaucaagaaguggugguaauauucccugagcuuuucauuaccccuccuaaucugacacuuuuucuuuugcaggcaagugcccauucuuugagcuucacacucuuuccuaugcuacacuuuauugcuuuuuucugucaucauuaacugaucuuuugguaauuuuauuuuauuuguaaggccuuugacuccuccuucacaauaauaccaaacuaucucucaucauuuuaaaaggucacuucaauuucuguacagaugaucuucacuucuacuuaggccucaaccaacacaaaugaccauuuacuggacagaaacauacaucaccucuaaaaucauagacuccaguaugucacauaugaccaaucauuucucccuaccuuacuggcacuacacuuauucuuugacaucaccaaaucuccacacucaccuccucuacaugacaagcuuucaauauuugacaccaucuguggcuugcuuugagauaucuuucuuuuaguuuucaucaccugguaucguuucuaggcugaucaucuuaguucucuuucucugucuuucucuuguguuucaauguuucuguuaaaaauuuaguauccagaauugacacauuauuacagaugugaucugacuaggagagaauaguguaagacauuagaucucuuuaucuuagcaaaauucuucugacauagagaccacgauuauauuaaaauaguuacagcaaauaugauuugugugauacacacacugaauuuaccuucaacuuaagggaucugaacagcugucaaaccaggauucuucauguaauugauuuugaaccuauacuuuaucugugcuuuuucaaauuuaggcuuauuauucagucaacacuaacaauuuggaacuugauuaucuaauacaacauaagcuuucucuucuagcuuuaugccauuuacaaauuugauaggcauguuuuauucaucuucauucacguagugauagacguuuuaaaaauauuagguccaagaauagaaucuugugaaugaccauagacaguuccuugcauuucaggaauagaauguuuaucacugcaguuugaauauucaucugguucuacaauccucaaacucuggacaaaagaaacccuggugguagguuguggauaucaggaaguacucaaagccaccgaauacaucuaaggcauauucuagucauaucaauauugcuugaagauuugauugauuuauuuagauaucaauuuuguuugaauauuuggagaaaaacaacuaguuuaauuggcaaauaauuugaaguauuacuuuuaauuguauauacacaaauguuauaacuuuuaaagguaauaaugagacuuaaauauuuuugagcuuuauuuugcuuucugucugaggccagaguguucacuaucuucugccuuuaggaacccuuuggugaaaauguuucagugucaucacucugucaagacuuuucaauaucuuuccuaaggauuucagguaaaaauuugucaaacaccacauaaaaaucaacauguaacacauagauuuaugacauucucccaaucuaaaaaaauauauauauauauaaauaaaggcuuaguuuggcaguguuuguuuuuaaggaagcccuguugucuuaucugagguacuccaaaccauugauuuaauaauauauucuacaguuuaucuacauaguaacauuuaauaugcuaaacuccaugagaaucuuuuuuccuuccuuucaguaauugggacaauacaccaaucucuuguaccuugguccucuuccuaaguguuucuccaguauuucugagcuaucauauuuugaucguuccugcuggcugauuggcuacucugagcaauuauuuggcaagccuaauucaaagcagugccccuacucuugcuaucucccugcuccuucugaaccaguggaauauuuucuuuuaaugaauuuuacucuaaccuucccaauuugaagacaauuuuucuuagauggagaaaggagcaaaaguauuagaauguuucuguuuucucuccauuagcagccaaacuaacauuaguuccacuaagcaguaaauggaucacuuccugcuuguuacauauguugcaaaaacaccauuuucuagcuaaaagguguucuuuaauauuuauuuugcaacuuaagcuaauccuggguuucagucuuuggacacuaauuaaaaaauuugugaaaugcauuuucuguuuuuucuaaauuuuacuucucugucuauguauauuaaaauagguaacagucuagagaucaaauucuaucauacauaagagggauguucacauguaacaaauccucaacgcaaaaguaguuuucuuguuuucuuccaucuguggguuugacaggaccaagaugaagguaugagucaggaggaaguuggugcuuccccauacuuuauuguuucagguaagauuaggaauauagacauaaauaaaauauuuguucacagauauugaaguccucaucaacugaaauggaaagauuauguuguuaggcaaauaugcuguaaaauaauuucugcugucccuaaaugacacagucaauaauuuuucuuaaguuuguauuucauuuccugauacuucuuuuaacaaacacaacuuuuaauauuuuauaauuuucuaaaucaaaauucuuuccuuuuuuucuauuuagaauucuaucauuuucacaucaauuauauccaugaccaguuaaaaugcaaacaugggacauuauaagcauauugauaugguuuggcugugucccaauccaaaucucaucuugaauuguaguucccauaauucccauguaucauaagagggaccuggugggaggucaucaaaugauggggaugauuauccguuugcuauucucaugauaguagugaguuuucacaagaucugaugguuuuauaagcggcuuuuccaccuuuugcucagcacuugucuuaccugcugcgaugugaggaaggacauguuugcuuccccuuucaccaugaauguaaguuuccugaggcuucccugcccugaggaacugugaguaaauuaaaccucuucccuguacuuuauggcagugugagaaugaacuaauacacauauagauaaggguggaacugaaauuuaaagagauguuguuaaggcuucagaagauuuacuuugacuauugccuucuccuuaauuacauucaaacauauauauucacacagauccaaagcacugugguaauuaugauggaggaaaugguagagaagcacguuaugaguacuuaugaugcuggguucuugaagggacauaucuauuuauuuugaaauagggacucacuuugaaacccaggcuggaggcuggagugcaguagcacaaucuuggcucacugcagccucgaccucuagggcucaggugauucucccaccucagccuccugaguagcugggacuacaggaggauaccaccacaccuggcuaauuauuauuauuauuuuuuucagagaugggguuuugccaugcugcccaggcuggucucaaacuucuggguucaagugauucucccccuugaccucccagauugcugggauuguagguguagccacugcaccuggccauggaaaggaccuauucuaaaggagcuuaaaaucuaguaggcaacagaaaguuacaggguaaugauccuggagccaguccacguacuacagugauaguaauuagaagaaaugguuggauaaauggcaaauccuuuuuuaaaaauucaaaggugacuaaggauagggagguugugggguuauuuuucagauuaguuuugcaaaagcaccuuauuuaucuaguauuauuagagaggaacuaguuuuccuaggguuauauuuccaaacuguuaaaacugaaaaucucuaaguacuaaaauguuuccuaugguaaauauuuuaaagaacaaguuucuaaaauauauuagguuuugcuuacuucuaagauuggccaugacuuuaauauuugcuaauaucucaggguuauuguuuaaauauuaacuuauaugcuagcauuauacugcagugauaccuuuaggaguuguuuuauggcacagauuuguuuuugcaggaagaguccuauacugacagguuauaugaguuaguuuaucugauugauuuuuuucccgucucuugcuuaagagggcuccuuaaggcucccugcuguuguccugugugccugcuuuguguaacacccccuucagauugacauauugagaucuccagagcaaagugaaaaaaaaaccacagaggcuuuuucuuaagaaaaagaaauaggcuucaaguaaguauuuaaagggcauucuuaugaguaagcuacagggacuugguguucucuguuucgcuguucagagguuuuauuuauaucuuucaaauucuuuguuguauucuggaugcugaagguuucagcuauauccucucggaguuggauaugaccauacaauucuacagcacuuuuuucauaucuaauuuuuuuuguuggaguuauucaaacuggagaccaaucuuuuuaaaaagaauaaauaucuauguccuucuuaggccagaaaagucaagcacauuuauuaguuuaauaauuuagaguuuggaaaaaggaguaccaauuacaaauucuccugugggaaauguuauggaccuacuuguuuagaagaaaauaaccuuuacuuauuauauuuuuuuauuaagcaaguagaaauuuuucuauaaugagaucaaaaagaacaaagacgcaaauucuuagcacuuucuccccauuagacuuaugaaauugcuggaggagaauuguucagaaauaacacguauaauucugaauccaaugcaacucauaaagcucuccuugcaauugcccaacaaagcacccuggaagaaauauccugucauuuauaauauaccuccauauucugagcaaauggauccuuuggaucacacaauguugaagauauucgaugguugccacggaaacaccgcugacuuauguucuggggaacuggaaaugucugccgaauaaucguuaaccuuccaauugaccuucuuacaaguuccuguacguccacaucguuuauuuccuauaagauaagagguggaagaauuagagauacuuuaauacagucacaaaacacaaaccuauuaugaguuguuaucuguaaauguuagggauucuguuacuguaauauauugguuuuaaugcuuagugcauaucuaaaugaaagcaacauauuuuuguuaaaauuaucaacucauuuguaguugcuuucuaugcuuuaaauuauauacauuagugccuaaacaaugcuaaauggagcaauugucuuacauaugguuauuaacaauaaguuuauaauuuauaauguugaacauuguagaaacauagguguggucaaaacauuuaaaaaggucacaaaguaaguugcuauuauaguuuauuauuaauuaauacuauuacuuugaguaucuaggaagguaauugccauguaagaguuauacacacgcacauacgcaugcauacauacgcacacauacacacacacacaugcacacacacacauaauuagcaaugaaaaauuuggcuuuuaacugaggcaaguagagcaagaggauauauaaguuuuucuaauaauuuauuagaauuguugauguuaacucguauguuucucuugguaaggaauagaugaaaaauucuguuguuuaauacaaucugaaucaggaugagaugagagagaaacccagugcucuuuaucuaaauuaauuuuaucuaaacaaauuuuaucuauucuaaauggaauuaggauaaaagugauuaaaauaaauuuuaguuuuaagguagucuuuacuagagaaguuggugcuuaauaguguucauuuggaaccuuuacaacgaaugaagucuuuguaauuaacauacuauugguuucaaucaauuuuuacggcaacagaaauaaaagaugggaaacaaaauaaguuuuggguugcagugagcauuucugagguuugaucuaagaaauuauuacaaaaaaaaugaaagaaaacagauaauucauagguguaaauguucuuuuuuucuuaccagauuaauuacauauuauucuuguagcauauguuagauucaaaaaucguccuuuauauaugaucuuuaugaaguguagauuuuucugaaaauaaaaugaugccucccaucagcuagcucuaguguaauagccuggauuucugggcauuuaaucaauccuuaauguuccauaaaaaugguuuuucucaguuuaaaaugccgucuuuuuccuuuagucugugucauuucacuggccaccaaaaacuuugucugucaaagagcaggucacuuuuaaauucuauguaaucuacucacaaaguaggauuaaacgguauccugucaacuccauuugaaguccugauuuuaaccagacaucuuuuaaaguuaauuaauauuaauauugcuauucaaugucuuccaauuuuuuaaauuccaaaugauacagacaggaacuuucauuugaaggcaguggaaaauuguaugacuuuucucauaacauuaacuaaguuguuuuauguauaugguauuuuuuuuugcuuuagcaauacuaagauuuaucaacauuuuaucaaacagcagcaucucuaucuacaccacucauaaugaacuacaaaucagcauauuggauaaaaauucacauuuaauaaguaucuacuauauguuaagcaaaauacuaauuacuuuauuaucucauuuucugcuaacagaugauacucugaaucagaugcuauuuauucucaguuuauaaacaaagauucaggaagacuugaagcucuucauucauaauacucuacucauaggaugaauuuauaaaugucaucaaaagaaacagucucugaagaaguuauacaugcccauauuuccuuacaggaauuauuuagauuaauauuuaugaaugguagaaauuaaaacuguaaagauacauuauuucagcauuuaauuuccugaugauucuggaaggaaugauguagucaucuaucaugagccaaauccuuuaagaggacauuuuucaaacccacaaaaagggaaaaggggugguuaccuuuuauagguuuccaaagaugaaguucucaggcaccuaaacaacuaaaauauaucugaagaaaugucaguuugaauugaguguauuuugccuauuauuauuuggggaagggaagagaaaguaauuuucugggaagaaagaaucugucauucugaaagaaacuaacagacaaucugucucaaaaaauucacuugcaauuuuagucuugacaugugaucucaaaaacaguuuaacagugauaugaaaacuugauuaggcagcuauuuuauauuuacggaacuuuacuugcgcauuucaaaaggggcauuucgagaguggcagaugcaaaguuauauaaacacugaaagacaagugaucauuuaaucuauaaagagauccauuuaaauggaaaaaaguccagaaauaaacuuguguauuaaaauguuauacaauguacuaggaucuauauuauccuaaugcucugaauuuuuuaaaaaauguuuaaacugucagauuuuuuaaaauaaucaugugaagaacuaguuuaccaauaaagcacucacucucccaagcccccagcaccauuaaauaucuuaaucuuuuaaaagauauagaguauuccugagcucuaaguaauuuaaagaacccaaauuauaaaauuauuuuccuucuuauauucuuuauuuuauugaguauauucauaaaaguagaauuaacauugcaauaacaaaugauuaaguauuuuuuagcgacuuaacuuuucuauuuuacuuauuuaggcuaaggaagccuuuuuucccaaaaauaauuuaccuagauacuugaaaacuacuaagaaucaaagucaauauguccgacaaaauauucuuauucacuuugcuuuaauaauuuaaugucgguugaauccugaacugugaaagccccgaggaagaaaaaaggaaugcuaaaauaucuucuggggauacaacuccaucuagaaacagccauuucccagaagaaaucucuuaggagaauugaaucauuucugaauccuuguaguauaucagcuuuagguugaaaugaauaagauugugggaagaaaagacucucaaaauccauuggaucagaugccaauuuagacuaaaaauaacaauuucagaggaauaguuuccuuuuucccauucuuauaccucuuagcaucuaacaaauauuuuggcuuauaguagguauucaauaaauguugauaaauacaaaauuuauuuaaugaaugaaugguaagauuuuaucaucuucuaaagacuuauaccugaaauuuuaauucuagacaccagaauacuuuaaaauguuaaacaauucuaaauaaagaagauuuuaguauuaagauuaagcccucuacuaugugguguuuguuucuuauuuguuuguauuuuucauauuuuagcaaagaugacccuuugaugcuuccauaaaauuuaacauuaauaugaaucaauuaggcaaauguuaaaaaauggaacaaauccaacuguaggcuauguaccaacaggaagagaagcaggauggcaacuuucuacuugaaagcuuagaagugagcaguucaauucaucauuaaacuagaaaaaauuaaaaacauccauuacacauauaggcuuuuuaaaucucaaaacaacaacaaaaccccccaaacuggccaggcacgguggcucacgccuguaaacccaacacuuugggaggcugaguugggcagaucaccugaggucaggaguucgagaccagccuggccaacauggugaaaccccauuucuacuaaaaauacaaaaauuagccaggcgugguggcacaucccuguaaucccagcuacuugggagacugaggcaggacaaucgcuugaacccaggaggaagagguugcagugagccaagaucgcgccauuguacuccagucugggugacaagaguaaaacucugucaaaaaagaaaaaaaaaacaacaaaaaaccaaaccaacaacuuucucauuaaauguaauacucagcagugauuaacagagaauaaugucuuacacuauucaaauuaaguaaaaagccaguaaagucaaucaagacaacaaaggucauauuugauauuaucaggcaauagaaggguauaugaagcauugugcuucuugcagcucugaacagugcacgucuuccuaucugaauuucuaacuuuuguaaaacuuaaauaaaguguuaagccaucugcuucagggcccugaagggaugacaauacuugcacggaaaggcugcucugagcuggauccacugauugcggggagaagauaaauacuauuaccaaguacuaacauaugauugauuacaccauaugagcuagcacagccucucauuauuauagcacacuuaaugcaaaugaaaaaaauauauuguuuucaaguuucuacauuaauuucuaucaugaugcacaaugccaacuuugauuuauauucccuccuuuaaaaacuauugaugcaauaagauuaaaucaaugucugcaacccauuuuaaaauuagcaacaaaauaauagcuacacaaacaaaacuagacagauucauguucuccacguucagccaaaacgggcauuugcaucuuuugaggguuuuuuuuauuauuacauuuagaguuuaguagcuuccuagcaauauugagaaauccauguuuuuuuuuucuuuuauagaaacuagggaaaauuauaauucauccauuauaaauucccauaaacaagcauguaaaugaaaagugugcaagaaaaauguaagucauuuucugaggcauauuucagaauaaaguggaugaaugagaauaaguaugcgggugaauggaauaauuugaaaguaagaguguugauuuuggauauaccagccaauaaugguuuuuguuuauuuuuuuauggguuaaaauacagaaaacauuugcucauuaucugaguuuuaaccuuguucagauaaaagugcuaaccuguguaauguaaaugguauggguugugaacauuguauuuuuaagaggcuaggcaguguggcuugcccaaaagaaauuauaccucugcuggaagacaagaaaguagggcuguggguaagaaagagauaacgguuucaaugauggugauggugaaguuuuauuagacaauucacaguagaaaaccuaaguuugaaggauaagaaaauaauugaggucuccuuaauuaucuccuagacuucuaacauguauugaguuauuuaccagugagauugcuuuguuuauauggauguuuuauuuugcaaaauaguggcccaaauuauggagcauccacuuaaugacaauauuuucauuuguaauauuuuaugaaauaaaauuuaauaaguuuaaaaacaugaaucauaaugcuuaugaaaaauacaauaaaacauaaauuuuuauuauuuuuuccauacuauuuauuaccaaugaaauacaugcuagucuauucaggcuacaccuauacaauaugaagaugccauuucuuccaaaguacaaauugagucuuaaacaguggguaaaugaccauguuguucucagaagcucuauuucaguuuauacuuuuaaguucagguauacuuguggaagcuaaauuggauauuaaaaaaaauuaauuaagggguuccuucugcaaucuuaucaaccaauacaggagaauggccauuucaauuuagugauuguaagcauuaauuuguccagauuaauccauuucucuaaagagguaagaagucacuuuauuuuucuaguaagguugauugacaugaauagguaaaaugacucucgcugguuuugcaucaggaaaucuguguagucuauauccuguccaaaguaggaugugaaauaaaaacaaaaaauuagaagaauccuuauuucaaaaaaaguaaucuagaaaauaauuaauacaaaaaagcuagugacauaaauagcucccaucagauuauaacugaggcaguagaaauuucaaaaauauaaaccauaaagauaauuaucaaaaaauauuuauuuauuaccaauuaaauacaugcuagucuauucagguuacaccuauauaauaugaagaggcuauuucucccaaaguacaaauugagccuuaaacagugggugaucauguuguucucauggucaaaaacaaaauucuaagugaaaauguaucaaaaagcauguaucaaaaaacaaaauccuaagggaaaagaacaaagcuggagacaucaugcuaccugacuucaaacuauacuacagugcuacacuaaccaaaacagcaugauacugguacaaaaacagacacauagaugaaugcagcagaacagauugcccagauauaaggcugcauaccugcaacuaccugaucuuugagaaagcugacaacaauaagcaauggggaaaggacgcuuuccuuuaauaauaaaugauugcugggauaacuggcaagccauaugcagaagauugaaacuggaccauuuuauuauaccauauacaaaaauuaacacaagauggauuaaaaccuuaaauguaaaacccauaacuauaaaaacccuggaaaacaaccuagacauauaaaugggcaaauauuucaugacaaagaugacaaaagcaauugcaacaaaagcaaaaaucgacaaacaaaauugaauuaaacuaacgagcuuaugcacagcaaaagaaacuaucaucagagugaacaaccuacagaaugggagaaaauuuuugcaaacuaugcaucugucaaaggucuauuuauccuuaaguucuacaagaaacuuaagcaaauuuaaagcaaaaccaaacaaccccauuuaaaagugggcaaaggacaucaacagacacuuuucaaaauaauacaucauaugaucaauaaucauaugaaagaaagcucaacaucgcugaucauuagagaaauccaaaucaaaaccacuaugagauaccaucucacaccagucauaauggcuauuauuaaaaagucaaaaaauaacagaugcuggcaugguugugaagaaaaaggaauguuuauacauuguugguggugggaguguaaauuuguucaaucauuguggaaaagaguuuggugauuuccucagagaccuaaaagcagaacuaccauuucacccagcaaucccauuacuggguauauacccaaaugaauauaaauuguuuuaucauaaagacacaugcaugccuauguccauugcaucacuauucacaauaggaaugacauggaaucaacauaaauacccaccaacaguacacuggauaaagaaaauguggcacauauacauuguggaauacugugcaaucacaaaaaaggaaugauauguccuucgcagaaauaugaauggagcuggaagccauuuuccucagcgaacuaacgcagaaacagaaaaccaaauaccucauguucucacuuauaaaugggagcuaaaugaugaaaacauauggacacaaagaggggaacaacacacuucggggucuacugaagggaagagaguaggaagaagaaaaggaacaggaaaaauaacuaaugagcacuaggcuuaaugccugggugacaaaguaaucuguacaauaaacccccaugacacgaguuuaccuacauacaaacuugcucacguaccccugaacuuaaaagcuaaaaacaaaacaaaaacaaaacaaaaccaaccaaagcuuuacacugaaaaagauuaaguuuuaaauuccauuaucaucacuaauaguuguguaauauuugcugaauuguuuaauuucuuugaaacuuaguuuccuuggagaaaaauugaaaugaaaauauuuaauuugaagguuuauuaaguuccuuuuccuuugucuuucccucuaucccaacguuuaguuauuccacaugaaaauuaagacauacuagaaacuuagaagguaccagaacuuuauugaaaagcagaccuccagauacguauugccugaggaaaucucagaaaaaccuaucuuauuuugacaugagaaauacagcuaaaauucauagaaaccuaauguuuggcagaccaaaaacagacuuguaagguguuuucagcgucuuuacucugaaauaaaaaggaucauuccaucauugaaguguaguguaggagaaacaacuugaaacugggaauuauuuucacuuuucuguguaaaaagaggaaaauaauuuauucucuauggaccucauucccucaguacuucagagaauaugguuuaguauuccauaagauaauauauaagggaaugaucucugaauuuuaacgugauaugaucauuaucgcaguaccauucuugugugucauuugucaagcacuguguuaagagcaccugauaauaccucauuuaacuuuuauuaugaacaugcaaaguaauuguuauuauacuuguccaaaugaauaaacugaggcacaggaagcugauauccauguuaagacagcuaccaaguuuuauagccaggaucaaaccuaucuugcugacuauaaaaccaggauucuuauccaaaaauacuauuuugucccuaaaagaaaucuuauuauucuagaauucuguauuuaguauaaugaauaaguaaauauuacauuauuuuuauucauaaauaauagguaugaccaaguacuacaucuuguugaggaaaaauguaugugaucacauuauuuguccaugacugaccugcucauuguuccuuccauuucugacuggcagguccuaauggaacaacuuauuucccagggcuuuuagguuguaauauauuuuuaaucuuauguauuaucuuugcaaaaaucaaaagacuuucacaagaauuugacaagucuaaagauuugaaaacaguuguacuuccuuaugaaaagggaaaaaucuguucuguguuuauucauauucauaugcugaacuuuuuaauacucauguaaggaggguggacauaacaguucuagaaacaacauuaaaauauaaauggaacacaagcacuccacugggaggaguuuacuuugcuuacaaaguagaacuguacuuuuuauaaagaugaucuccuugagcaggcagaaugagccaacagaaagagcuaaaagagacucagugagaaagacuuucuccauuuauuuuauuaauauaaaacccuuuaucauuuuuaaaaacucuucauucuaucuuuguuaaacagcauucacucaguaaguugaauguuuacuucaaguuuuguuuccgcuuaaaaauucaaggccauuggaaaugcuacaauuauauaugugaaaaaaggacacagaguuaacaauaagguuuaguuggcuuuaccucauuuauaaugauccagugacagucaaaagcaaccaaauuagucuccacaaccuagaauagaaaacaaaucagcuaucagucaaaauuaaucaugcaaaacaaacccaacuaaaugaauauacuuugcaaaugacaaaaaaugaaucguauguuagaaaggucuuuguuacucaauugaagauggaaaaauuauuagcaaaacacuguagaugcauuugcauuugacauacauauagaugcacuguagacuugcuaauuauauuugaaaacauaauucaucaaaaccuagaaaaccauggguuucaacagaaaaaaauacauaaauaaaauacacuguuuugugauuuaacugagaguggagaguggaguuaaaauuucaaaucacauucccuacucgaaauaaacuuugaugucuuuuuaucaucuaccuaauaaauaucaaaguacauagcuucuacaaucuggcucuaacuuaauauucuuaucugcugcuacuucucuguguauaugcuuucuacuguuuugacuaaguaaacugcucuguauucuccugaaaauguuuguaacguguauucuaaggugaucuauucuaaaauuaucugaaaguuaaauaccaaaagugauaggcaacauacuagcauuaaagcauggguaggaaauuuuaguagcuuuuagauugcuaauaagaugaaaagaaauaaaauauauuuaaaaggaagaauaaaaauauauggguagcacucuuuguuugacuaacuucagauacauuuauucuaaaugauucuuggcuuaggccaaagaaguaagccucagaugugugcaugcguguguguguguguguguguguguguguguguguguguaguaggggcaguuucuauaugaagguuucuacgcuaauaaaucuuaucauacauauucuaagacacguucuucugauuuaugcauggcaugggcauauaauaagugagacucuuuuguaagaggucauucuguuguuuuuagcaauaauacucagcgauuggguuucaaaugaagaugcuuucaaauaacuaucaaggaguuguuauagaaggugaauugcauuuuguuggcuauucuuuguucuaccgagaaacaccugcuaagaggugcauugcaucacaaaaaauaaaauuggaaauauauuugguaugugacucaauguuuuuucaaaguacguaauuaguugcagaaucuuuguuuuuuaacacuugguacaaguuucauacuauuccauuauacaucacauuguucccugugacuuuauugagguguagagauaguacaugaucagauaauugaggauauguuaucuacuucuaagcuuuauuauuauuaucauuuuuaauuuuauuuuauuauuauuauacuuuaaguuuuagguuacaugugcacaaugugcagguuuguuacauauguauacacaugccaugcuggugugaagugagcgaaggauaugaacagacacuucucaaaauaagacauuuaugcagccaaaaaacacgugaacaaaugcucaucaucacuggccaucagagaaaugcaaaucaaaaccacaaugagauaccaucucacagcaguuagaauggcgaucauuaaaaagucaggaaacaacaggugcuggagaggauguggagaaauaggaacacuuuuacacuguuggugggacugucaacuaguucaaccauuguggaagucaguguggcgauuccuuaggggucuagaacuagaaauaccauuugacccagccaucccauuacuggguauauacccaaaggauuauaaaucaugcugcuauaaagacacaugcacacguauguuuaucgcggcacuauucacaauagcaaagacuuggaaccaaccuaaaugucuaacaacgauagacuggauuaagcaaauguggcacauauacaccauggaauacuaugcagcuauaaaaaaugaagaguucauguccuuuguagggacauggaugaaacuggaaaccaucauucucagcaaacuaucgcaaggacaaaaaaccaaacaccacauguucuuacucauaggugggaauuaaacaaugagaacacauggacacgggaaggggaccaucacacuccagggacuauuauuaucauuuuugaaauauauguauacuccacuuauaggugaaacuuaauaauuaaaacauaaccuauggcaguuuucaguuuuagcuaaaaaaaaauaaaaaaaaaacacuuuauaccaguaaugguaauccuuauuucaaauuuucugauuguuuuacuuuaaacaucuaagagacaaauaaugaaaaauuuauuaacaauaaaaaguaacagaaaauacgugagacuccauuagauuaaaaagacuucaaacuagaaacuaagauauaaggaaaguggguuucuggguaaaauaaagagaaauauguuguacaaggggguaaaccacuacuaaaauauguaaauagaauucagagaaaaagaagugaauaccaauagauaggcagcauggauguaaaauacuucugaagcaauaguaguacagugauucuauuuagcuuaaguuauccucauuugaagcuaaauaauaaucuucgcuauguaaucagauaaggcaaaauuuaaacuauaagcacucugcaucaccuguagaaauuacuaaaugagaaguuguuuugugcaacagcauuuauggacuaaguagaagguaagaguuaugaugauaacuuguugguaacuuaucuagaccaugagauuuacccauggcucuucaucuuaaaguauguuaggcaaaagcaagaaauaauauugaggcacaaauccuguauuucagugaagaagaaagacaaacauguugucuaaagccaugauucuacucacuguacuauccucuguugcuuagggucagcaaggagauagucucuccuucuggucuuugguuuuauucaugaguauuaacaucuaagauauuuuagcaguauaaauuuguuacaagcaaacauuagcacauuacuacagauaaauaaauaaaucaucuaucuucauguucuaaauugagugcucuucaccauaggcaaguacuaaguaucugugaaccuucaguaugaguccuguaugucuuaaugugcauuuuuaagaaagagucuaucugaaucucuuuuggguccucaaguuaacaggucuccuacgaguucuauuggaccaacuauucuaaaaucauuaguccucaaacuuagucuccaauuuagguuacuaaaugaauuuaaaaaauacccugcccuacaaacaagugaguggauacaaaguuuaucagaaaaacuagacuauauuaauagcauaaucauuuaaagucaccucaauuuuuaagcaaagucaaggguucaugugguagaaacugcuagaugaucaucaaaauccauucucuccuucugcugggacacucagcuagacuacauuucccauccuccacugcaggguauuacaaggccaugugacugaguucuaagccaauagaaugugagccgagugauguacgccacuuucaaaccugacucauaaaaccucccaugugcuugugucugcucucuguccauuccagcuuaguaggauugugacgucacgccuagagaccuuggaagccacaguagcuccagugcauggagcagacuccccuuuccuacucuaugcuguagugcugagcugacaugaaacaaaucuuuaguaguagaauauuacauuuugggucuacuuguuagacuaauuuagcccaucuuaucuuuaaugcaaagcauuuuuauuaacuucagcuaugcacuuuuucuaaucuuaauaaauuuuaauaaacauacucacuagaguaacuuuuaauucugugauuuuauaauggcaugauuucaaaauuaugcaauauuucuuggccuuuucaaaaauauugaauauuuagaaucuuuuuuacaaacacauuuuuaucuggagaagaaaaacgaauuauacuagaaugguccuuaagaauaaaaaaacagauaugucuugucuuuuuaauuauauaucaauguauauguaauauacacaacuaaaauccauguauuauugugacaucauguguuaaagaagcuugaaauuuuuuguaauguucuacacagaaaguuaauucuuccauuuauuaucugagaaaauauucacuaaacaaggguuauaauuucccuaggucuagguuaacaucuucaugcauaaccagugggcuggcaugaguucucugagauuuuguaaucaaauguuaccaaaauaaagcaauguuaaaaagccacugaauaaaaagguaacugauaucaguaaugguaggagcauuuaguaaggggaauaaaaagauaaaauggaauucaauagccuagaccuuggaaauccaguaagcuuugaguucucucacuuaaaugaguaguguauuauacacacacauacacacacacacaaaaaagaauguauaguaguaugauauauauauauucagugaaacauauaugcacuuauaugcauaucacuucaaagugguuaaaacuccaguagaaguagaauuaaaggaaauaaaggagaaaaagcagugauaauauuguuuaugcuucucauguauuaucaaauugagcuaauauggagugagcacuuacaaaaaaauaauuuaccuaaaaagaauuucugagcucuuuguguagauaacagaagacaacuauuauaaaucccaaaucaauucaccugauuguuuuuauaguuuuaaauaauguugaucucuuuccacuugguaacacuugcagcuauauaaugcucuaucacacuaguggcauuacuaacuugagggcuaaauuacuucuggauuuuagaaguuauuugaagacaagcuagaauuuuuaaagccuuuauauuuacugccacaggaaauuguuuucuuuucccacauuccuuaucuauuuagcauaucuucuaaucuccuauuuuagcagugaacguauuugaaaucaaugaaaggaauuaagaaauuugauugcaauuuuccuuuuuucauuuggaaccuguuuaauaucuaggcacaucauuauuauaguuguuugggcucauugugugaauucuuagaaauauuuuacaagcucauaaacacuagugcuguuuaaacaaaaauuucaaaaaguuuucgauuauuauaaaauauugaagguauuaaaauaauauugauuuuaaaaaaccacuauccaaugaggacucuauuuaauaauaugcuugguuaucaaaauaacaggaaagauugagguauggcuuucccuugguaaugaauuuccucucuuccucuuauccuauaauucucuuuugucauuauacaugugcacauuaauaaucuaaaaagagcaugacauguucauauagaguugaugccacuuugaaauauagcaauguaauuauaacaaauuaaacuaucccaccucccaagaagcugagcuuacuauaagggaauugagcaaaaaaggaaaaaaaaaaaucaaguccugucaggaagacaagcaaugaguaaggacagaccaucugucacuggcaggaacuuuagaacuucugaaucuuuggaaaagcucgacaauuuaucacugugucuuccaucauucauucucaaaucuuuagaugugcuaaauauaacacaacccaaugcaaggaaaucaacaacccugcccgagcuuguuucucacuaguaauaaauguggaacaguuccuacaagugcaggggacgauuuaauugacuaaacaauaacagcaacaugcuguuuaucacucaaccuuguggcuuaacuaaauuaagcuuguuccuuuugcaggauguacuaaauauuacacauuuacgcagagaguuccagugcucugugcaccuguagcagcaaagauaucagguguuugcuucccuauuucuagcccuuccaaaucaucagguggagaucagcaaggggcaugcauaggcagaggacaccagcagauacgcuggaacaaguggcuagagaaacacuaaagagcuacucccuuucuggcuucucaucuauagcaauauuauagcuuacuuauaucagcauuuuuggaacuauauucuguaggacacuaguuccacuaaaaguaaugaguuuucuguagcuaaguagauuuagaaauauugggcuaagcaaaguuaaacagaugcuauuaccacauuauuccucaaagcuuuaaacagguuaacaugaauauagaaauauaauuaacauaaaaaucauauuaauauauacuauuucacugauugauauuauggaacauauagcuuugugcuugugagugcaaucucuaaagucagauuuaguaccuuuauuuucugagugugacuuugaacaaauuauaaaccuguuuccuuuuuugucaguaagaauaaugauagugcccacacaauagaaucagaaugaacauuaaaugagauaaugguauaugguaaacugucaguaaauaucagcuccucacauuucaguucaugugccuuauugaucucuaggagaagauauuuggauuauagaauauuucagauggauuugaccacagaaaccauuuuuuuccacugcaagucucaugggauuaguacgguuuggaacauguagacuauaaucaauguuaauuuagccacacauuucuaaagguucuaaaauuuuacugaaauaccagaaggaauuuugucauuuuaaauugcaaucccacaauaaaccuacagagagcacgacagaggaaaauauuuccacaaaacaaaaacaaaagaugacuuacuguauuuuauaugacacaaauguauauguaauguuuuuuuguuuguuuguuuguuuguuuguuuugagacggagucucgcucugucgcccaggcuggagugcaguggcgcgaucucggcucacugcaagcuccaccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcacccggccuauguaauguuuuugaccaaauggugauacuugugcuucuuuccuuuuaauuauuuuuaucccuauuuaaaaacaaaauagacaaaauaaaaccacaauguucucuccaacaaaagggaguauguaguauacaaaguuuauaguguauaauauauuuuuagcaagggcuuuguggauuuacaguucaaacuauauccaguugccugaguguugcauauggccaaagugcacuacuauagaguucugcuaaaacuaaacaaacaaacaccaaccaaaaaaaugcaauuauuauaaauacuaugucugaaacacaguggccauacgaaacuccaaccuucucaagguacaggaaacauguacaugaccugaguuuuguuuucuucacuuguuuucuuuagcugguuauuguugcuguuuuucucauuaaagaacugaagccaagacauagggagacuggaguauuauuuguuuagauaccauuuuuaaaucccaagaauauccagcagauggcauuaguaaucccucacgccaacacugggcagcauggggauauucugaaaggacugucuuguuugcauuuccccuugagcucagcauggauccucaacugucuucuguucuuuuccaagcagccacuaucugccauuccacucugcuuuuuugcuuuagaaucucugcucugaucuuccagcuggaagaccacaaauacacuuucauccaaauccucuugccauuacugccaaaguuauuucauaaacggauaugcuagauuuauuguuacugcugugcaguggggucuucccacacccugugggagaugaaaauaugccaccgcugagacuuagccaacacugugcuaccugcucugcuucuuaauguguaaugcaagagauagacugcauucaucauguggcauagaccaacuuuccuguguucuauauuauugaacaaagauugaacagugauuaaaagcaaauucaugauuucaguacuuuaccucaugagaauaaagauuuaaaaaucauugccagugucagaaaccacuguguuacugucuuuaauucucugugaguuucugcuggcauugggguuuuccugggcguuugcuguggugauuuaaggugcauuaugccaaaacauuaggaaaagcgguguuuguugaaggaccccucaucccuugccuauuuuaccauaugcuaauaugguaacuuuuggcaccaucaggaaauuacacuaaaauauuuauuuucuuguagcuauuauuuuuuaauagcuaaaugacccuuggcagaguaaauuaauucuuaaguaugacaggcaaacaaaugaauaugaguucuuaguuggauuuugaucaacgcuuaaaaugauuuggggguaaauuggcacuuaauugcuaggauuuaugaacuaaggcuuucuugcuaucuugaagccaauaaagaaaaaauaaaguuuuucaagucuauucaucacgucuaaaugcaauauaugagcucuccacagcuguggacuuucaugcuuugcuuuguuccuuuugaccucuucucaguuucucuguuugacaaaguguuucucauaacucaaauugugaacaaaaugucaaacccuucccauccuaccucucuaacuccaggcaguauuaucccaacccuuaugcuugccugacacucugagccaaccucuaucccagccuuaaugaaaucguagauaacuauguaaguggcugugagggccauguuguacguauuuuauauaaccccuuagucccucugguucagcuguaaucacuuuccugcugguccucuaguauaguucagccuuuguccuuauguugccuccuggauugcucuuccauuagagacacacacauagcucccuccuucauuucauuuaggucucugcaugugacuucaucaggcaugacuucuaugaucauccauuauugcucccccaugagucucuguuacuuuuguccuauucuuuagagcauuuaucccaccugagacaaauaaacacacacagagucacuuauuuaccaucucuuucugugcuguagaauaagcuucaugguaguaaggacuucauuuuggucacuggucuaucccuuuacagugagugacacauaguaggguuucaauaaaauggauugcuaggaaugggucagauuuuuuuuccuaaauguugcuugcggaaauaagagaaccauauagcccuaacucguccuuauacaucuguggauauccauaccucaccuaggacuaaacuauuugauaagcucauauaaaaaggaagucauuagaaaaaauuuuaauuaaaaaauuaaaucagaaaaugaaucaauuuacauuuucucaagugagaagaucuuaacuauuuauauaguaauuaaguauagaaauauuaaauucaaaaucugcaaagccaaauaccucaggacuuggagacuaucugauacuagaaaaauaaaaugaaaguugaguaaaugggcuugaauucaaaugcugggccuccuuaacuguaacaagguauguuacauacucugagucucagguuccugaugagcugaaugacauuuucuucauggaggcauagugaggacuaaauggcuaaauguaucuaaagcaucuggaacauuacauguguucaaaaaucacucaaguuacuguaauacuuuugacaguacucauaaauggucauguuugacaacauuuauucuguccaguaaaugcuuauugaaugcuauuuacaguaugucauuaauaauaauaguauaagcuaauauuuguugagugcuuacuauguaugacacuauguguuuuuauauacacacacacacguagauaauaacucauuuaauuaucacaacauccuuaucaugcaaacacuacaacuaugugcauuuuaaauaugaagaaacugaggaacaaaaaguuaaaguaacucacccaaaucauaaagcgaaacaggaguggaugcaagaguuaauaauuaguaaagauauguucuacaaaauuuucucauagcccucugcuucuaaguugcagaaccuguuauguaguuuucaaaauuagaauuacaguuaaacugaauguugcagaacauuuugugggauacacuagacuuuuauuuauuuauacuccacuguguuaacuuacgugcauccauuguauaacugauagagaaagagacuaaaccauagaagacuuugaacaauacaggugauuccaugacuauuugccuuaaagugguauaagaaaaugugcuuuuccuuuaguaagacuuacuuuucauauucuuuucagaaugagagaaauuugcuacacugguuaacugauuaaacauuucauguacacacacacauacagucacauacacauguauauuccugauguuuaaccagagaaguauuugcaccugacacuuaaccagagaaacaguuaucuguuacuguucuuucaucacaacgaaacuucccauugccaccagaggaggaaaacaaaaaagcuucuagaggagaaauuggacgacgauucuuagauacugugccaauaaagcaacauggcaauuaagcaucuaguuucuguaguuagacaguuaauuagucuacuacuguucuuacacuaaugaaagucuuuguguagcuugguaguauacuguuauaaguagcucaucguugaugaagcuacuauggaggcuaauuauuucucauuaaaaaacaguccuaguucaauauuucuguuauccuuggacuuuuccaguauuacauggggauuuugcuuucuagaauuuuaagaguggcauaaaauguugaugauucuacuaaaauuaaaagacuucacaggaaaacaaaaaucaaaagguuuuauuguuuuucugugcaaaauauccaaaagaaaaugcagggaaaugcaaaaggugaauuuccauguccgucuuccuaagcuacuuguguuuugucauucucaaaguaagcucaggagguauagucuuugaaauuuuuacugaaucagaacaggaccuuggagcuuucugggguuucuaaaauuucuuucauaguuucuuccauaaaaaggcagcuuuguggccuacuguaaaaaauguuuucaaaugguguugggcuugauagcauggaaacuuuccauaauuccaagcaauugacuucccugccugaguuauuucacuaggaugaaguauaaacuaccuuuucuuaccauugaaaaauuaccuuacgguguucgaacuguguuuaguaacaaaaagucaguugaaacugagguaccagaugccaacugcucaaacaaaaugucacuugcagagcagaauucuagaauucgacaaaggagcccauuugugaucacauaaagcaagaacauucgaagucaucugcuauauuuuagugaucauaaccuuucuuaaaaauuuuacauguaugcuuaucugucagcguuuaugauugcauacuuccuauaaaacaauuagaguuacucugaaugccauuuauaugucuuagaauucacuguucuaccuuuccuagaaauggaacacacaacugggugcuuugguguuauugcaaauucauggcuucuaaccccuaguuaaagcugacccucauucuuuuucuguauauagucaguucugcucuucuuccauucucaaggcagugacaauucaaccuuccaguguauugacaugucccaccucaagugcugugucucaucuucucugccugaugacguuguccagcuuauuuggccauacacaaauauaaccuggaauauggcauauguuagaaccacuggagaucaacucucaaacaguggagcuggaaguaaguacauaaauguuucagucucuccacucuccacugggugauucugagauauauuccacacaugcuuucucagaugguucuccacaggauugagaccuauuugcccacaguuguaacccuuucuuguuaacacaugcuugacuggcuuuucuccuuacccucucucauguucaccacuuccucacuugugcuuccugggaacaccuccuuaauaagccaucugcauucaacuccuugucucaguaucuguaccaguaacucaaacugagucagccuuccuauacaaauuacacaauuuguuacaugaggggaguaguccuauaguuaaaauaaagauacuuguaagaaguagaacauacguuccaacuauccuauacauaaaaaaauuagaacaaaauucuugagaaauuaaaauuauucacaaucuguccauaggaauugucuucuuguaauauacccuuaagccacucucauaauucuaaaaagcugugcacaauguauuugaguauuguuuacaucaauggugcucaaguuuagcauacguuauaaucaccuggagggcuuuuuaaacacagauugcugggccuaccccaauaguuucugauuuagaaggucuggcauggggucugaaaauuuuaauuucuaacgaguucucaguugaugcaauauuguagguucagggaaugauuuugagauccacuguuuuaugaagaguccuggucagggacugaauggauuugagucuauauuauuuaauuaauaaacaaagccauucugccuuguugagcaccugaagaauguaccagacacauugcuagguacuggaguuguuucaacaagcaagacagaguuuguccuguucuaaaugagcuuucagacuggcuacaccggauacuuauuaggauuaugaaaaguaugccaauaccugccaguccacacauaauaguccagcagaaauaacuaaagacaugcaucuuuccauagaaggaaagacaaaaggcuuguuuuagaaaaaaauacuauauuuucaagccuauuguaaagagaaaauagcauaucugaaaaaaacuccuuaaaacacacuaaaguguuauauuuauacuucaaucauugcuacacaaauuauagcuuugcacaaauuaguuugaugacacauauuuucuauuuguggugauguuauuuacaagaauuaaguuuucaggguuuguaaacauaaacuuuuuuccacuaccauguuuuguuuuucuuuuuucaucucaagugauaagaucagccuugaguauagacaaccaauuauauccugaaauacaucauuggauuccacugcucuuuauuucuuacauuccauuccagguucaagaguaggaaugaguuccgcuaaacuguuaaauaaaugacuugucaaagcuugcuucaacuaacuccaggcagauaaagagaaaaaauucuugaagauuacuguauguauuucugcccuuuagucaguuuuuauuuugagaaucaaucuuuauuaggaacuacagaauaggacuaagguguguuucuguuacuagaguugaggccauaaaugcugugagguacaauuguggccuauaauucaggggguauccuggagauguaugccaagacuuucuucgucuauuuuaaagaagcauauacccguuuuaaaucucuuauauguaucauaguuuacugaaauaauuaucaguguuucacaguuagcauacaucucuauuuagcacaauuucacaguuuacucaugucagaauacaaaaggaaaagagcaaauaaggauauauuaguccauacucaugcugcucuaaggacauacuugagacuggguaauuuacaaaggaaagagguuuaauugaaucacaguucaguguggcuggggaggccucaggaaacuuacaaucauggcagaaggggaagcaaacacguccuucuucacaugguggcaggaagaagugcagagcaaaaggggcaaaagccccuauaaaaccaucagaucucguaagaacucacucacuaucaugagaacagcagcauggggguaauugaccccaugauucaauuaccucccaccgggucucucccaugacacguggggauuaugggaacuacaauucaagaugagauuuggguggggacacagccaaaccauaucaaaugaucuauuugauaaugaucccucggucuccuucagacccaaggagaugggcugacaacuguaauucugggagcuacuuguauuccucuacagaaacagucauuaagcaggcuggcugacuggcuuuaaaagcuuuccuuccaagaugacuugaugauagaauuauuagaagagagucuuuaagaguauucugguagcacuaauucuugugcuaauuaaggacaaggacauacuugaaguaaauauucugugguuuugaucaccacaauuguugaaaugaugugaucuuuuuguuguuguuuugcuuuucauuuguuucuuuuguagacacauugguguaacacauuuuaaaaauauaugcaccccacuacagaacaaauaauuaucucaugagauaaggcaggcaauaccuuaguucggcaggcuuguucuuauggacacauuucacccugauuugcaguaugacagugugguuagcucaggauaauuuuaaaaucaacagaaaucucuuuuuuuuuuuuuuuuuuuuuuuugagauggaguuuugcucuuguugcccaggcuggagugcaauggcacagucuuggcucacugcaaccucugccucccagguucaagcaauucuccugccucagccucccgaguagcugggauuagaggcaccugccaccaugcuggcuauuuuuuguauuuuuaguagcaauggguuuugccuuuccacguguuggccaggcuggucuugaacuccugaccuuagguaaucugcccaccuuggccuuccaaagugcugggauuacaggcgugagccacagugccuggucugaaaucuccuuucuuaagaccuacccauccuuugcuuuuaggaauaaaaucuuguaucuuacacuauaaguuguaaacuauucacugaaguguuuaucauucaaguuucuaauguaaggauuuaagagaaaaauguauuuguuagagaaggcuaucuauuuuccuaaaaauagaauauuggccuauuguaaggcuucauuuuucaaguucuuucggugaggugugaaauuauuuuaaauggaaugauuucaguugcugguugccccauuuuguuaaaaaagcaaaguguuaguaagguuauggauucaguuccucucuagguaaauuacuguuccugucuucuagaaucaugguuaugucuguaaggggacauaagacauaagccccagugaaaauaaaauggaacauuauccaaucaccaucaagucuucaaauguagaauauaaagggcagaauauuguuguuagaaagagauauugugaagguguaaaaagaacaaugaauggucauauagaaauagauagaagauauuauggguauaaugagcaagcaauuuaugguuggcauuuuccagaacauauugcagagauaaaauuuucuugaaauguuuuugauaaauaaaauaugcuugaaaugaauuuugaguaaauuaaaagcagagauugauacuguuaugaagauaguuacauauuacuugacaauaauaauugauauggcagggcagauugggcuuggauaaaagcaauuugggacacaugggagagaauuagacaaaucuugaugugacaaaaagaaaaauaaauguuuauugcuauuuucaguauuauuccaaagguaagauuuuuuuuaaaacaacacuuagugauaaagaaauaaagauauguaauaauggcucugugcacaauuuauaauuuguauaaaauauauuuagaguaaauuuguuaaaauuauauuuguauaaguguugcaaauuaaaauuacauauaauuuaaaaaucauuuuguggguucaauuacguucaacaaauuaauguuucuauuuauaagggccauaaagaaucucucucaacauuuuagaaguuagguaugugagcaaagaggaagacagcuugcuauggcaguucagauucugauauacagaguaguaagaagcaggaaagcaacauuucuuaccaacugauccuuuaacaugguuacauucuuuccagguaugguuuuucaucauacauacuaccaguacauuauugcaaagacuaucuagaguuuugcuauuuuuugugcuaaaaaugaauaaaaaucuccauuaaaaauaaaacacgugcuucuucauccuucuaauuuuauuaaauuuuauuuugcauguacacuauuaaaaaugcauaaucaacuuuaucugaaauuuuuaauacuugcaauuaugccagaucauucucagaacuaauaaaauuucugagauaaauuaagauuaauuucuaaauauucuucaaauuauuuuguagauuaucuacuguaagccauagaaaucacaaauaauuuucaaaaauucuaaaucauauuuauauuauauugaaaauuauaccuuaacuuucuuuuacuuaaacuugcuuuaugaauaaagguaucugcaaaucuaaugaaaagaauuaugucaaagacccaaaacauccaauaugaauuaugauuaaaacaguaacacaaaagaaaaauaauuaguuaaaggaugaucuagcucuaaagcuaggaaauagcguaggucauauugcuaaauuguguauuuucucucuguccuaauaaaaguugacacuguucaaaaauccuuaucuuuagcuuugaauaugacuaagaaacuuaaaaaggaaacauuucaaauggaaaaaauguuauugagagccaagaaaaggacauuuuuaggguugagaguuggauaugauuuggaaucugaaacaccucaaauauuugcuguuugaaauucaaacuauaauugaaauugucaggugguucaccaaaaugucaaggguuauccaaucugccaaauuucugaaugaaguugaaaagacagcaaaucuuggauaaagaauaagauuuuccugcagagcugaauuaaguccucuuuauuaagucaauggcuaugucaauuuauagaaaucaauaguggcuuuugagauguaguuuaauaaaauauagaaaucuauauuaaguucuagaaauaucaagguuauaaacaagaagucuauauaaagacaauacaguuuguuguuucuuuuuauuuuaauaaaaaacaaaaguguuaguucccuuucuugaaacauuuuauuuuaauuuagguaacaaauuaugacauaaauauaaagaaugaaaccauuaggcauucuaaacuaugccaauuuaaaagauaauauaaaaaauaaaugcaaagucaaugugacaaguuugaacuucaguaguuguaaauaugcucauccaaagagggcaacagaaauuaaaaccaccaauacuggugucauucucagaguucaaagggaaaaaguuaccacuagaugaagagguaaggacuuugaucuauugcagguuuuuuauacacacuuuuggagcagaaacaaaaaaaucuuacucugaaguuuguuuuuuuuuuaaagaugagauuuguguguguguguguguguguguguguguguguguguguguggugugguguggugguguuguuguuuaguaccacacaaaacuaucuguauauuccuuaguuccauauucccucugcaaaguacaggugguaaagcaauuuggaaucaauggauauguggauacuucgguauggugcugaacaaaaaauuaauaugauugaaugaaaguacacauugaauuaucagucagauccucccugaaacuagaaaaaaauguuuagauggcuauugcuaugaucugaauguuuguaucccuccaaaauuccuguguugaaaccuagucaugaaggugcugguauuagaagaugggcccuuugggaagugauuaggucaugugagcauaaccgucaugaguaggauuagugaacuuauaaacaaaugugagggaucugguuaucaaauuuugcccuucuaccaugugaggaugcaguaagaaggcaccaauuuaaaguagaaagggaguccucaucagacacggaaucuguuggcaccuugaucuugaacuucucagucuccauaauugugagcaauaaauuuacauuguuuauaaauuacccauucuaaaguaucuuguuacagcagcccaaacugacaaacacagaauuugguacccaaaacuggggugcugcuauaacaaauaacuuaaaauguggagcagauuuggaacuggguaaugggcagaaccugggagaaucugaagguacgugcuagaaaaagcuaugaauuuaccauaaaaugggguuauuuugagggcucugaagaagagaacuguagggaaggccucaaucuuuuuagagauuaccuaaaugguugugaucagaauauugauugaaauguguaugauaaaggucauucugaugaggucucagauagaaaugagaaacaugucauuggaaacuugaggaaaggugauucuuguuauuaagugacaaggaacuugacugaaucgugucccaggguuucguggaaggugaaacuuacaagcacugaaauaggauauuugguggaaguacugaggauguagcauggcuucucuaaauugcuuauaguaaaauguaagaagagagaaacaaauuaaagaaaaaauuauaaucaaaauggaagcagaaaaagaucuggaaaauucucagccuggcaauguugcaaaugaaaaauagagaacaccaaggaugugaccauuccacuguuuguauuugauaagguuacuauggauugguggaagccaggggcucuuauucaucaagccaauggacagaagaacuccacaaaugcaucucagagaucaucgggcuggccacucccaucauaagcuuagaaauccaggaccuugggaacagaaaaauuuuaagucucugcucuccccauucuggaacagcacuccuugcccugucuuacuguugcucaugugggcccagguacagcuugggcugccucucugcaagguacagaugguaaacaaugauggcaucugcacagugccaucuccacagguguagaugcacagaauuuaugagcuguggaggcacggaugacucuagauuucaaaugaagcuccagagagucugaggaccuaggcagugaacagccacaggaguggggccaccacagagggaucccauuagggcaaugucuggugaagcucugggggugaggucacccuugagauuccagaauaguacagccuucagcaugcaagucuaaccugugagagcugcaauacugguugcauuccgcaaacccugugagagcugcaauacugguugcauuccgcaaacccugugagagcugcaauacugguuguauucugcaaacccaugugggcagggcuuccuggaaacuugggggcccgaugcuugacccagugugccugaaaggcaggauaucuacucaagaauuauucuccagccuugagauuuaauguuguuugcaacauuacauuuuggacuugggacaaguuaccacuuuuuuuccuuucuauuucuucuuuuuggaauggaaauguguuuucuaugucuguccaaucauuguauguuggaagcacauaaguuguuuuauuucacaggcucacagcuagaggcaaauuugccucaggauaauucccaucuugagucacacccauaucugauuuagaugauauuuagaugagauucugcacuucagacuuuucaguuaaugcuggaacaaguuaagacuuugggugcuaggugcggugguucacguuuauaaugcuaacacauugggaggccaaggcaaguaaaucacuugacaaggucaggagucgagaccagccuggccaacgugaugaaacccugucucuacuaaaaacacaaaaauuaguugggugugguggcacaugcuuauaaucccagcuacuugggaggcugaggcaagagaaugcuugaaccguggagguagagguugcuaagagccgagaucacaccacugcacuccagccagggcaaaagaaugagacuccaucucaaaaaagaaaagaaaaaaaaagacuuuggagcuauucgucuggaauaaauauauuuuacaugugagaaggacauaaauccuggagggccaggaguagaauacuguggcuugaauguguucccucaaaauucuuacaugaaaaccuacucaucaaagugaccauaugagaagguggggcuuuugggaggugauuaggucaugagaacagagcccuugugaaagggauuagucccuuauaaaagaggugugaggaagcugauuaucaccuuuugcccuugcaccaugugaggacacagugagaaggugcuaucuuuaaagcagagagggagcccucaccagacacccaaucuguuggugccuugacuuuggacuucuuagccuccauaacugugagcaauaaacuuacguuguuuauaaauuacccagucuaugguauuuuuauuauagcaacccaaacaaagacagucauauaaaugauaauacugaauaugaauuuaguuauaaauguguuaaaacuauauuagaagggggguaaggguaacuucaugugagagaugacauaugcaaccuaaauucucaucuugcaacuuaguauaucaauagauaucaguaucuaggaaaucaagaaaaaacagugugaaaauuuuauuuaaaauauuugaaaaauaccaaaaguagcuaaaacaaaacaaaacaaaaauugaagguugcuucgcuagagugggaagagcauguagggagauguagagaagcaauuccuauauuacauuauuaguuuuauauguacggcacuuuuuuucugaguacacaggaaauuuugauaaaaauaaauuuuauuuaaaaaauuggugugcaguuagaauggcgaucauuaaaaagucaggaaacaacagaugcuggagaggauguggagaaauaggaacgcuuuuacacuauuggugggaguauaaacuaguucaaccauuguggaagacaguguggcaauuccucaaggaucuagaacuagaaauaccauuugacccagccaucccacuacuggguauauacccaaguauauaaaucaugcuacuauaaagacgcaugcguauguuuauugcggcacuauucacaauagcaaagacuuggaaccaacccaaauguccaucauugauagacuggauuaagaaaauguggcacauauacaccauggaauacuaugcagccauaaaagaaaggaugaguucauguccuuuucagggacauggaugaagauggaaaccaucauucucagcaaacuaucacaagaacagaaaaccaaacaccgcauguucucacucauaggugggaauucaacaaugagaacacuuggacacagggcgggaaacaucacacacuggggccugucauggggugggggucagggggagggauagcauuagaauaaaugccuaauguaaaugacaaguuaaugggugcagcaaaccaacacggcacauguauacauauguaacaaaccugcacguagugcacauauacccuagaaguuaaaguauaauauaaaaaaauugguguguauucuuuaaucacauuaucaucaaauauacuauuuuuaaaaaaccuguaagaaaacuaagcaaaauauuuucuaaguaauuuuuguuaaaauuuguuuaaaaauuacauugaagugucauuaauaucuacaguuuuaaaguccauuuuuuaagagauauauaaagagauauacaaaguaccauacuucauguuuauauuacaaaucuuaaauauaucucuuauaaaggaaagcaacaucagcuucccauguugcugaccuugucauguguaugcagauugaaaaauugauuugagugucuguagucaauuaaaacugugauaucccauacagaauguuuacuauuuuauugcugauuuuauuaucuucuuuuggaucaaugacauucccaggguaaauaaaagaucuuaggggaaccacuauuuuaucacaggacaucacuuugaaauucacagaaagcaaaugacaaaaacauuucuuaccacauagaggacuguaacaagacaggaaaacagaggugcuauugaaauuuugucuuaaauucuccuaccuguaccuggggauuuugauucaaaauaaauacagagauauaaaaauucacugaaguuaaaggauaagucaaucaaauacaucuuuucuucagacauacuuuaccuaccauaacuaucuaaaaauauuuucuuaacacuaacuaauaauccuaaccauuuucaaaaugacucuccuaacccuguaguuauucaaguugaaugaauacugaauuacucaugguagaacuugugucuuucaggcacauuauaguaacuacaaauaaguaccugggagaguggauauuguuauuuuguuuuuuguguuuuuuuucagacagagucuugcucuguugcccaggcuggagugcagaggugcaaucuuggcugaccacaacuucugccucuaggguucaagugauucuccugucucagccuccugaguaucugcgauuacaggcacacgccaccacgcccagcuaauuuuuguauuuuuuguagagaugggguuucacuguguuggccaggcuggucucgaacuccugaccucuugauccgcccaccuuggacucccaaagugcugggauuacaggcgugagccacugcacccggccagagaccugauauuuuuaagaacuuguucagcuguagggacuugagaaauauaugaaagaguaccugugaguuuuuuuuuuuuuuuuuuuuuuugagaaauaauauggcuaaagugaacuaauccuguugguugcagaggagaggagcagaaugaucacuuacaugaagaaagauaaugcauauacaaaauuagagccaaaagaagcaggcacuucaaaaccuugacugaauguacacggacacaggcaguaaauacaccacuuaaguaaagcuaaguggcacuguucaccacuccccuuucguuguuaaaaugugugccuucaugcauagcuagagccaagcaaagccauucuacaucauuuauuuggcaacuaaaugugcugagcugauuuuugccacucuacuggaaccugccuuucuuguuccugacuacacauuucuguuuaacaguuuuucccaucuggaauacauuuacuucuuuccuuuauccaagcuacaaaccauuuucuuucaaugaagaucuguguugaacuuuuacugggaaggcuucacuuccucauccacaguuacugcuccuuuucuaaucgcccuacagcaaauaaugugcaucauucauuuaggcauuuauuguauuccucuaagacuugcugcugauuuuuuauauaagaacugauauaguguaagguacaguggacacuuaaaaaucaguuuugauuuuaaauuuuaccucccuuguuucuuaccugaugaguuugaacaaguucucagcaucucucaaacuauuguuuccuuauuuguaaucugggaaugaagccaacuucccugagugguaacauggauuuacugauauaguuuauuucuccugcucuauucagugccuggcacaugaugguaugagaaaaauguguggcccuuuuccuuuucuuuacuuuuaauuccaggccacauuauagaauccuggagaacagaauugcccuacauugccuuguauccuguucaaugucuggcaguaauuaaguaccuugugggcacuuacuaaguaguuguuugaaugaauguaucaguugggugccaugaagaaucccuaauggacccucuauugagugcuguuaguagcuacagggacucuuuagauguaguagaacaaauucaucacacgugaaacaucuauugauugagggucaaugcuaucauuuuugaguauugaagaaaacaugguuaugucuuuacagggggauaauaaaaucauuauuuuaaacucaugacauucuguuuaguauuaucuucaauuuaauaagcuugacagacauggauaaaagguaaaaagacugucaaacauuuugugaaguuagaguuuuuuaaaaaauuuuacccaaauggaucaccucauuuuuuuuuaauuaguaaacuggaaaucagugaaaauugagauauuauguguuuauguaguucugccucaggcaacuaaauuuuaggaauuucugguuccuuauaucaggcaccugauuuacuuuauuuuacucauuuugauuuaauucugcucaguugaugaauaaaagaaccugugaaugccagauauuauccuaaggccaguauagucuuucucaaacuuuauacugcaucagaaacaccugcggggcuucgcaaacauaaauuguagggcgccacucccagaacuucugauucaguaggucugggcuggugcccaagaauuugcuuucuaacacuuugccaggugaugcugauucagggaacacacucugaaaacuacugcacuggagaagaaaaagacaaaaucaagguuccuucucuagagaggauuagaguuuuuauuaggcuuuggcaacaauucuaaagugauaaauuguuuauaaggacggugaugucuggguguagaaucuugaaguuucugauaauucaaauauuugaagauccagauuugagcagccaugucuucagaacaauaaggaaacuugaaaaauaugccuguaggcauguuuuaaaaacuauuuugacuucugauaauguagcauuaucuuuaaaccacuauuucuacauaacugaaguagagagaaaguuaaaucuaauauuaauuaggaguugccuauaugacuauuuuugaucacucucuucuaauuugaucaguuauacauuugaauugauaaugcagucuauuuuaaagauaauagaauauaguuugccuaaguaagaaucuuuucacacauaaaaaucacacauuuagaguucuaaauucauuuuuuuaaguuaauggaguauguauagagguauaacaucauuagauauuuucagaaaaaaagcuguuaaagugaucuacacaaugaguucaacuaaaaaauagauuuugacaauuuaagaggaaauuaaauaggccugcaugagguaguuuaaggaaucuaccauuuagauuagauuuggagaagaccauuaucagauauacuucauuuuaaacacuaaaaauguaauuuuuacauugaaguuuaaagggaacuggaaguauuucaaugccauuugaauuccaaugugacaggccaaauagaaagcuuauuuugguaagaaguuucuuaaacacuugugaaauuuauuaaauccuuuuuuucuaagccuacuucuugauaaucucauggacuaccauauuuuguaaauauuggaaauaauucuauucuuacaaaggauuuuuauuaagauaaacuaggguuuguuacacuauauuuuaaaaucaauucauuaauucaccagcuacuaugaggaaucuuuacaucuucagguacuagucuaugugcuguguagaaaacagaaguucagagaaaucuaaacuucaggcauuggagagguaaggaagcugcagaagguaaguuggaagcuaguagaggcugguucaugagggugcauaauagaagucaucucuguaacauaaaagugcaaggugaaguagcaagugcugauguagaagcuacagcaaguuauccagaagaucuagcuaagaucauugacgaugguggcuacauuaaacaaauuuucauuuacauuaaaggaagaugccauugggacuuucauaaccagaaagucaaugccuggcuucaaaguuucgaaggacggcugaccauccuguuaggguuaauauagcugaugacuuuaaguugaagccaguauuccuuaccauuucaaaaauucuagggcccuucagaauuauacuaaauguauucuaccugcacucuguaagugggacauuaaagccuggaugacagcacaucuguuuacagcaugguuuacuaaauauuuaagugcacuguugagaacuacugcucagaaaaugagauuacuuugaagauauuacucuuuauugacaacacacuuggucaccccagagcucugauggagauguacaaggagauuaauguuguuuucaugcccgcuaauacaacauccagucuguaguccauagaucaagggguaauuuuaacuuuuaagucuuaucacccuuaagaaauacauuucaugucuauagcugccauaaauaggugauucuucugauauauuugggcagaguaaauugaaaacuuucuggaacaaauucaucauucuacaugccauuaagaauauucaugauucaugagagcaugucaaaauaucaacaugagcaggaguuuagaagaaguaaauuucagcacucaugaaugacuuugaaggguucaacaguucaauggaggaaguaauggcagaugugcuguaaauagcaagggaauaagaauuagaauuggagccuggagaugugacuggauuccugcaaucucaugauuaaauuugaaugaaugaagcauugaaucuagugaaugagcaauaaaagugguuucuugaaguggagucuauuccuggugaagaugcugggaacauugcuaaaaugacaaaaaauaauuuagaauauuccaucaacuuaauugauaaagcagcagcaagguugagaggauagacuccaauuuugacagaaguucuucucuacucuggguaaaugcuaucaaauagcauggcaugcuacagaaaaccuuuugugaaaggaagaggugauugguaugacaaacuucacuguuuucuuuuaagaaauuaccaccauuaccucaaccuuuagcaaucaccacccugaucagucagcagucaucaauauccuggcaagacucuucaucagcaaaaagauccugacucacuaaaggcccagaugauuguuggcauucuuuagcaauaaauuauuucuaauggcccuauguacauuuuuuucuuuggcaucauacuauugcacuuacuaugcuacaguauagugcaaacauaacauuuacaugugcugagaaaccagaaaauuuguucugguuuggagacaucgugugaugucuccaaaauaugccuguauuuggugaaagaaaaauauugaacuuuuuugacggguugcaugugacacugugggggcaaguauagcauccaauuuggcuuuaggguuguauguaaccugaguaacuggguaaaugaugauuccggucugcuuaugccuuuuuucuucguuuaaaaagauuuuaauggaaguucaguaaugagagaacuucaaacagcacguauuccgagaguuagaaugcaaaauucagauuuuaucuuucuuuaaauacacuagagcagaggguccugggaauuuccuuagaaaauacugugaggucaaaacguggaccuagccaaaaccacccaaguuuaugcaucaguccccccaucguuugaaggagguauacauuuaucuguguccauuaguaguguuguuugagaauaaaucuagaucuacuacuuacuauuuuugugguaccuugguuacguuauuauguaauucuuccaagcuucaaauuccuagucuguuagggaucauaauaguucuuaccauauugaauuguuuugaugauuaaacaaguuaauauguacaagguacuuagcacaaugccuggcucauuguaaacacuuaauggaacuuaguuauuguuauauuuauuucauguauuagaauucuguauaugauuuucuucgggauaaauaauuaccaguggguacuuaaaucugcuggacaucauuaucccacaucaugcgaauaauuuucaaaaucuauaauaguacuuacuccccaagacuuuaaggaaaaacaagaauaaggaaaaugacacuuguacauuucauuugauuuuuaaccuucuguauuacaguccccaaaugaaauuguuauuacugaccuuuguagaaaagauacaguuacuacgaagacaagaagauauacuagcuuucacucccaucuacccuggcugcaauugcugugcuguccaacagugucugugaauuagauaucaaacugauuuaugugggaaaaaaauguguuacaaacccaacgguuucagauugaacaaaagauuuuucucuuugccauuugccucaguaggauucucagcucagauccaguucuucccaaccccucauuaaagugacuacauuuuacuaaacccaucucccugcucuguuuuacagagugcccgccaucauuuaauuucauauaucaagcaaaacuauuagcauagguccaaauaaaagagccagaaaucuugacuuauacccuaggugguaaucagcccacuuuaagugagcuaaguagaauacuuguuacuuugggcuacccucacaaacucucauagacacuuaauagaaauaaaagcucaguaaucaaacaggauauaauggaaccuagguagguaguguuuaccaguuaagaacauaaagauuuuuuaaaacuccauuucuuaaaaugaucucagcgcacacacacauucacacacaucgcauacagaagagaaaacauucucuucuugaaaacuuuucaagggcugugugugguggcucacaaguguaauccuagcacuuugggaggccgaggcaggaggaucacuugaggucaggaguuuaagaccagccugggcaacauagagagauccucucucugcagaaaauuagcuggauguauuggcacguuccuguaguuccagcuagucaggaggcugagguaggaggaucccuugagcccaggaguucaaguuacagugagcugugauugcaucacuguacuccagccugagaagcagagcaagauuccucucucuggaaaaaaaaaaaaaaaaaaaaaaaaaaaaaaucuauuuucaaggaaaacaauauaagcacuaaauauaaaaaaaaugauccucaguuugagugugagagaguguuaguuaagaugaggacucuaaguaucuggugaacgugacacugcugugguaaccuggacagauggggcagagucccaugacaguggguugaaaagugaauagagagugacaaagaggauacaguagcuuucacuuuaaggaugauuaguaagggagaaucuauaauagaagccauggaagagcacagcuuuaaggaaugguuacuugcucacuagcuuauauguuuuuuuuuuuucaaguugaguaaaaccauacgauagcuauagacugaaggacgaagguagcaaagagagagaaauuaaagguacaagcuaaggguaaagaacugaaaaaucaauguuuaaaaaugacaaauaguaguuuuuuauuuuuaauuuugagucuuuuguaaauacuuuaaggguaaaugacuguauagcauuaacauauagaaaaaguaaucauuguaaacagcuguacuuauaaaauguuugcaguugcuaaaacuacuaguuaaugguaguuuagaaaaaaauaauuuuauuauaaaggagcaaugacaacuuuaaauggguagugauaaaauuugaaagaaaaaugauuuuacuaccuaguuuuaauuugacagauucuauguaccugcugguuggcauaaaauaugcuuuaaaauuuuuucccuaaaguuauuuuuauguugaaucaacaguacucaaugaaaguauuucuauuacaauuuaauuuagaguuuguuucugaaguauugugaaaaauuuuaauaugauaaaguaggaaacacuuuugcucaagaaucggauauacguggguuuaaaucuugauuucuuugcucucucaccuuugguaaguaacuuaagcaggcuaagccuccauuucugcauccauaaaaugaggauaaugauagaauguuucucagauguguuuuugaggaucaaaggauucaucuauggcaugaaaaggcuaaaagcagggcccggucaauaaauauuagcuauuauauuuauuguuuauuucuaguuugucucuuuacuucuaaagcacuucaaucuauauauuuuuuaaaaaugcaaaaaaaaagaguuuuuucaauuccucauuuguauacacuuugccacagaauagaagccacagggauuuugucccacuuaauauauggcuucauaaucugaaugaucuugggaaaacugggauaacucaucuugcacacuacacacuaacagggaauuauuaaagguaguaaccuaaauuggauccauaaauacaucgguaucacgcagcaaauuuuuuucugcuagguaggagaacuuacauacuuguauuguuauuggacucuaaugacaacaaggugagaaacgaagucaacauaauuuaggaggcuccucucccucacuccggaaauacacauggauuucacaauucucgcuauguucuauggaaauccaagacaaacauuguuguguauucacacacacaugagauauucccacuucagagauaacauaaacauagaggcaaagguaaaauacggcugagaauucuguguuaaacuggacuucugucaagagagucuacaaaaaauaauuuaaaaaagcacaguaauauuuaaaacauauauuauauuccuucagacacuaaagacaauggucucagaaaagcauaauuuuuaaaugaaaauuuuaccaucauaauauaugauuuuguuagauacacuacgguuacauccuaagugcauuagaaauuuuaaugggcuuaguucccuaacuucucccacuaggaaccucuacuguagacaauuggccaugcuacugacagaaaugugaaaugauaaauguuaaauucauguuuuaucuuuuuugauguuuauuuuuaaucauuuuuauuugauaagacuucuuuuacuggagagucagaaugaacuaucaucuuucaaagaaugaaaggaagacaauucuuucuauuuaugauuuaggauguuguuucacuuuaggcucaucacauuaaaagcaguaagcaaaaugagauuggugaggaaaaauuucuuaucacuaacaacuucuaauuauccaaucuauagcuuauuuggaauauauuucuuccaaguuaauuaauaauguuuagauuuuucuguucaauuaaguuugugguuaucaauuuauuucuuuuuaaaaaaaucaauuuccauuaucggcagaacauauucuacuaaaauacccauuugcuuauuaacuguugauuauuaaaccaauaauuauaauuugcuuuuaugcacccauuauuaugacugcuauuagcuccuacuuugcagguaucuaggaagauguuuaaaagccaaaguuaaagccucaagauuucucaugacugucugagaaagagguccacuccuaaugcagauucugaguguugcccugaaaaucuauuuauccucacauggugcuuuguuggauuggaggggaaaacugggacagcuucucaccuccuagagaaccaggcuccucaaaauagcuguuugaacuaaacuuuuacauauauaauauuuuuuucaaaacauggaaaaaggacuccagaaccaauuaaaaaagauuucugacaucuacaauuucgaauucuucuuuccaugagucuaaaaacaucuaaauuuuauuucucuaggaguuuuauguaugaaaauugagcuuuaaggaguaaaaauguuuuggcuuauaaaucccuugaccaaaauuuuugguauuggaugcauaucuuugaaaaagaaaauccacagggcuuuuaaaauaugguucaauauacuuuucaaaaaucuaguaaggcccacaugaaaagauguuuaucauuauuaagcauuaugcugugugcgguggcccacgccuguaaucccagcacuuuggaaggcugaggcagguggaucgcuugaggucaggaguucgagaccagccuggccaacaugaugaaaccucgucuguacuaaaaauacaaaaauuaucugggcauggugguacaugccucuacuuccagcuacuggggaggcugaggcaggagaauuguuugaacucaagaggcagagguugcggugagccgagaucaugccacugcacuccagccugggcgacagaguuagauucugucugaaacaaaacaaaacaaaacaaaauaaaaggucuaaaauaaaaaaacaaugauaacauugaaugcugugaggcuguggaaacaaugugucacccacauauugcuaguaggaauauaaaacaaugcaguuagccaagaaaaaguguauggcaguugcuuacaaaaucaaauaggcacuuaccauaucacccagcaauuacacuauuggacauuuacucuagacaaauaagaaaguaugucacacaaaaaccugcacaugaauuuuaauagcaauuucauucauaacagccccaaacuggaagcaacccagaggcucuggguuaaauaaacauuuuaaacugguauauucaugccauguauguuagcucagacuucucuguaagaaaauaccacacucuuggguggcauaaacaacagaaauuuauuuauuuaucacuguucuggaagcuggaaguccuagguaagggugccaauuaguuuccggugagggcuguauucuuggcuugcaauagccaccuucucucuguguccuuauaugacagagaaaaacagaaaucucucuuccucuacuucuaaggcccacaguccuaucagauuagguccccacucaugaccuccuuuaacccgaaagacccuaucuccagauacagucauaucggggguuaaagcuucaacauaugaauuuugggagggacaaaauucaguccacugcacuauggacuacuuuggacuacauggauuauuacucagccaugaaacaacuuagaugaaucuccagagaauuccacugagugaaaaaaagccagucucaaaagguuacauacuguguaauuucauuuacauaacaugcuugaaauuacaaaauuauggagaucgaaaguaaauuagugguugccaggugucaggguugggguuuuggggggagguaucugagaucauaauagcacaaaggagacuuuagaugaaauuguucucucucuuggcuguggcggugaucacaugaaacuacacauacaauaacacugcauugaguuaaacauacacauacauacacaaaggagugaauguaagacuugugaaaucugaauaagcucgauggauuauaucaauaccaguuuucuaguuuuaauauugugcucuuguuauguaagacgaaauccagggaaggguauacuugauuacucuauauuauuucucaugacuaccugugaauuuuuaauuaccucuaaauacaaaaugcauuuaaaaauccuaaaagaaaaauccaggcugguugcaguggcucaacacuuguaaucccagcgcaccaaggcaggcagaucgcuugaacucagaaguuagagacaggccugggcaaauagcaagacccugucucuaccaaaaacauauaaaaaugagcugggugugguggcacaugccuauagucccagcugcuugggaggaugagguuggaggaucacuugagaccaggggguggagguugcagugagccaugaucacaccacugcacuccagccugggcaacagaaugagacgucucaaaaaacaaacaaacaauagaacuaacaaggacaauuuuauguaagccaaguuaugauaauaaguugguuguguuuucuuacauaggauauuaacauggaaguuuuauauuuuaucaucaauuccaagcuuaucaaauuuaaaaaucuuuaguaagcaugggcucugccuuucuugauugccauuucuuuuuaucucuuccucccucccucucuuucuucuuuccuuccuuccuuccuguccuaggauauaaugagcuaggaaauaaauuucagcuccuaagagaugaaagacucauagcuguuagucuauuauagcacuaauaugcucuaugacaaauucucaguucuuaaaaauggugcuuaaaaaugggaaaaaagacuguuuuuuuccacuuuaauauugagaaaccucucuugaaucugacuggaauuuggucaaaaaaaucuauuggauuaauuuucuaacuaguuucuuaagcacagcacauuaagaaaaucaauucaucuaaauagucuaauuauacauauaaauaaaaauaaugucuugauuuuuaaggcaauacaauuuccuucuaacucuucaauauagccaaugaaauaaaaagugaaacauguuguuaagaacagaaaaauaauauuuucuucaugaaauaugccucauuucuaauuagugauguuuuccuaagagaaagaaacuuggcagagcaauagugaaucauugaacugaaaaaaaaaaaaguuuaagaugugauauuuuuaaagaugcaauucaaauauucaaucucauuaucaguuaacuuuauuuuccccaaacuuuaguaauuugaaucaaaacuucugagacucauuuggucuuggugcaauuaaaguuucucuuuaucuuaacuuagauucuuuaaaguggcaguaugcuuucugcaauauagcuauaacucuuuuuaaauaguuguuuuggaaucaacccauucacaaauguguggguccauuguauuauguuuuugauuagauauauuuuccaauagcaacugucauuauuuucuuuuuuuuuucuuuuuuuugagauggagucucgcccugucgcccaggcuggagugcaauggcuggaucucggcucacugcaaccugugccucccagguucaagugauucuccugccucagccuuccaaguagcugggauuaaaggcacgugccaccaugcuuggcuaauuuuuuguaacuuuaguagacacggaguuucacuauguuggccaggcuggucccgaacuccuggccuugugaucugccugccugggccucccaaagugcuggcauuauaggugugagccaccgcgccuggccaauucucauuauuuucaucagaaauaauggcaaauguucccaaccugacagcuucagccugucaguauccaugacaauagaauaucagacauuagcagguccuuugacuaccacaaaacuuaagaacacaucacugguaauguagacuucagaagcauuuuaauugaacaauucuugugguauauguuuuuaaacuuguaggugaagaugaaauauauugaccugaggucaggaaggauaucauggcccaauuugccccaaauuucuguuauuaaauagauaauucauaugaccucaaauaguaaacuaauaggaaaaucacugggauauaaugauaaucuagcaauuuuccaauuaacaaguuggcuuuagagcuauauugaaaugugaugacuuugaaucucuuuacuaacacaccucuggucauaugaagcuauggcuauaaaaucacuaaaagaacuaugaacuugagugugcgggacuucaauuuacuuucuaacacuaauuaguuauauaaugcuaaguaaaucauugagcgauacugagcauuauuucuuuuauuuuggaaauaaauaacaauauaugccuauaugagaguaauuauuuucucuuuccaugacauccuuuucuucguaaaccuccucuuccuauggcccuccacugaacaggaaugguugauuggguccuacguggacaaguuauuuaacaaacauuuauuuggaagccugguuuaggacacaauugacaaaaaucuguuuguucaugaagcuuacauucuggugagaugucaaaggaauagagggauauaauaaacauauaguaaaauauauagaauguuagaugaggauaauuucuuaagagaaauuuaaacuguggagcaagcuuagggaauauugggagaggaauuucaauuuuagauagucagaaaaagccucauugagaagacaauguuuaaacaaagaguuggagagagugagggagugagccaugcagccaucucagggaagaacauuuaagucaggaggaaagaccacacaguugagaauguaccuggcacaugugagaaaaagcaaaaagucuguauugcuggagccaagugaguaacauaaagaacaaaauguuaaaagaucagaaagguaauggguugaaaguagguaauacagaaccauguagaucauugcaaagccuuuuuauuuuacuacaagugagauaggaaaccugaccagagaagugacaugaucuaaauuuuuaaaagaugauucuacuuuuuguacugaguauaaaccguagguggcaugggcagaugcaaagagaugaauaauccaggcaggaguacaugaugguuuggccuagacaguagugcugaaguaccgagcagacauuauuuucugaguauauuuaaaaguaaagcuaaauggaauaguucuugaauugcauauagguuaaaaaaaaaaaagaaucaaacaugacucuaaggaaaaucgucauugaaauuuggucauuuuacauuuuaaagccuauuugacaucuaaguggaugugcgcaauaggcagucggguauguaagacuguaauucaaaggagaaguguaugcuggaaacaguuacccaaagcugcgccaaucagauccucuuucugggaauuggauuuaugacacagaaacagaucuugguugacauuagaguuugauguauagaauuugggucagaauuaaugcccccaaaaugcaaaaccaaaauaaaacugcuauuauggcgaagcaggaacugucugguagagaaaccuaucuauaucucaauggaaauaagaaugaaacacacauccggaugugaugugcacccaagcccagagaaacaucagaugaccagagauaugacugacauugcugcaacuggauuccauuguuuauuacaauuaaaaaaggggggggcccagcacagugguucaugccuguaaucccagcacuuugggaguccaaggcggguggaucacuugagcccaggaguuuaagacuagccuggccaacguggcgaaaccccaucucuaauaaaaauacaaaaauuagccgggugcauuggcuuaagccuguaauuccagcaacuugaguggcuaagguaggagaauugcuugagcccaggagguggugauugcagugagccaagaccgcgcccacugcacuccagucugggugacaggagugaaaccucugucuuaaaauaaaaugguuaugugaugaugugaaguuuguuuuacuugaaaucuaauuauugccaaaaaacauagccuauacaaggcaugaugaaaauaauaacauucauuguuuuccuuuucaaguuaaaccuguguuauuguacagcuugaaacauacuugaauaugaugaaauuuugcauauuuauaagugucauucaaaaucacuugauuccuucagugagaauuuuuacagauaucucaguagaaguuuggauuguuuucuugauuccugcaauuacauuuaggugaaauuugccucuagauguaggauaauugaauccauucacccuuaagucauguuugagaauguaugagaagcucaagccacaauaagcuauucagcacaagugggcacauugagcuuuaguguauaaaauguuuuauacacuucaaucuuguaaauuauucuguacauucaaccacugaaaaauaacuccuucucuauuucugugauauaaaggaugcuuuuaaagaggcuugcccuuuauaauauuugacccuuggcaaugacuccuauuuuaggcaaucuauguauauugacuauaucugcuucuuacugagaaaauaucaagcaaucaaauauugaauacauuagggcuaauuuguuauauaaacaacaaaguuaguaaaucacuggacauuaaaaucuugguaagacugugaauaucauauuuucgagacuacuugucaaauuacuaaguuguauauaacuauuuuuguauguauuuuagaaagaaucaaaguuuuucaagauaauuugcuauauuucaacugggugugaaaguacaucaauaaagacacauauuucugguuugugugcucaaaaauaggcaauaaauauuuucuauaauuuuuacacuuagccuauuuuaaguuuguguguguguguguguguguguguguguguguguguguguauuucauuguguugaaaaaagccacuuggaagaauaauauaacuuucagggaaggagugaauacauguucuuuuuauucacuguuuuuuaaaaaauaguacuugaggccacugaaugauccccuagucaucugagggaauauuuaaauaaugcucuguuucuauaguuugaaaacugaccuagaacuaagaagguaaauaaaauauuaacuuuuauuuuaauuguuauccuaccaguguccuuuugcucagagccaaaugcagcaaguuucaugggcacaaauggaccacauuuucaguacuggugauuauagugaaaguauuuuuaugccagaaacuggguugauuuaagaaguaacccuagaaauuauauauguaauagcuuucauauaaaauuugauuccuuaaaaaaugaguaucucuagucacgguucuguuucucuuuuucuguaagaucuuaaguugaagcuaaagacucuguuuuuauuuuugcuaagagcaaggaaauagccaaaacagagucaacuccaauugcccauguuuaaauuuuaaaagagaugacuauuauuuauuuauauaacuaauaaauuaauuuauggaaucccaugauuucuuauuaauaguacauucuacuuguagugauauauuuuuuaucuauuuguucauucuuuugacuggcuaacuaaauauacauauauauacacacauuuuugagcugcuuucuugaaguaagacguauagcuagugagagaaaacuguccuuaucuaaugagauuucaucuaaaacuuuuuaaugaugccuuuauuauggugaauuugaaauauuaacaaaagucuuucuuucucuuucuuucuuccccuuuccuuuccuuucucuuucuuucuuccccuuuccuuuccuuuucuuuccuuuccuuuccuuuccuucccuuuucuuucuuuugagauagagucucacucuguugcucaggcuggagugcagugcugcgaucucaaucacggcucaccgcaaacucugccucauggguucaaaugauucuuaugccuuagccucccaagugggugggauuacaagagugcaccacuacaccucgcuaaguuuuauauuuuuaguagagaugguuucuuuugccauguuggucaggcuggucuugaauccaugaccucaagugaugcaccugccucguucacccaaagugcugggaauacaggugugagccacugcacccaaccauauauauguuuauauuuauauacucaccaccaccacccuaaguuacuuugaaacaaaucuauaaaauuuuucagaaugcaucucuaaaauauuagaaauuuuaaaacauaauccaaauacuaaaaucauaccuagaaaaaaaaugauuucuuaauaucaucaaguuuucaguuaauguucaaauuuucaaauaacucauauauaaauuaauuuugcagcucauuugaaucaguauccaaauaaaguacauguguuacuauguguuaaguuuuucuuuuuaguguauuuuaaucuauaggcucauccuucauuacucuuuuauuuccuuucuugccauuuucuguuggugguggugguuguguugcagagaaaccuaauaucuauuuucaaaaaaggagccuacccaaauuuaagcacauucagggaagagaccucaggaugcaauauagacuuuuaaaaacgauauagagaacuacuaaaauaacuaagacaacaaaaaccaggugacuagcauaccuugauggauuugauaguuguugaagucaaaauaaaaauuagcaccaaggagcaggcugcugguuggaaucucuuuggagacagaucuguaucaauauaacugugcaacaacuggagccaucaaacaaggaauggggugccucuagaguaugaauuugucauugaagcaauucaagaguaacuucaaaaagacacaauuucuuuuaaaauaaugagaaacaacaauugcuugcugugucucagaacaaagcuggaauucaaacaauuuuuacauucccuuucugauguuauuuacucuucuugcugucacuuucacuaccucucuuaugaaacauacaagauuuuuacucucucaccgccaccaugcacacaacuugcucccauuaacuguagugguaaguggauuaguaaaauaauugucaaugcacugccucucuccugacuuaauggacuacaaauugaaggcucauuacagagcaucugcuuaguggagcccaaaucauaucuagcaaccuaugagcuagcacacugguuuagauucucaaagcagacucacgagaaucagagaccuuacucaguaguaaccuaguacuuauuucaaggagacagacaagaaaagccucagaccaagcacagagagaacagacauuaagggugguuccccagguucuuccuucucaugucugacaagcagcucuggccagaagagauuauaucccugcauuaucccuacaugaggcuucugggauuccucauaaagcagugauuguuaaauucugaaacaucuucauuuuauacuccagauaguucuauaguuuauguguggcauuccuuacagauggccaugccuuaccgauacaggguuauguuuacuaaguuucauuauucuuugccagcacaucaugcugacagcauugcagagauaaggucucuuucuccaaauauuuuuaguccauuuuccuggauguccagcugacaaggagaauagacccaggucaccugacuucuuuucuuucccacaggugauguucuccaaaugaagggaguguagagagagcagaccaguggcuauaacuccuucuacccacuuuagauguugggguuugagaaaauguaaauuuuuagcuuuaaagugucaacagcauaagaaacacuuuaauagauagauacuaaaauuuuuagcuaacaaauuacaguccacuacaauuuuucauucacuuuaucuuuacucacguauguuaguguuuaaaugcuagcuccaauucucucuuuccauguggaaaucaugaagacugcaggcuaugugaaucccacucaacuuucauuugcuccuuuuaccuaaaagauacaacuaguauuuuauaacguaaugccuuauaagugccuauacauaugauuuagugcuuuaagauaaaacaccuuuaauuugcuaguauucuccacuccuaguauuguaacaauauagauauucaaugcaauauugguugaguauuaauaaauacaaaugacauuccucuaauuuucaguguuuaaauuucugcucccuauuugugguucuaauaggugguuuugcgccguccaucaaucuuccaagcuuuaagaagcaccuccugucugcacaguauuuuuaauuaaagggaguccuuuuaauuauggaauguucauuuauguuaaguugcuacuauuguugauaagacucagcucugauaugaaaaagcagauacucugagagaaagaggaguuagcgcaaaacuaaaacaucaugcuucaugccuucuccuuugggacucugcucuuagggaagcucuuuuggaagagucauaacaggcacaccaaguuuuccuauucugauucucugcugucaacaguucccuccuuucauuuacucucuccaguuucacuacuguaagacaccugaaaggaaagucagggagguaaaugacagaggauucucauaucuccucuuuccuguguccccucugucuuagauucauuuauucuaaucuuuagcaaucccacacucuauuaauaaccuugacuuuggcuauauuuaggggcuucugcucaggcuccuggucuuuucuucucuuugcaguaugaauuuauagaaaagaacaacaaccuacuaugacauugcucucucuuuuuccuuuccucuccuuccgccaguuguaaguugccaagucugaggacuaacaguugaugugauaucugcuuacauaauaauaacaaaauaauuuauauuucuuugcaauugcuaguauuaggcacuguguuaaacccuuugcaggaauuaccucauuuaauuaucccaacaauccuaugaggaaguuauuaucuccaucuuccagaugagaaugcagccuucagagaaacugaaaaacuucuccagggucuuccugcuaagcaaggauaugaacacaggugugugaaauaacagugcucauacucugaacucuuacgucauagugccucucuggaaaggggcugcagauacguuauuuuccuuaacacgucaauaucagagguacgcaugaauuagagaacaguagucaaagcuuacuuuauuuacuccaauugucacguaagugucugugcucuggcaugaaaacaaaaaucacucacauucuuuccucccuaaguguuuuucuaaaacgacaucugaaaaaugaaaggaaaaaaauuaagcauauuuugucacuuuucucccaaagcuagauuccucaaacaaggauaaccgguauuuucauuuuuuuccccuaccauucguuugauacuauuaaaagucaacauagagccuaaaaacagcugacuucucaauaaacuuauuucuagacuaauuuuggaaggacaaaaaucagagaagcauaaauuuuuaaagguccugguuuuguuucuaaauuuaaaauaacugcauguuuuaugacuaucucagcuguguuuuaaaaaauuauucccaggaaugagccuuguuauauucugaguuuaauuugucuuguaauaaaacuuagaugcuuuucugaugccacuacucagugcugcuauccuuacucacuuuagcccguuacaucugcucuucauucucauggagaagaaaaucaaaccaggguuaucuuagucccaaagucaugcucuuaaaaucuauuuaugucgcuuucuacaauuucugcugagccaucuguauuguucgguauuucccucuguuuauuuucuuuucuaaauuaccuuuuuuuuccccccccgggcuugguuuuucgccugucacacaucucucaucuagccagaauacauuaaggcccuauuuauauaccaagcacaguaaagaaaaccaaguucacgugugaugaacuuacaguccauggauaaagagaacuaacuuaauagguaauuauaagacaaugugaagagggauaggaguggggcaauuaccuaaggagggauccugauuccaugcuauaacuucuguauuaaucuaaaaauccauauaauguauucugagucuccauguuugucaucccaaauucauaacucuuacauucuguccaguacuaguuauguuacaggggcauuugcagguagccuuaauauuaagccacagucuacuauuucugcccaaacuuauuuuccagacuaguagccacuccuaccaauguuacaugacauuguuccuuaaguaauuaaaauuucauaugguuuuacuucuuuuuuuggcuaaauauuuaaugacagcccaucauaaaaaauauacagucauaagaaaugucuauuuugaacuacuucucuuuuuuuaaauucugcuaaauuuuuuucuuguuauuaaaaaaaaaaaacuggcaagugcagugauucacaccuguaaucccagcacuuuggaagacugaggugggaagaucacuugagcccaggaguuugagaccagccugggcaagauggcaagaccucgucucuauuuaaaagagagagagaaaauauacauguauguauauauauaguguauauauauauauauauauauauauauauauauauauauauauacacaaaaaaaaaaucagaaguggaaaauaaaggcauuuauaaucuuacugucuugagauaaccacucuugauauuuugguuuauaugcuccauaauguucuuagauuaaugcacauaaaaauuaaaucacauuguggggcuguuaaauacacauauaauuuguauauguauuuaaauaacacaucuugacagaaaaauguuaauauuaauucuaagauauuuguuuacaacaaauguauacacacaaccugaaaggaauguguauguuauuuaccauggaauauuuuugauuuuuuaaaaaagaggauacuuccaagauguguguuuuaaaguaaauguauaaaacagaaagaagcagauucaaaagaguugcuaaaacuauuaugcucuagaaaaugcgguaagugcuuuuauuccugugugggccagcaugaaugaauaccagcccuucucuuuucucuucauuuaaucuugcacagcauucaauauuguguuuugagcugucucauauugccucuuggguguucuauuaucuuucuuauuugaccaugaugaagauggaacuccucauauuuccuucaaaauucuugcuucuuucuaauuauugguacagucaucauucuuucuaggauacccuucuccagauagcacauuuuaacauuucaaggaauucuacauguaaaauguauguaacagacaaaaaugauuccagguugaugauguaccuguaaaauaaauucauuaguccaguuguauaaugauaaauuauggguugcuaagcuuacagacaagauuuuauuaaauuauaaaguuguuaaaaaggaauauacaaacacacacugauauaaagaaaacacaagaaggaagcuacugagcugaagcacaauauuuuuauuccucgcuaacacaggccuauccuuauuuaaaucucaacaauuugaagaaacuacuaugugguaagcugacauguuuauuauauuuuaaaggagcuucuaugucacuaauaggcaugaaaauuguaacuaauuuaauucagcguuaauucuucaauaaauguauuugaauauauacaauuuaauuaagcacugucuucauauucaguguuaauuuaugguaacuuauuacaauucugauaaaauuguuaucugucagucugccuaagauuuuuuucauuccagaggauucagagaucaaauuucuaaaauucacaaagaauaaggagggcuuuccucaaaugggaugcuuuccacuaugacaguccuaacaugaucaucaugagaaaaaccucaacuggccuguuccaaagaaauguuauuaggauuucaaggcuuuucuggaaauguuagggagaucauuuuuuggaaauauauuagaaauugacuaaauugcugccauagucaaaauaaaaauuggaaugucuuaaaaauuaaauuccagcagauuuuaugagauaaaaaauuagaaauaacuauagauauuaauaagaaaaacuuaaaguauaaaagaaaacauaauugguaaaaacuuaaaauauuuuuaacuuuaguaagcacaauuuacacugcaaaaauugcaggaaggggggagaauuuugcuauauuaaaaauaaaacuuauaaggcaaacuggaauuggagaugauaguuucagucacauaaaaacuaugauuuacacauuuuuaaaauuguuauuuuuuuuacccugaaaaucuuaguguugagucuggugcuuaaucuucacaguauuucaaaaucuggucuaaagaccacaugaacgauaauuauguaguaaguuuguuaaaaauauaaauuaccauguacagcuaauuauuuaaaaacuauuuagggcacagcuguaauagaaaauaaggcauuaaaaaggaugugggaauuagaagcucaaauuccuucaaauauuaauuaaggccuuuccuaagaaaguagugagauauacucaguucuaaacuccaguaauaaugaagaaugugaagaaauucagaaaggucacagaaaugaugagaggcuggaaaauuacauuucugcucaaaccucagaaguuaaaggcaaagccauacuucuauugcuugauuucuaagaggucaaaauucugcuagggcuuaaauaaaaguuucucagaaucucucucuuucccuuucucugucauugcaaauauauguacuguuccuuaaauccuuuuuaaauuugcauuaugauguaaacuuuuuccaguaaaauaaggaauaacuuuugucaaagacugagaaaaugaugacuguaugauaugcuaccgcuacaguccuaaacagccauuagcuucaccugcccugacauggagccuaguacugucaccauauacaucauuucuuuagacugaggcaguuuugcaacuggacauuuuauuuuuucuuggccaucauucaguguuaauaccauucugguguagacaaaguguugucaaauuuuaaugcauauaaaaaucuuguuaaaaugcagauucagguucaguagaucagcuuggugccuaagaauaugcauuucuagcuaguucccaggugacagugauacuacuggcuuaugauccacacuaauaucaauuuacuuaugagcccacaauuuacuaauaacagcucuauuagagaaaugccuacacgauacagaaugaacccauauuuuaucccauuaaagagggcuaacaaguguccuaauuguagacagcggaaugggaucuuccuaaggagauugcuccaguaucuuuuugagugcuaugauuucgcagaggagaggggaaaggaaccuugccaaaaagcaaagguagagggggacuuggaggacacagaacaccaauuucacugaaaacacaauuuuuuagcauugucaucacucaaagaaauuggauuugggcuaauaagguaagacuaacaaaauuauauuuguuuagcuauugucacuuuuaucucuugaaguaaacaaacuuuuuuuuaagacucgagacgaacuggaaaacuuuauuuuuuguauuuuucauuugugguuuuucaaauaauuuuuucuuaagcauucaaugauauuaccuuaucuauauugauuacuguacaaauuuuaggcuuuauggaauuaauaaucaugaccuguguuucacaauucuuguuuccuugucaauccaaaaaggaaugcucauggccuguguuuuacaacucacgaauuauccauacaguuuucccauguggaacagaauauguauuuuaucugguauuguuuaacugugaaaauaugugccaaagauuaucuauauauccuuugaguuacagauagauaacucauucuauucucauuucauaaugaauaccuaaguucaaacacauucuaggauaacaacugagaugugagugacuucuacgggaaugagaugaucaaacuguauauauuuuugccuuuucaaaaauaaaauagcuacagaaauucacuaguauuuuuuaaauaauggaauuaauucuacuuuaguuuuguacaauuauccuacccccaucuugucuuuguaacucaaaauucaauuuuauuugaugcaucuagugauuuguacugauaauacuaaauaaaugaugucuuugcuaagaacuuaaucucuagaaguacacugaaacagaaaagcaaaaaaaaaaaaaaaaugcagauggaaaaaaauucuuaucugucuuauuuucaguguuuaaaaugaaaaauaaugaaauuaaaaaacuuaauccucucuaaguguuacaguagcuaagacucuucuguauuaguaaucuuucuuuuacuauaucagcuuauuauaaaaaagauaaaugagauaaauuuaggugcacaggaaauggcagauugcucauccucaauuccuuuucaaaagcacuaaagagacagaauaggcaugaugaaggagcauccuaucugcaauauaagcaaaugacuggaugacucaaaaacacucaauaacuugaauacaauaaucuuauguugcuuuucucagcacuaugauucuuagcuucuacagauaguccuggauccagcacuccuugaaacauugguuggaaguaaaguuaugggcucagauuagccugccagucaauaaccuuacagagucggccuuauugauucuuuaguaauuugaccaguacaaguacaaucaucuauuuccucaagccauuucauucuuuuccacuguguagguggaggccaggcaacugcuaggaaauuuagcacagcuugcgaggaguauuuuauggggacauggacucagccaccaguagaaaaaaaaaaagcacaaacugaugauaccauuaaaauauuguugccaaguaauuauauaguacaauuccauaaggcaagaauaauggccaaugaaucuuuguaccaaagcaacauaaaaaugagugguuuuuaaauguaacauuuagagucagucuagaaucaggucuaagcucaacuuaauagcacuguuaucuucagcaccuucugaaaaaaaaaagucuuauaaagucauuuauuguuuggcaaaucuguugguguaaaccucuucauucagucucaucugagacacagacuuagguuucccacuucauagaauaaucuacacauauuccacauucugucaaagacagcuggaguucaaauaauugcuuugccaaacucgaacuccagagcucuucaaaugguagaucguuguauuccuagauguagguauuugugugugugugugguuuuaaaaucauuuauuuaacaaaggaguagaaguucagaauuacaaaaaaaaugcaaauaugacagauauggaaaugacuuuucugcaagguaagguaguaugguagaaauugagaguuuuaaaaaaccacauauguaccuggcccuaauaaauugauucaaccuucuccuuucucuuuccccagcaucacacuaaaugaaaagcuaucaugugacaaugagaagcaaaaacagauuuagauaaugguacuauuggaggcuucaccuacuucaaaagaauuucauguuuuaaaaggcacauaucaaggauaaauguaaaaugauaaaacuucucaugaagaguauucgcugcuucagcucucuauacaaacauacauuauucucuaucccucccuagcuccugcauaacgaauugcagcagagaacacaaauuaucuuucccucuaguggcagaaaagucugcaaaaugacauaucucacaaauggugaaaacaaacaaaacugacaacuuuugcugucaccuuaaagaaaaugcugugugauugagaaaguuguguaauagaggaugacuaguuugcauuuauuaacauauagcuuucuuuauguccuaaaauaacacuacaugugcaacuguagucaugcuuggcuuaacgcucuguuauuucugucuuaaaauuuuaauaauuuuauguuugagcuuggguuuuguaagugaaaucugaugggacaaugaaacaugaauuuaagcaaagaagauacguauaauauguaugccuaucagucuuuccuuguugccucauuaucauacagccuuuaugaugccacauaagcagaauucugguguagcgagagagcaugagaguucagcaagucucaaagugaguacagaagaguauuugcaucuaaaaaugacaacauagaaacaaagguaagauaaggugaacauacuuccuuuccuuucauucauccuuaguaaucaguaaagcaaaagaguagauaguauugauagaacaugcauguaucaggaaauaaaguaaaaacuaguuuugugcagcguuucuacuuuuccaguaagaaugaaagacauaugcaugucgaagcuaugaaauacaaauuguauaauuuuggugauucugcaggugaguuacaugcucucauauuugcacuuaaaacugauacuacacaauauaguguugaaugauaaaauuaauaauauuuuaaaacuuagauauuuuuauuuuaaaaacuacauuaaauaggacauucuaaaaaaucaaaguagaggaagagaucguggaagaaaggaaaagguaccuuuuauuaccuuucauggcauauuuuuccugguuuuggaacuggggagccuacauuuucaggguguuucgagucucacaaauaauguaggcaucccugaguaugaagcaggaauuugaguagauaggcuuaagguugaaaucuacauuuucuucuuacugagaacacaacuaccagguacaugggaucuggauucauuuggugacaaaauuucacuuuaacagaagggauugaguaaaauaaaagaaaaauagagugcaggacacagucucauucuuuuguuugugcucugugauacuuuucccacuauugaccaggggcuacuuuauaugaugcuuaauuguguccacuugaguuucuauuccucaccucagcucagaacugauccuugauuuccuuuuauucaacaaacaagagugacugacuuuucacuucauacuugcuuccuggaucaucuuguccacaguuaguccuuuaaaaaccaccaauaggccgauaaguuucaaaucugccuaacccacacuggaacucucuccuaugcucuaaguucauacauucaacugucuacuggaucccucccgugcaucccuuauauguccuucaagaugauuagaucuaaaucaaaaucacuacccacccauuuccacccuugccaaaguauccaucucuguuuuucucauuuucauuaauaagucuauuauauccagucuuauucuaguaagccagaaucccaggcuuauucucucuuucacccuccccauccaaacaccaugaucugucaacacuacaucuaaagggccugugaaucuucuucuuucuuucuaucagcuaugacauuugagcacgcccaucuauuugaacuggauuauuguuccuuguuccuacuauuaugccccuccaaucuauuccaacacuaugcugccugacagauauuucuaaaaagcaagaucauauaguucucuugcuaacaaaaucuuuuacuaauuucucaccaauuuccaacacaaaguccauaucuuuaauuuuucauauguauucaaguaaguccucucuauuuuucuuuuauuaagagguaaauauaaaauguguuuuauuuauuuacucuauaaacucauauaacacuguguuccaggcacuguuccaaguacuucauacauauuuauucauucauaaucuuuaaaauuuuuaauuauuauggguauguaacaggugaauauauucaugggauacauaugauauucugauaccggcauacaauauguaacaaucacauugugguaauuggguauccaucaccucgagcauuuaucguuucuucguguuaggaauauuccaauucuacucuuuuagauuuuuaaauauacaaugaauuauugcuggccauauucacccuguugugcuaucauauacuagaucuuauucauucuaucuaacuuuauuuuuauauccauuaaccaucaccacuaccccccaugcccucgcuacccuucccagcauuggguaacugucauuuuucucuccuguauuuuccccuacacuucucuauugccuguccccuuuguguuuuaugcucuguccacaugaagucauuuugauuuuauaaacuugcuugccccucccuucuccauuauuuguacauguaucuccagugucuuuccagcuaucaucuuccagccaugcuaauucuuacgucaucuuacuggacuauuagauaaccuggauaaacuguugccaaauaauucaguuuuacuggauaaaguggcuuagaguauaggaaaugucggcuuaguucagaauucauuacaauaaaauuuguuaagugcaguaauagagauguuuaucaaaugacuuccaggggaaaauaggagucaagacagauuccuaaaauggugaccuuagaacuuaguauaaaaggauaaaaugguggcaucugcaaggcagaaaaaagauguuggggaggagaaaaggccuucugugcagagcaauagaauaugcagaggcaugaagauuuuucagaauggcuagaacauccucaugugguagugggaauuaagauauaacaugauuucaaggauauuuaggaagcagaauuaagaaaacuuggugaauaacugaaugaaagaagaauaaagagaaggugagaucaugaauauacaauuucaaguuuagucuaaaaggaggaucaucaggccaaucacugagacugggaauacacagguuauuugagagagccgaauccuaaccacuagaccaccaaggagccucuauguagguaaucugaaaauauuaaauuguaggaacccaggcaaagaugaccaauacaauguuaaaauacugaacugagaguuuugagcaaaaaaauauaaauguaaggaucaucuaaaaauagauaucaggugaacuggaugagaacccuuacagauaauuauaaagugagagaagaaggacagagaauggguuccuaaggaauacgaguaggcagaauugcaguagaggaaaaggguuuuuuguugguggugguggugguggugguguuuuuuuuguuuguuuguuuuuguuuuuguuuuuuugccacgaauacagagagaagauaaugagguuucucagaaaguucacaaauacucauuaaaugccuauuaaccacacccccuuguuucuucaaucagauacuuuuaagauauuucuuuaccuagaagaauuauuauauaaaaaauuaugucuuacuuacuguacauugcacuaagagauucaucuaggcuuaguagaugauuuuaaaugacaaauauuguuuaacgguuuagccaagcuauccgggagugguauucaaaauauuuaaccacuagugugacagcaccaacaaaucagaagagauaaaggcaagguuagccuauaaauuucaugcuaagaaggaaaaggauguuuacaccaaacacuguucuuuuaguuguggaaucaaggaacuaugaucacaaaaucuuaggucucuggaaagguguuaggguggugguggggagaaauacuggaggguuugaagcugcagauauuuaugaacuguuaugguaauauuucaauacuuuaacaacuaauguaagcaaugcuggugcauagcaacugaauauugaucagucuguagagcugguaucauuacuccugagggugaauuuguucaauuauuauuuuccuaaaacuuguacccuaaucaguugguaacaaugaaggaauagaauuuuaauuaauaggaggaauagcugcuauagaggacacuuuugcagggaauggcaguuuagggaucauuugcucacuauuuauucaaaaauaccaagugucuauuuuaugucagagguauacauacuaguucuaaagaucuaaaguacaacauugugccuguggauaauaauacuauauuguacaucuaaaaaucuguuaagaagguagaucucaugcuauguguucuuaccaaaauaaaaccaacaacuuugcgucuggaagaaucuuaggagaacuaaauuccaauuauuucacauaaaaugagaaaacuaaaaucaguuauacauaagaacuuauuaaggagaaccggaauucuccaggauggcucuucccuaugcauugagucaguaauucacuuuccuucuaaacugggacacuaccaccuucaacacaugaccacuggaucuguugaagggagaaaacucaugcuaugucccggccuggaaugagcauaugacacuuucauucauagcacaucggcuagaacucagcugccucacugcuaccuaacucaggagaugccaggaaauauuauucaccaccaugcuuaggaaaaggaugaaaaagcuuucugacuagcuagucucugccacuucucugauugcaagugcgagcccugggcuuuuuuuccuguccucugaguacugaaagccugcaaaaaucaguacucaaauuaccugauuuggcaaaugcccucaaaaugaaaguccgauucaaugcuccauuugacuuuggccaggguguuuuuaccagcucauggaaguauuucugaagauaguuucaaaaauguacauaaaacuguuaguuauuuuaaguggaagaucacuccaguuucuugguguaucaucuuaugugaaauaggaggccagaauuuuguauuuauuuuguuaauuuuaccuccagucuuuuuugagucuuugauuuccaccuaucuaaauagguuagacauagauuacuauucaaagaauauucaaucacuuuggggaucuauuuccuaauuucauauuuaggcuuccuuuguuuucauuaaaguaacuuacaacaaauguuaauaggacauaucaggacaaaauaacauuauuggucuuccuccaaguaaacacugauaaacauggacaaccagguugguuguuuugagcauguuauucuuuuuaucuucaucaggauuuuuuuaaacuaugcuuccaagguaauauuuauaacugccgaacaccuuugcaccauuuaauuccuggccauaaauuauaucuucccuuucucugaaauaucuaaaacauuuccuaaacaucugauuagacuuuauuacugcuagcuuugaaguaacaguucaucuaucagaauuagccaugcaaagcaguucuuaaucuguuacuaucacggcucaugacaaugaaggguugguaucaaacaccauuugguuccagagucuggcuugaagcagcaauaaauaguuuaacaaacuuuaaauacacaaugagcuaacaugcuaaccaguauguauccaccuguucaauuuaagcugugguuaauuauaaauauuuuguacuucuuugauuucuaguaaaauuauaucucaagccuauuucaucucaugcuuuuccuggaaaagcaaucauguacucuuugucuucauguuuuuaaaucaagaguaaacaaccaccucugcuuaucauuuucagauuguuuuaaaguagguuucucccuuuuuauucuuuuugccuugcuuauuguuuacuuucuaguucacaaagcaaaguaccaaaccuggugaagucuacuuuaaaauuaguaaacaaagaauuagauaguccauaaggaaaaugcuucgguuuaaucuuugagauuuaaaauuacauugugaagaguuaauuauauuauuuuguauguauuuuuacucuaacucuguaagcugaaacaaagaaaauuugauugcuuuucugaaguucuuugugcccuuccuugaauguucauuauuccuuucauacuuuggagauuaguguuuaucuauacacaguauuuuaccacgugaaacuagaacaggcaaaaauaaauuaaacagcuugcauucuauaugaagacugcuuacauugaggcugauucaugucuauuaaaaucugaugcauacuuuauuaaauuuaaauuaagaauuucagaacucaacgacacauuuuuauuuuacugugcaucgagacacacaaaacaaguucauuuaaugugauuauuggauuaaaauaucaucuugagagaugaaaaucauuuuuucuccagaaacaauauugugaccuggcacuguuggcuucaaaauaaaaaagugguuuucacauguauuaggaaaagugagaugucccuuuauauuuuuaacagugguauauuucauaugacucagauuaugaaauuaaauguuuauaucacuauuauucuaauauuuucuucuauucauaguuuguaagugucacagcuauaauauuuuggauauuuugcuuuaaucuauuuuuuguuacccuuauuaagaaccaagucuggcugacuuuaucacauaguuuuaauauaaagaaggcggugucuaauuucugcccuuauugcugguuugaaguuugagccuguugaaggagaugagauuaaaguuaaaugccuucauauuucuccuuuugaggugcaauucugagguuaaggggauggaaaaggauggggaggcagauagaagcaccuguuuuuaguaugugggauuuugagauuuucaagucaccccuuccaggcauaccagaccucagaugacagccuccagaaaaaucucuacucacaucucuuuaacaccaagaaagggauggugacacagaaggcaggaauagauaugagcuggaggcagugcuucugucugacuguauuucuuuucuuuuuucuuucuuuuuuuuuuuuuuuugaggagucuuacucugucaccuaggcuagagugcaguggcucaaucuuggcuuacuguaaccuccgcaucccacguccauucucccgccucagccucccaaguagcuaggauuacaggugugcaccaccaugccuggcuaauuuuuuuguauuuuuaguagagaugggguuucaccauguuggccaggcuggucuugaacuccuaaccucaagugauccucccaccucagccuccuaaagugcugggauuacaggcgagagccaccgcgcccgaccucugacuguauuucuguggguaauauucagggguuugagaguuucuacaugcccuagaccaggaugcaaagcuucugagacagccagagguccaggguucaggacaaagaggcuaccacuugcagggauuucucaaauagggacaagggagcacaaauuucagagaggacacagacacuaagaaaaaugcagauggaaccagcugcaucucuguggucuuuacaugcagagcuggccagaacaggcucucuggcccaauaacucuccccagcugcugaaaggggugaguaaacucaugccccuacuugguguccuccuaagggugccaaugggggcacagugagcacuuauaagcaaagagacuauuugggccaaaccagauguaauggcagauuuaaagauacucacacccuauauucuccuuauucccgugcuaccuguuguguccacacuauaauuauugccuguguuuuguguauuuauguacagugugaaauguuuguaauccuauuaauauauaauagauauaaugguuagguuaaagguguucuguacuagagccugauacuacauuccuuuuaauaaaaguaaucuuaaauuaccuccuuaaauuuuccacucaaaacacuauacaacauuuaaauauguacaacuagacucucccagaaaaucugaaacucagaauuaacugucacauuaacugaccagaugaguuauucaacucuggggcaacucuagcucuuaaaaaaauauuuuucuagcacugaauugaaacuuucuuuuuugguaauuuuacuuguaaucauaguuugcccucugucgaagugcaaaauugaccaauggauacuucucuugauaagauuucaauauuugaagacuaucuuugugacuaucaaagcucuucuugguggucggguacagugacccacaccuguaaucccagccuacugggagguggaggcaggaggaucacuugaagccaaggaguucaagaccggccuggucaacauagugagaccucaucucuacaagaaaauuaaaaaauuagccaggucguguugcauggaccuacaguccaagcuacucgggaggcugaggcaggagaaucauuugagccuagaaguucaaggcuacugugaguuaugauugugccaccauacuccagcuuuggugacagaaugagacccugucucuaauaaauaaauacauaaauaaaagcuuuucuugaagcuaaacauccagguuguuacuuguuuuuguuuuuuuuuuuugauggagucuugcuuuguugcacaggcuagaaugcaguggugugaucuuggcucacugcaaucucugcaucccguauucaagcaauucuccugcuucagccucccaaguagcugagacuacaggugcgcuccaccacacuuggcuaauuuuuuuguauuuucacuagagacaacuucucaccauuuuggccaaguuggucucgaacuccugaucucaagugacccaccugccuccgccucccaaagugcugggauuauaggcgucagccacccugccuggcaccagguuguuacuuauaagacaauauuugaauuccuuguuguccuagguucccuuguggcugguuagcaccugugagaggaaaauggagauuuugaauuuuauaugcauuguugauccagaaguauuauauaagcaguguuuguauuucaauguaugcuuagcagcgucacacgggaucugcugcugaggggucacaaacuaguggcauaauuuccucaggacuguguagaauuguuagucaacagaauggggcccugaaaauaaugacuguuuccucuauuucuuacugaaacauaaauucaugaugccauuugccuaagcaaaagauaugggaaccaaacuuuccuuugucaugagauuacaugaaaucgauuuguacuagcaaugcugaaauucuuuuccaagaaucuaaauauauauaauguuucuauauuacuugcuuuagucaugaaauauuuauuacauaucuaccacaauuaggauaugcccuaggcacuagacaaauagccauuaaaaacagacaaaaucccuguccucacagggcuucuauuccaacacuguaauggaauuauaaguaacuuuacuuauaacugcagauauuuaugaauaaaacuagccuauuuauacauguuauuauuacgugaauaaacauauuuaaacuaauaccuccuugugcauuuuaaacaauccucacuuaagucaugcuucaauaaauauacuuaauuuggagauauauuaauaugcuauaauugagaauacagaauuuacugccauaaaauacauaaagaagaauuagguuuugaaguuaauuauuauauauaaagcauuuugaaucccuucuuuuccuucacgcaaggucucuucuauuuuuauuucaugaucagauuauuuuugucuucuauguaugggcuauguucugccacucuaaauaaugauacuaauauauaagauuuauacuaaggucucaguguaugaguguuauuggugugccauuuaugaaguuggcaguaguguuauuucuacuuugcauuugagaaaacauauuuagaaaaguuaacucacuuauucagaggcauauggcagaugucagcuggguuuuaaucauggucagugucauuuaagcauuaggcauuaaacaauuacacuccuuaacuuuguacgcugccugguaugccacacaucauggcuucuauccuuccauauuauucaauuuugucacaaacaaaagauagcaaccacuuauucauucagguaacaccugugaagcacuugcuauguaccaggcauuuucaaaaugcuaguaaugcauccuguagugaaccaaauuuacauaauccuucuauagagaaauccaguuuccuggauuccugucuuuaggaagcuauaauuaacauuuguaaguacaacucaauaaacauuuaaaaguaaaacauuuuaaaaugauguuucaaggcaaaauauaaauaccuucccaguguuucagaucauaaggaguguaaauaguaaaggguuaaguacuuauuuaaugucuuagaaaagagcacuggaguagaauggaaauaagauccuauagagaagacaauaaaucugucuuuuuucuuuccucccuuucaucagggccaccuccccuucuguucugcuguugguggugaagccuggagcaaucagcuaauggcucacagcaugaagcaagcagccuuaauguccucucuucccuccucacacauccuagaagcaguacuucaagaagugaucagcauugugucacauuucuaguuucacuauuucuguuuuuccaugaguauuaaauuucaaaaaaaaguacauuuucuuuuccaaaguuugaaauuaaaaggauugcuuugagauuauauuuaaucugaguacacauuuuucucauacaaagugucaaguaucauguaggucaaagagaaaauauuugaucauccauuaguaauuuuucuagaaugguaggcauuaagacuacaacucacuuguugauuuuuuucccugcaaauaagaaguauaggauuuuuguuuguuuuuugauucucucugcugcacugauaacacuguagguuugaauauaaaugccuguaaccuuugacuacuuuuacuuaaaagucuauucuuuauucuaagauugguauucaaaauuacugaaaaaauuccacuugaucucuuauaaguacguuaaaaaauucaucaaauuucauuacaguaaaauguuaaaccaaaaaauauggcauagaccuuuacggaauacauuuguauucaaucucauuauauuuucaaucauucuacauucaaaaacaaguuucccuucuuuucaguuuagaaaauuauguaagaauaaggaaguaaaauacuuagcugcauucccaauacccagauuagaaacuagcauaugguaaauacucaauauuuuuuaagugagcaaauaaaugaguuaaaagccacaaaugaaacauauugaaugaugucuaguuaaucccaaugaaaagcauaguagcugaacaagcauuacaaaacauuuuauuuacacacuaagugcacaauauuuauaaguauaagauuuuuuuuuuuuuaaaucacuuagguaccuguaguggcucuuuccuuuaacaaccucucccuucccucuucuuuccuucuuucuuucucucuuucucucucucucucuccuccuuucucucuucacaugcaagugcacucacacagagaauccagaaagacucuucagaugcauuaucacucuuugugcacauggguccauugaauuugaacguaaauuccauuuuaagaagaucacacaugaaaagcuuucauuccucaaagaauuuccaaguaccaugcaugauauuuuucaaagacuggguuuacauuagagcuuacaggaugcgcuuucaucauugacucaauuuuuaucaaaauugaauugcccucuuaacuuuauuuucaaaucccuugauuuaaauucuauaccaaaugaaaguccaaauacacugccaaauagaauuaacucucgaugucacuauuaguucaaauauaacuucaugaauaaaauuagucugcaauuaauuacaagaauauaaauaugcgguuggguuuuaggugguuucccugacauaggggaaauguggaauuaaaauauuuagucuuaggccuucuacauaauucauacuauuccuggagcugagugaauuaucuuucaagggugauuuaaucuaauuuaaaaauugaacaaauuuugaacugggaauuugcuugcaguuuucaaagauauuguguauauauauaccuuugucuauuuuaagcauugagggaaaagaggaggggcaaaaacuagagagaauauaauuacauaacugcaugacauucgaucaucacuacagacuauaaaguguguguguguguguguguguaugugugugugugcaugcacaaauuuggggcaugaaaacccugugaaucauccauuaagaguagaccaggugcugugggcugugguucacaccuguaaucacacaauuuugagagguccaggcggccaguucacuugaggucaggaguucgagacaagccuggccaacauggugaaacgccaucucuacuaaaaaaaaaaaaaaaaaaaaaaaaaaaaaaaggaaaaaagaaauacaaaacuagcuggguggggugucaggcaccuguaauuccagcuacucaggaggcugaggcuggagaacuugaacuugggagauggagguugcagugagcucagaucacaccauugcaauccagcuugggugacaagagugaaacugucucaaaaaaaaauaaauaaauaaauaaauacaaauacaaauaaauaaauaaaaaauaauuaaaaugaaaacaaauuaagaguucaacuacuacaaugucuguuuucuuuuuuucuucccuccuucauuuaucuagucaaaaaaauaauuacugaauaccuaguauguguuagacacugcucuacgugcuagaaacauaguaguaaaaagcaggcaaaaauucccuucguaacagaguuuucauuguagugguuggagggaaagauaauuaacaaauaaguaacuaaaauauauggugcaacaugcugugauaagcgcuacaaagugugggugaucagagaugggucucucugagacugcaacuuuuaagaccugaauagcaagaaggagccagccagguaaaaacuaaaauaaaaagcauucugggaagagaaaacggcuauuguaauguccauaugugagaaacaagcuugguaugaucaaggaacagaaaucaggucgguaaagguaaagguagaugguuuuguuuuggccugugguucagauuuuaaggcucauccacaaagaucccacuguucccugauacuuugucuuugcccuugucucugcaagcagaugauuaauguugcuuuuuauggguacuccagcaaauguaucauuuuggacuuuuauugggcacaaagcacagaaaguacaccauuucagucuccaguauuuugaugaagaaauauuguuguuuaagcaacagaagccauuuauuuuuaaauauuaaaacuaugaagaaacccugguucugaccugauuuggugauuauccugucauuuauguuuugcuucugggcuuuuuaugacuuugggcuauuucugacuuauucaaguacuuagauuucaagggcuaauuccuacacaugaaaauucucaccccuuacuaggaaccacagguugugccuggcucuccugaaucacagugcaucucucccaccugcuuuguagagccaaaggcccuuauggacugcaguuauuucuauucuuuguuaagcacaggauuuggugucagaaaagccucagcuuaaaaacuagcucugaugcuuuucaauuuugugaucuugggcaauuugucuaaccucuuugagcuucaguuuucuccuuaaaaauaaucacaacacauaaugagcuuaugcacauaaagaauuuagcaaacugacaaguaacaggacagcacuuaguuuguguuggcugcuacugucaucuucaucagcuucaucuccaucaucuugagucucuuuuauuuaaaauaguuguucgcaaaguguggucccuagaccagcaauaugagcaccuccuggcaacuuguuagaaauguaaauuaucuggcaugacugaaugagaaacuggggugcggcccagaaauccauguuuugcccaacccuccaaguaauucagaugcaugcuaauuuugcauuagaggaaauguauuacauuauaacguuugucuuuaguuguucauaauuacauuccuaagaacugugcuggagugaguggcuuagaaauuuguaauguccuuuaagaaaaacuucuuaaaaucuauauagaaaaaaaaaucacuuagaacauggcucauaugcaaugcaaauaaaagauaggcaaacgaaauguauuuugcuccccucacagauaucuauguuguguuuagauguuagaauaauccucugaaaacucuuagagcagucaagguaggucauaauugcuccuagaaagucuucauacuuguuucaagucuuaaauaaaugaaaauuuagucauuaaauaaaacaguugaguuuaaugauauaugugauuuuuuuauaaauuaagaaguuagauauacuauucuaaaguggaauguaauaguguaauaaucaaucuuauaccaaauuuucaccuucaucaaaauucaaacuucuuggcugaagaagcaacuaagauuuacaugcacaugcaacaugguaggaaacuucuuuucuacaauuuuauugaauauguauaguuuuaucuccuuuauuccaugccauauuggccuccuauauaaagaugauaacauaaguggcaucaacagagcauauucauauucaggacugucacuaggaugguuugauuuucauggaaacuguuauauuuaugaaauaauuaacaaggaacauggugauuaagaguaaaauauuugguuguaaugcaaaauaauuuaaucuaaguaguguguccuuaaguccuguuucaacaagugguuuuaacauauauuuauaguugcagaacauuuuuuucuaaugcaaucugauaagaaaauauauagaauuaauucagcuaauauuuucuuagauaaacuucuacagcaaaaggcagauuugcuuacugccuccuucuggggcaagacaugggauuucuugcagccuauuauaaaagauuugaguuuccuaaucacagauuucucaacuguguugcaaaccuauuguguauccauuuggguccuccacccugucucuugugugaccugggaaauaugugaaaccaacgugaaugcugauacuauggaugcugccacugcuaugaaaaauaaaauucucucucuccagccuaggagacguaugucuucuuccuuuguuuauuaaacaguauccagcaaacuuuucagcuugcacauugaaccuucacaguucuugauacacauguggcaaccacagucguuguuuagaaaccucacgguccuuucagucuguuucuuuauucugacgugguugaauagcaugaaaaauaagucuuguuuaugcaaguacauaucgaccagaaaugacuguguuauaauuguuaccuuggcaauuaaaaauaacuuucuaugaucugaggguuugugucaucuccaauuccuauggugaaauucuaacccucuaggugauaauauuaggagacagaaacuuuggaagguuauuacaucaugaggguagaugccucauuauuugguguaguguacuuauaagagagacuccagagaacuuguucaccccgucugccauaugaggugacagcaaaaagaugaccacugaggaagcagggccucaccagacaccauuucuuccagcaccuugaucuuggaccuccuagcauccauaaaugagagaaauaaacuucuguuguuuauaagcugggcacuucaugauagcagcccagauagauuaauacaucucucaaugaaacaauagggaaaauuaaaagagaaguagguuuuuuguuuguuuguuugagauagggucccgcuccaucaaccaggcuguagugcaguggcaccaucuuggcucacugcaaucuccaccuccaagcucaagccauccucaugccucagccuccuggguggcugagaccacaggcacacaccaccaugcucagcuaauuuuuguauuuuuguagagauaaguuuuugcuauguuucccaggcuggucuggcugcccacagugcugggauuacaggcauaagccagcacacugcagccacaguauuuuguuuuaaauauuaaaccacaagugguacuauuuguacagauuuuccaacuguccaaaucccuuguuauguguaggaaagucaaacaagaucaccagaaacuuguaauaagcacaaacaauauucaugcuauagcacaaugcuacaaaaaaaccuguuaaaucccuauugcacaauuuucuguuaugacaggagcuuucacaagccauguuccaaagcuaaaacuaucaguaauuuaaauguguccagugucagguaaaaauguauuuccucagauaaauagauccagacuauaaguuaguuuguuuuaaucaaucuuaaaugaacuuggcagcucucuguagugguuauaaauuuuuguaaucauuucaacacauaauuuaaagacuuuuuuuuucaaaagcuuuaaagaauacccuguauaccuuaguuuucuauuuuaaguauacagacaucauugcuuuuguuucuucuuucaugaugauaucucagaggcuugaaacugaaugcugggucuuacuuccucacuuuuugagucaagguaacugccaggauaucaggaucuaggauccacuuuaucaagcuuccagguuauagcacaaaacuaaacuuauuugguuuaggaguagcucauaugcaauuuguuuaaauaaaucuuaucucaagguuaaacaagggagaaagacuacauauguaauuuuaaaucuaaaaucagccucagauaccuauuaauuaaacacaauggaaaauaaaacuaaaauauauaaugauaagaaauaauaacacaaaauaaauagaacuacaaaauaguaauaaauaacagaaacauaucaauauaguaaccugaauauaaaacaaaacuuuauauuaaaauaaacugaauuauggaaaaugggaaaacuuaaaugcauuuucuccagcagaaguacugaaacuuuguagauaaagaaggcagacaguucuccagagacuaaaacaguuugucaaaaugugacauggauauaaucuuauauuugaggugagguuuuucugugaccuuacugaaacauaugacaucucaaggauaggaaugagauccagugcaaaaacagcauuaccuuaauauuuucuaacaugucuagccauuaaguuuuauguauucugggaaccuagagcauaauacugcuguauuuaugugaaauguauugauuggcauagaccuuucaauauuuugaaauuugcuuaacaugcuacaaaguuaguaucagagaagacauauuuuauaacacuaaguuaaggugacuauacaaauuucuaucauauuuauugucacuguauccuugacuuauuuguaauguaucaguaacauuucuaauggcaacuucagaauuucuaugucagaggguacgugagguaagggguacuguauacauuggaggaauagaugaaguuguauuuuuauugcauuuacauaaaauugagcaaaugccaacuguccauaaaaaaaugacacggauuccagccgggcgcgguggcucacgccuguaaucccagcacuuugggaggccuaggcaggcggaucaggaggucaggagaaagagaccauccgggcuaacacggugaaaccccgucucuacuaaaaauacaaaaaauuagccaggcguaguggugggcgccuguagucccagcuacucaggaggcugaggcaggagaauggcgugaacccgggaggcguagcuugcagugagcggugguccugccacugcacucgagccugggugacagagugagacucagucucaaaaaaaaaaaaaaaagaaaagaaaagaaagaaaaugauaugguuuccaauggagauuaagggauggcagagacgaucaaacccuuacuuggcacauccaagauacuuuuuuuguaacuucuguuucauauuuuuuguuugcauauaucuauuucaaguuuauacuuuauuagagagcaacggcauguugcuugguuuucuuccuuuauaugcuaugugcaauuacuuagaauauuguuacaaacauucuugaucaccccaagaaggauccagacauauuuuauauacuuucauuuucauaacauuaacuguuucucauaauguuuaguuucccauuauauaauugaguuguacaauuuuaucuucugcaaguaacuacaauaauuuacagcuaugugugucugugugugaauguguguguguguguguguguguguguguuucaaaaguacagucuagggccucagugaaauaaaagacaauauuugaugcugauuuaaguuuauuggaauggaaggguaagggaaaagucuuccgggggccuuaggacguggugugcucuagaaagacacagaccaagaaaaggugauuacgauaaaacacaaguguuauaauaggacaguauggacuauggaaaagcaaaggaggaaguuucuaacuagacuuggggagaaucuaaaacagauuuguuuuaggaaacuuucuauuagcucuccagaucuaccuccaucauccccccugguuuccugaccuggcagauuaugugggcccuauggaagccucugacuucaggagguucagccaauggggagaauaauguguucaguguauugauuccccuggcccucugccugcaaauuugcuauguccuguggucacugauccucuccagucagccuuuacuacagagcugucuuuccuucugguuucagauaaccacugucuccccucaccccucuggguuuaggauuguaauagcucuuacuuuuuguguuaaccuagauaauugcauuaacauucaugucuuacuuacacccugcccaaacuuuuguaaacagauucacugugguauacucuucuugagauacuguaauuugagugugaaaucuguuuuugauuggagccugauuuauacaaccugagucuugaaggauaaauaggaaagcagagaaucucucagagaacuauaaaauguuuagaguaaaugaaagaauagcaggagaugaaaguagaaaggacuuguaugccacucugaggaguacggagaugaccauaaagaugauaaacaacugugacccgauuucagguaaaggagugaucuaaucuuacuugcauuuuagaaagauucuuuggacauuauuuaggaaggaguuuugaagggaaguuagacuucagcaguuagcaaccuaaaguaacaagccacacaaaagaaacuugggacucacaaauacuuuaagaaagcuguuggcaauggcaauagagauaggaagagaacugugagaacagugaaguugugugaggcaugagaaaaggugauuaucgguugucuggccugaaaaauugaaugacuggagguguaauuaacugagggaguaguuacagcaguaucugaagacaagauucaaugagucaauuugacaauaggaagucaggguagcaauuagauuaggguauaagaggcaaauucauguauuaaauauuuuggcuggauaugcuguaauggggcaauacagagauuuaaugaagcuuuagugguacaaacauaaguaguaaacauaaguaauagagcacaaggggcauaauauaagcauguagccauaauauucuuagguguguagauuacaacauaaauaugguacaaaaacaaacucaaauaccuauacuaaauuaagaaaaaaauucagcugagugccuuggcucacacuuguaaucccaauacuuugggaggccgagacagguggaucacuggagcucaggaguucaagaccagccugggcaacaugguaaaaccccaucucuaccaaaaauacaaaaaacuuagcagggcaugaugauauacaccuguagccucaguuacuuggggggcucagguaagaggaugguuugagcacgggagguggaaguugcaauaagccaagauugcaccacugcacuccaucccgggugacagagcuaggcccuaucucaaaaaaaaaaaaaaaaaaaaaaaacgaagaaaaaauucuugcuagacuuuuauguucaaaaucaaaaagcucaacuucaugugaauuacaaaauacaugaagaguuucugaaagaacacuuaauuuccuaauuauaauaaauuuguguuuuaauuuuggaaacaucacucuugagguagauaaauguaaaauauaguggucccacauguuuugauuucaugauaaaauguuacagaagaugauauaauuaaaacaucccccaugauauuuucaguuucauggagaugaaacucauuuguuucacguacaauauacuuuauauccauuaauauuaaagcaguacaagauagccuaaauugcauguccuauugccaucucaaaccacauacaagguucauuugugcauccuuguaccuuuuauuucuaucuugaaauccucuuucuguuuacuugcuucacuaaauagauaugacauugcuugucaccugcuuagaugauauugacagagcuguccuauagguuccuucuaggccuaaaauauuagguccuugugauauauuugugucaucucaagcagcagucguauaaaauggaagauugcuuaauauaaaaugcaaauuucucaagggcaaggcaucauccugcauaguaaucauaauaaugccuauaaaaauuauucaaauauuuauuugauuuuauguugcauuaauuuuuuccccagaaguucaauggauaaauaaacucaagcugagguuuugcuauaaccaucugcuuaagaugagcaaacugcaaaauauugauuuccuacugaaauuugagaaggguuaagcaugacuuggcgaauaucaacuggcuacaagaguaacaguuauaagcuuaauuucaucauuuagaauuuuaaacuacugacauacaguccaagauuuuaaacaauuauauauuuuguuuucucuauauguacuuacacuucuauauuaauuuuugucugccauaaucaacaacuuuagauuauaaacuaugcaauagaagaggccacauuuuucuugcuuaugaauauauucuuaaaggaaagcaagaguuuaauauuuuugguaacaagaugaaauaaguuaccuugccuuuaagauuuggauaguauuuuauacccuacugaucauuguuccuuuuaucucccugaugucuuggucaguuguggaaucaccuuaaaucacaaauuuaagucguauucacuuaguacuauaguugauucuaaacaauaaaguaucuuuaaagagauaaauuugccucaaccacagauucuucuauuguuucuccuuuagaauucauuuucuccuacauauauaauggauauauaacauuuauauacaauuuauugaaauuauuuuuauguaagauaauaaacaagacuggucaguauuuacacuauaugcuaacauuuucagugauuccuuuucauugaaaguuuuaaacuuaaagguuaaaugaaaugaauguggcaguaugacauuuucaucucauugaucuucaggauugucaugucauccagcugccucggaaggcucucuuucuuuuggauauauguuccucagaagcuuuggccacauuuucagucaaagaauaacaguaucacuacuagaaaguccacugucuuaccauuaaagcaaggacuuauuaaaaauauccaagagguuagcauucuuaggauaauuaaacacacacacacacacacacacacacacacacacacacacacacacaauaacuguuggaauuuuuaacacaggauaguuuagcagauacaagaacagccugcggaggcagauugccugaguuaaaaaucuguggugugacguuggaaaggcuauacaaccgccuggacauuagcuuauuuaucuauacaaugggcauaauaauaguaaaguaauuauccugugggguuauuaugauguuuaaaugaaccuguaauuaauuugaauaguggcauauaguuuguauuacaagauuguuaaauuuuuacaaaauggauaaaaugauggaaauuuuagcauaccacacaguuuauaaaaagcagugguaaguucauugucauuugauccacauauaauaaguauuuuguuguuauuguuggcaggauuuugauauaagaauaaaaucaaaacaccaucaugacuucuuucugaaauucacauccuaaaauugauaagguaacucuucuugguuuucuacugaaauaaaaacaaaacaaaauauuuuccugaugccacuguacaaaaauaggacuagggcuuaguuuauuuucaaacucagaucauaucuuucaaaguaaaugcuccagccaaacaaacaauagcaacaucugcucauauugaugaaaacuuuggaccaguugggagccuuuauuaauuuucaacuagaaagcagaucauacaguagaggaaggacacaaacagucauagcagucauuagcauauuaauacauuacaaaaucccaauuugggaaagauauuuuuaaaaagugaaaaaguauuaucuuguauaacuaucaaauggcacacacggaagcuuucucaaucauuucuuaaucuuggccaccaacaacugaaaacaacaaaaacuuagugcucaauggaggauacacauucagcugcucccuaauaauuguuuucaaaauagaaucucuuuguaguagaagacucugaaaaugucagagcugauugcaaacaagcaccacacaccucacaggagacugaacccaaagccuccuauuguucaggaauauuaaaagcaguuguuuuaagacuucaccgaacauuuuacuaauguguuauuaaaucaaaucuguuugcacaucauuaucuaacuaggucaagugaauacaaaaagauaauuguuuaaaacuaaugcaaaccacuuaaauaccuucuuuaguuuaugaaaguaaauacaucacuugaauguaugauugcacaguaaacccccacuuuagauauuacuuuucauuaucauaaauauaggaaagcugaauuagcuuuuauuuucagagagagcacggugaaacucaguaaaggguaauuuaauaggcaaguuucaauacgccaaacagcgaggggcaacgaggcauacauuucucucuuauuuuacagcaaagcaauaacccaguauugcuucuuauagccacuggguagaauuggugaagggaccucuacuacccaacuuccuucauuuuguucugcaaaaaauauauuccugauucaauauuaucauuauaagcuacugcaaguugcuaaaaaaucaaauuuuaauuuucauuaaaaugccuuaauaguggcugagaauauuugcauaaagguaaaaaaaaaugauguucauuauguucauaaaacugagcauagcacuuuugugaaaacaccacagaaauucaauuuaaacucaaagagaaaaauuuaaaacagaauuuugauauccagcaaguuuucuuuaaagagguuucauguugugauaguuauuaccuuagugaauucaccaccauccaaggucaggccauuaggacuguagacucagaaaauugcuauuaggagaacacuaagcaccaucccauuacucaguucagauucacauuuacaaaauucagaucgcaauucaaagccaugguacaaauuucuucauuuucagugagauuuguaagucuuucauauauacugaaauaugacuaacuuauuuucuaaacaauauucaucugacccacuuauucuuucuccacaguagaccuauauggaagccaauuaaaaucagaagguuuuuggagaaccuaaaucagaacaggggcauuagaugacccacauuuucaaugacuuccagccuaagaaguccuaauguggccuuucaaugacauauauugaaaggcauuucugucuuagaauguguuuaacugggagaugaguuaggaggcuaaugcauuaauccugcauuagaugcuaauuaaaauuacauuuuauucacccuaaaagugagacuaugcauucuucuuuuucaguugcuaugugaagcaaauggaauucuacuuuucuauuugccuaaauauuccuuaaccuuuacuuugaacaacagcuugccacaucauuauagaagaucaagaauuaaacugaaauacagucuuugacaguuuguauuuugacagguaaagcuuuggcauucuuuuuucuccauuuauaggagcauguuccuaaggcuuucuucacccgugcauagcuuucuguugguaauuaggggaaauaggacacaacugccauguugugcaaugcuguacaaugugcccagcaucugccuaggaaagaaauucugaaguuacagaaaaaaaaauccauuuaaaucuucaucuuaauucauggcaauagugagauaauugaaagucauaguaauuuuuucccaaagugcauucucaaaacauauagcucaaauucaaucuuaaacagauuaguuaaugaagucuuuauuauguaccaaauuacaggauucaucuuuccaacuuaaaaaaguaagauaguaaugaguucaacaaaggugaaaguggacauuuagaaacauagcacaaaacuaugcaguuucuuaaacucaaauuaaagcucaaaacuauuucugaagagcaguguuaucaaaaugauugaaaagacacuugggaaaaaccaaaccuauguaucaggaauaaaagauaucagaucaaauaacacaucuagcucugcucuuuuaguuuucucaaaauggcuucaaacaaaacaauaaagcucagaaauagugaggaguauaauauaaaaaucugagagagagagagaccgagagagagcgagaacgugcaugcaagagcaugcaaaggaaaagcuauaguugauggaauaguugaugguauaauuuccuucucgaaaauaaauacaaaucccuuaaugucucauggaaaguccagguuuaaccucaaaacaugaacagcaaaacuaucuguuugcuuaacagagaagugaaccauaugaaaaggaaaaguuaauuagcauucaacuaauagguaccacaacuugagcacucccaauugagcacuuuuaaaaaguaagcguuccacucauuuaaauaugcuggaaguugagcaccaguugagcgcuuucacagcacgcugaguacugauugagcuauuucgaagcacaucgagcacuuuucugugugaauucuuagccaaauuuccauacccccaacccucccucugccuacacagcugcuaaucaagagaugccuucccgguaugaaauuccuuugccaauuagaauuacauuuuagccuuucaucuuuuauguuuuaacagaauuaagaaauaauaauaauuagugaauauaugucacguugaaguucauuucuucuaaagagauaucagguaagccaauuccaucccuuaagggcccagguuaaaauuuggaaauuagcauccaugcugagaguugugaggcugcccccaaacuuaauuguggacagcacaaaggauuuucaauaguucauuccuccagguguuuaaaaucagccaggaagugaagcaaccugagaaugguacaguucccuagaucuuugcaauugugucaagguucuuaaaugggcaugaucucacccauaaaaagaaaguguuucaugcuacauaaggcaaacauuuucuuucugcucuacuuuuugccuaagugaaacaaacaaguagguauugagugccaaauuauauguagguucuaugucaaauacugaggagaaugugaaauuuacaauagccccugaccucaaggugauuacuguuguauugggaaaaauagugcaacaucccggccuauacugugcuauguuaauuucuaauguucuucuaauuuauccuuuccuuaguccagauauuuaaauuauacuuauaauuuuuuauugcagauaauuguuuauaguccauuuuuguuguuuguguuuuuugcuuauggauugaggugggaauaaaugacuaaagaacaaguuccuaaaaucagaucacagauauaacaauacugagagacacuauucuaggagacccgguuuaagcaacuaacagauguuccuagauaacggcucuauagugcuaguuguauacauaggaaaaagaaaaaacagauccauuugugcagagaugagaacugaaugucucaaauuuuauaucuuguaagaaccaggaauguuuccaacaugaagaaaugauuaauguuugagguaaugaauaucccaguuacccagauuuaaucauuacagauuguauccuuauaacaaaauaccauauguaccccauaaauauaugcaacuaguaugcaucuauaaaaauuaaaaauaaaaauaaaaaaauuuaaauaaaauuuuuaauuuuuaauuuuuaaaaauuucaaccuggauaaugaaaacaacaauauuacaaauaaauaaauauaauuuacuaguuauuuuaaccuccucuuaauuuaaaaaauaaagagauuagacuggauuuuaaaaauguuguuuuaauugggcaggcgugguggcucaagcuuguaaucccagcacuuugggaagccaagguaggcagaucaugaggucaagauaucgagaccauccuggccaaaauggugaaacccugucucuccuaaaaauacaaaaauuagcugggcauggaagcgagugccuguagucccagcaacucagaaggcugggguaggagaaucgcuuuaaccugggagguggagguugcagugagccaagauggugccacugcacuccagccuggugacacagcgagacuccaucucaccaaaaaaaaaaaaaaaaaaaaaaaauuauuuaaucuuuucauggaaguucuagcaaucagucccaaaauaccaaaaguaggcugucuagggagaggguuggucauugcuaagaaaaaaaucuuuacuuucauuuauguuuuaagaaauuuuuguuuaguuagaauuuagccaauguaaagauuaaaugcaaugugagacacucucauagaaagaugaaaggcagaaaggaugcaauuggauaagagagaacuguuucagucguucuggaauauaucguuuaguucucauuuaaaccaguuauaagaugucuacaacucucaaaaucaaguagcugcaaucaucaaucuccagaauaaauuucaccucaaaaauuuaccauuuauuuagagauuguugucugcaauauauuaggcuauauauggugugggauuuggacuugaaaaaauaaagagcucgaccucaugaaguuuacaaucuaaugacggagaacaauaaauuaugggaauacuggugauagauuuuaaagauccaaaauucacaaagguauccguccauuaagcaaagcuagaaaaauaaauuuaauuagucuguagggaaauuuaaagagccacuuuucuuuuuuuuccuuaguuuuuguuucucugguaauuaucugaaauuuucucuuucauaguaaauauaaaguaauuauuuaauucagaauguauuaccaguuuuuuucccccugagacaggguuuugcucuguacuccaggcuggauugcugugguggugcgaacauggcucacugcagccuugacauccugggcuccaguaauccucuugccuuagccuccuaagcaggaagggccacaggcaggugucaccacaacuggcuaauuuuuaaaacuuuuuuuggagacaggaucucaucauguugcccaggcuggucucaaauuccugggcucaagugauccacccacaucagccucccaaaguggugggauuacaggcgugagccaccacaccgaucuuuuaagguaaaauuucauuuugcauuugggucucccgccugucuaauucucaaccuggauaauuaaaacaacaguauuacaaauaaauacauaugcucauguuuucagccaucucagcuaugucauucuaugucuggcagccugaagggcuggcagggugggaaaagauuggucaauuugcuuaaagagcuuaaucauaaggaaauauaccuggacauuuggggccugacagcuaauugcccuaguuagauccacuccaucucugaacaauacgauccaaccuucaaccucacuggguaccaucugaaauggaacaccccaaauuuguuguaaguucuaauuuaaggucuaaauggagacaugacuuugagauacacccugccagguuccaugugucugagugccaaacaucauggagacaagggcugcaaaaaagaauagguaaaauaaauacaagaucaucagcuuuucuaaagggaaacugacuugacaaagggugcaaugauggugaaguaagguuuaguguugagaugccugggaguguuguuggguugcaagagacauuuuacuguauuaaguaggcccuggauugugauauuggcaacagcagagugugaggaugaauuuuccccuaguagcacuagucuccaggccacauuuggagcagguggaucaucaacauaaaaaucucgaugccagaauccuugcggaaaggggaaaagaaaugcuagauucugaaagaccugggggauccugcacuauuaguuuagaaaacaacaacaaaaacaaacaaacaaacaaacaaaaaaaacaguauuucaacauuaagcuaguuggaggacauugccaggaaauaaauaacccuauucuuauuauuauuuucaacaacaaacaugucucagaaaggugggccaagaaacacguuacaguuuaaaaugcaauuaaguagauguacuaauugcuaaacuucucaguuacuuauaauaaaaaaguuauuuguguggugugugguuaagcuauauuuguugccaaauuucuccacucuccuaguggcaguuauucugaauuuuagauaguuuuuuaaaaauauaaauuuaauguccagagaagguuggacugcuagguugauagguuuguuuguggcuuuaguuugcuuucauggcaaucaauauaucuugagaauacaaaccaacacugguagaauagggaauggauaauuuaguaauaccaugagguuugcaauucccaaaacaguuacagaaaugcaaagcguaaguucuacucaucaaauucggagucucuuuugaaauucuuauuucauuucugcugaaaauuugugaauuuuuuuguagcaacucuaagcucaggucaggaucaccaugggaguuugaaccaggaugaacauuuauuucaggucucccagaaaaggcaaacuuguguuugcuaagaaauaggcucaugccgcuuucuguaccucagguuucccaaguuuccauuccugcuccucuucuuagcccugauuaggacaguuuagcaaugagggaaucaucguugccaucuguuuucucuacaaguccaaugggagauugauugacaaauuggaucucuuagauuaaaccaccauuaacauuucucuuuuguucugaaaauucacauucagcauauugagugaucuuaucauaucaauaauuaaauacuaucuugugagccacuggaguuccaauaauaauuuccauauuucaaaauuucuuuaugucagaaaguauuuauucaaccuagauuucuuucuuccucucucuuuuucucucucuaguauaagcacauacacuaaaauuaauccauuuaauccaaaaguucuguucuucucuaugcuuaagggcgaaauaugacaaaaauccauaauccugaccaauuccuccauuauauuaugauaccauguaauagauuuuacugauaaaguucacaguacaagcucgccuuacaaauaauuuagugggaguuaggcauacugacuaccucuuaugucaugaauaaaagguuaaguugacuuuuucacuuucacuguagagcuguaaaaccaauauagcacguacuguuguuuuuuuuuuuuuuuuuuuuuuuuuuuuuuuuguugcgggggacaaggucuuacucugcugcccaagcuggagugcaguggcucaaucauagcucacuauaaccuugaacccuggggaucaaacuauccucccacaucagccuccagaguagcuaggacuacaggcauguaccaccauacccagcuauuauaacuuuuaauuuuuuuguagagauagggucucccuauguugcccaggcuggcuucaauugcccaggcugaguucaaacucccaaccucaauugauccuccugccucagccucccaagaacuagaauuacaggcaugagccaccaugcccagccuagcacacuccguacuaguaaucuaaacuugguuuugcuauuacucacugugugaccugaaacuacuuuuacaaccucuguguaucaaucuccucagcuguaaaaugaggcuaaacuugcaucuauccccuagguuuagugugauaaauacauguguacauauguaaaauacacauacagcagugucuggcacguaaggaaaacacaauaaauauuagcuacugccuuuagcaacuacuuuacaguguugagaaucaagucauuucuugcugucaauuaguuaugcuucucaguuuauguauauguucauuucuuuuucuuuuucauuuauuuuguucuaaaaaucguaagucaaaaggcaaucuagcacacucuugucccucagauggcauguucaaagaccacaacacaaacuuacugauuaaaugcuauuuuagggaguuaaaugucacuuggaaaccaaguaacuccaaaaaaaaugcauuucaugaugaacauguuaaaaaauaguauaauaacuucgcaagugaucacuaagcaaacaaaaaauaaaaugcaaacgaucuaccuaauuaagauagacaaaugcuuauacaucauuuuacaaaauuuuuauuugugaaauuaagauacuguucuaucuaugccauuggguuuuuugaggauuauaaguguuaacuuacagagugauuagcagugucacacaacugaaagaaccuaauaaaugcuagcuagcuauuauuagugguaaagugaaaaguaauuaucauaggacagcaauaaaaacuucaugagaacaaaaauuuacuguuucagaauuaaauaguuaucuggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaaccugggaggcggagcuugcagugagccgagaucgcgccacugcacuccagccugggugacagagcgagacuccgucucaaaaaaaaaaaaaaaaaaaaaaaaaaaaaaagaauuaaauaguuaucaaugacugucaaccagggauaauuuuaucuucuaccacagcugggguagguauuauugacaucuacuagguacaggcagaugcugcuaaacauguuauaaugcacaggacaucugcccacaacaaaaauuaucugguucaaauugucaauagugccaagcccaagaaacuuuguuuuagguaaacacauuuuuguuuaucucuaaaguauuaugccaauuaugccuucuuuugaacucuguagacuauuaugaauauauaaacaaaauaaagagaaaguuagguuuuuccccucauuaaaacuggcaauuugaaaaaaaauuaaaaauuaucacuggaaacauuuccaaauuagagaacauguagucuaacuauaauauacuaaugcuaauuaaauaauagugagugaaauuuaaaaugcaaauauuuauuagguauuaaacauuuaaaauugacauuauuuuuauucacuaagaagacuaaaaacagaaugauauaugaagagauguggauugaagaaguuaccuacuuggaucaguagauguacgucucacaauucuacauuccuagaggacucaugugauugggaauguuauucaaaauauuuuuaaaacucuguaaaacagccacucagcaaucaaauaggacaucuuccaugagaaaggaugccugucauaagcagugaagagagcuuuauaggugcacaccugcuggauaucaauccuauauguaagaauuuauggauauuaaacuuaagaauucuggucaguucuaaacccacccuucaucuuucacuuuuccuuuuuaauaaggauuugcuuauucauuacaauaauuuuucaaaauuaaaguguucaccuacuucuuacauuuaauaccaguguucuuuacaggauauuuaggcuauuaaggaacaaaacaagaaucacgguuaaaaaaaaguaauuucuacacaauaaauuuuaaauggcaauuuacuuuugcaaguuucucaugauaucuuucaaagugaaguuuuuggccgauuagagagggcuaauaaucugacuugaguuugaucaagcaauauuggaaguaacaacuuauuauguuucaacuagccaucaauuaauagcuuuuaguuuuaacagaauaaaauacugaauagcagauauuauuuuauaacauauauaaauauuauguauauauaucagagaaucagaguuaaugaauuugcuuuuucaaaacuucuacauuuauuuguguauaaauguauguuuucauauauauacucuuucaugccaauaugcaaaacuuugcauagacauggguacauuuauauuuaacuuuauaaggaggaucucagauagcuuacuaaaaaagacauaugaaaaaagugaaauaugauuucaggacccaggucuaacgugaauuuuaauguaauaagcauugauaaucugaauauccagcaacauacugauauaucaaugugaaagauuuagguaucuuggcuauacucuagcucuuaccucaaaaaacaaaacaaaacaaaaaaacccagacuaaaguauuucuaacacuuuucuacaaguagaaaccaaaaagaaauuuugguauagucuacaaggcacuaaaaauuuaauuagccagaacauuaaaggaccucuauguucaugaaauuuuacuauuggauagacacauauaaguuuaauuuuuuaaccuucuuauaugcuacaggguauuuuuuucauucuaauaacaauggguuuuguuaggaaaagcaaauugaccuuaauuugcucugucaagacaguuuuuucccuccuauuuguauuauagugagaaaaagucuggauagaauuguaaucuagagagacuaucuaauuuuucaacaaagcuucaugggguggcauuaccguaaaaucugguucucuacaaaacuaaaauauugauuuugucaguaaguauuuaaggaauugauuaaguucugggagacugacucauacuaacccagauuggcaaauagguucggacuccagugcuaacuaagauccauuugcuauagcugcucaguacagcagggcagauagugguaaucuaugguuuuggucuggaaauggaauuaauagcacuuguagcauguauuugccauuuauguacuaagcaaauuaaauagaaaucagcauauaaauugcuaauuuauuuauuugcaauaaauacaucucucuagugcuuagaaugcaugagcucacuauucuccuggcuucuuaugucauagaguaggagcagagcucaaagaggugcauaauuuugaaaaucauuuuaauuaaaucugaugaauugugccugacauaccacagagaauaccuucauauguuagccuguccuugccuuccaugacuggugucuucucuaagcagcaauagacaaacacugccaaauucccauuuucaaauuuaucuuuuuuuuuuuucuuuuuuuuuuauuauacuuuaaguuuuaggguacaugugcacauugugcagguuaguuacauauguauacaugugccaugcuggugcgcugcacccacuaacgugucaucuagcauuagguauaucucccaaugcuaucccuccccccucccccaaccucaaauuuaucauuagguccagucuaacuacuccguuuguuuuugaaucaccuguauaauuucauggagggaaaacucaauaaaaauuuaauuauuuuuggauucauuuacauucuagacuugcuuugagaagacuacagcagguuaugguaagaauuuuugaaauggucaagaauucucacuuacagcagaacaauaaaguuuugauaugaauaaccuagggauguguaacucauacauugccaauagacuuuauuugauuagguuucagguagcaacuuuguuuucuuuauucucaagucccuuuaggaguagagaggaguaauuuaacugugucuguucuuaugguuuuauuauuuugcacacuucguguuuacagcauuuuccuuaugagucuauaucccuugggguauggaaucauauaccauucauuauuguauucuuacagcucuucccacacugacuugcauagaauagcuuuaaauauauuguuugaauaauugaauaagugaaaaauggauuagagaaggauuucaauuuucuugucuugaagguugaagcaacugugauuuuauauuuaaaauaaugguacaauugucacaaauauucagauauuuucuuguuuuuccacaauuauucaaauuauugcuuggauaauaauucaaauggaauggaauaaaaaugauugacuuauuuaagaacuuaguauaaaguaaaaaccagcaguagauguugcagucaaaaauuauuaaauagacuauaggcuguuaggagaaguuaguagcaaacuguccaccaauaucagugucccaagucaguggucacaagagcgguaauuugggucuguuuuauuuggaaguuuagacucauuggaaacccguucuuugcuuaguuuccauguucagagaaaccuucugcaaguuaaacagcucuccaaucagaaaagaaaaacuugaugcugucucaggccucauuaacagaagcaagaacuaucauauacaauuuaggucaaacgcaaaguaaaauaaauuuaagacuuucucaucaaaaaaaaaaaaaaaaaaaaaacccacaucuguggauugacuaguaacagagcugccuuucaauacaagcuuauaaagcuaaaguuaaaacucagauuugagagcaguuuaauaauaauugauaaauacgauacaaggaaauauaaacuaaaucagggaugaaucagugccuguuagagauuuguuuuuuuuuaagccaguuauuuuuuuucuuacaauuccaugcaauuguaaaaacuauauuuauauggagcaguuuguuuuugagugauuggccacuaucugcuacuugaugacccauaacuauugggcccauggaaagaguuacaacuuuuaccauagaauccagcaucacgaacuuuugugauccugggaucacaggaagauucuuauuucaauuaauucaccaguauaaccuuuccuuuucuucuaaagucaugugcuucauauuagaaaauaauauauaggucauagcaauaggaugcaguacagagauaauacuuucaaauacacuaaucaacucccacuuuauuaauggguauuggaagcuucuauuauucuuuccauuuagacacacugaucuuguguuaaaaugaaguguucaccauauggaaaauaaaauguaucuuuaccuccacuuuacauuaugcaaaacaauuaauuucagaugaacuucagauuuaaauguaaaugauaaaacaaguuucuagaaaaaccuuguauguagaucuucaugauuuuggaguaagaagcauucuuuuaaaaaagacaaaaaguacuaacuacaaaaaauguaauaauuuggacuacauuacaaauaagaacuucuguucaucacuauuuacagggugaaaagacagacagaagagaagauuuucaaaauacauucacuugacaagagacuuuuauccauuauauucaaagggcuucuacaaaucaugaggggaaagaaggggggacuauaacuucaacaggcacuccauaaaagaaaaauauccucgaagcaaauaaauauacaaaauaaaucauccaucagaaaaaugcaaauuaaaaucugaaucuaauauauguccagcaguuaaaauaaaaugaugacgacagaaaauaacaaguguuggugaagaaacggaaaauuggaaugcuuucaguuacuacuucaaauaguaaaauugguauaaacacuuugggaaacuggcagcaucagcuagcauuaauauguaacaugccuuaugcguacuccuugagcuagcaauuucauuccuaaguauauacucaacaaaacuacagacauauccaaaaagauguauauagaaccccuaucuguaaugagcaaaacuguaaaaaaaucaucaacagaaguauauaaauucugucuuauucauauaacaaaauauuuugaggcaaucaaaaugaaugaauuuuuucuacaaacuucaacauggaugaaucucacagauauaaugcugaacgaaagaaagacaaaacaguacacaccguaugauucuauuuauauacaguuuaaaauuaaucagaacuaguugaauaguguuaaaagucaggauaccuuuggggagaucuuaacuggagcgugcaugaaugagaaaucugggcaugcuaguuauguucuguuucuugaucuggaugauggucacacggaaauuuguugaguuguaaacuuauaugcacuauauuauaauugcuucaucuuuaaaauugugcauuguauaaugucuccaaauaauuuauuuuagaaaaaaaugugucauuuaaauaacuaucacagcaauuugaguacucagggcacccuuuuuauuauuauuauacuuuaaguucugggauacaugugcagaacgugcagguuuguuacagagguauauaugugccauggugguuugcugcacuuaucaacccaucaucuagguuuuuaaauuuauuuuaauuuauuuuauuuauauuuuuugagacagagucucgcacugucgcccaggcuggagugcaguggcgcaaucucggcucacuacaagcuccaccucccggguucacaccauucucuugccucagccuccugaguagcugggacuacaggugcccgccaccaugcccggcuaauuuuuuguguuuuuaguagagaugggguuucaccauguuagccaggauggucucgaucuacugaccucaugauccacccgccucagccucccaaagugcugggauuacaggccugagccaccgcgcccaguccccaucaucuauguuuuaagcucugcaugcauuagguauuuguccuaaugcucucccuccccuugcuccucacucccugacaggcccaagugugugaugcuccccucccugugcccaugugugcucauuauucaacucccacuuaugagugagaacaugggguauuugguuuucuguuccuguguuaguuugcugagaaugaugguuucugguuucauccaucucgcugcaaagggcaugaauucauucuuuuuuauggcugcauaguauuccaugguguauaugugccacacuuucuuuauccagucuaucauugaugggcauguggguugguucuaagucuuugcuauugugaauagugcugcaagaaacauccgugugcaugugucauuauaguaggaugauuuauaauccuuuggguauacacucaauaaugggauugcugggucaaaugguauuucugguucuagauccuugaggaaucaccacacugucuuccacaaugguugaacuaauuuacacucccacaaacaguguaaaaguguuccuauuucuccacauccucuccagcaucuguuguuuccugccuuuuaaugaucgccauucuaacuggcaugagaugguaucacacugugguuucaauuugcauuucucuuacgaccagugaugaugagcuacagaaugggagaacauuuuugcgaucuguccaucugacaaaguucuaauacccagaaucuacaaggaacuugaccaaauuuacaagaaaaaaacaaccccaucaaaaaguggguaaaggcuaugaacagacacuucuuaaaagggcacccuuuugaugagugggagucauucuguaucuacugagauaagcuaccuucccuuguuuccuaaaucuuuccaaaggcuuauuuuugggaagcugcauacauauuugaaauauguaacuuugccuuuuuguuguuugacagccucaaaguucuuuuuuucaaugaaccuaggguauaguacaauacaaugaaaacuauuucauaaaguauguuuaaggaauacaagauaauaauaaccuuuucuuacugugaaauaaaaggaugucauggaacaguaggguuccuuucugaaaauuugaagaaaaaauguaaauuggagacaauaucuauugcuguauaaauaguaaaacuuccuccuuucaaagaauuggcguaucuucucaaacccaaacacuaaagaccauggccaaaaugucuaauuuauauagaauuuuuuuguauuguuucuggaaagacuauaauguacacagcaacaaaugcaacauuauuccuauauaaaaacauuuuuuucaaaauaucauuccaaucuauauuuaaauaaaaccaagugagcacugcuguuucacuauauucauuucaaggacacuuacagauauauuguguaacaauuuucugccaauaucacagcagguuuauauacucagcugcacauaacugcaguauuuuucuuaaagcuuugauacucuugaaugagagguggagcacuaaguguagacauuuaauguauuaaauuucuaagacuucaaagggagcauaauuaacucaaugcuacauaauuucuccagggacagaaaaaaaagaaaaagaugcaaacagaauugauaugcuuauuuuuccccuuagcaauuacaugacaaugcuaagugagcaauuucuuugauaaaacucauucuucugacuuuaaaguuaauauuucucuugaauauuucaauaacuuugcaugcuaacuuauaaaguauagaaaacaguaggguugaaaguucugcuauuccccuuuuaccagaauuucuccccucaacuucucucuguuuaaggcacuugcugaacuugguugugucucugaccucaucauaaccuuuaguuucucugucuuuccuaauuucucaauccaucaguuucuuuccagcuucauuugccuuucuaucauauaauccaugguaagccguuuucaauaaauucuuuucagaugcaaaaauucugcaccccuuugaccugcuaacaaccuauuugaccaguuucaaacucuggguguccucuacaaucugcagaggugcagaacauagcuggaggaaguuagagaagaaugugaguuagaucuagagaggccuuuaauuuauucaacuauauauuuggaauucaacaaaauauuacauauuauauuuuucaaaucugaaaugccaugauuuaauauuguuucauaaaaucuauaaaaacuggucuuaaacgucccuuaucauuguugagcuuuaaucucuaaaaaucugaaagaauauucuggaccuuucaacucaagaaaguuaaaggagaugacucccagagucucaugaaaauaugaagaauugaauacguauaugagccaacaaccaugagaaaaggaacagaggccaucagaaaaguguuuugccuaaauuacugaaaaauaaaaaugaagcagugacgcuugaucagagguagcaaugauaucuggugaagcaggguggcagaagccguagacuacagacugucauaagggcagcaauuaagcaucaagaccucuaccugcagagucauagaagucuugauaguugaaaaggccaaauaaaagguaggugugagauggagagcucaaaauaugggaacauagaggauucuugucauucacaguagcgagguucuauaaaauccuaugaaugcuguguuuaugaauacugaaucauugcuucuaggggaaugguuugguucuuuguaagccucugccuuuuuuguauuuauauuuaaaagcacuuuauuuaauaugcauugcugauucuuuaacauugaacucguggccaacagcacuauaacucuugccuauacauagcuuaucuaacacaaguauuuucugugugaugcacaucacagcuuucuugugcuuagggacacuagaccagcacuuuagcacuauguuugggagauauuuuaaacagggaaaucacugaugaaagcacaaaaaauugaaaaaggcacuaaauaaauagauagagaaaagaacacuugcuugucauagaggagcuaaaacaagaaugcagagagcagcuuuauuugaccuuaauuacuaacaacucaaguuuuugagcuaugcaaauauaugaucaugaaagugcacugaguauugauuuuggaauuacaaauaaagcuuaaugaauaggugaauuugcaaaaaacaaaaucaguuaauaaagcagacugauuguacguaaauguauguugauucucacaugcugucacaugcaaaauguuccugaaagcugauauuuaucccuugaaaaaaaaaguaagaagcauaggauucucuucuaaauaaauaggugaauuuucuaggugaauuggggcaacuaaugucgccauuauuauccaagagcaaggcaacauaaauacacaugcaaaagcuagcacuaccuccaguaaaauaaccauauccaucuucuaucuacucaaucuaaaugaucaaauuaccauuauguaauaaauuaaugcuauugauguucugagguaaauaauuuuuuaacuuagaaauuuacaauuagccacauuauucaucaaggaugaaguuagaaugaauacauuuucauaagugaauauaauaacaaugauuguggaugcuugucauucacaguaguuagguucuauaaaauuccuaugaacacugcauuugugaauauugaaucacugcuccuaggggaaauacagaguuuggucccugccagccucugguuuuaugcauuucuauuuaaaggcacuuuauuuaauauucauuguugauucauuaucauugaacuuguggccaacagcacuauaacucuugccucuacacagcuuaucuaacacagauguuuucucuguaagaaaaaaaaaaaacccucuuccuucagaaguuacuucaagauauuucccagcaaggccggaaacuaagaaauuguuaagacacaggaaccaggaauuuguggaucugacccacuagaauuuaucugauuuuaaggaugcaccagaaacagagcaggaaagggggucucugggaggaaagggugcagucaggaaauggggauuuuggagauuuguuauugaaaacagcaauuuagaauuuucauacccaaagaugaagaaaaaaguaagaaaaguaauaauucaaacaagaaaccugaagcugagugauaaaaaacuaaauauaaucauaucuuaauacuuuguuguacagugaacaauauuuauagugauaaaacauaagcaaauuacagauuuucaucuuauaaagccaacuuuuagucaagcaugaauaauuuauuucuaguaacagaauagaaaauacgugcuuccaacacacucaauauaaaaguaaaucugugggacauggaagcugagagguagaagaguggaaaaauagugaacgaacuuuuacaacuaguauauugucuuuacaauuacuauacugucaacaguaguugguauggaaauagaaguguaacuguguuauauaaaguuauuuaaaauugugcuauaacuaguaauauauugagaggaugugcagguguaggugaaggacaugaaguaaaucaucacuuauuauauaagaaaagguagguaagagaugacaaacuaauaaaucaaccaguaauauuuacuagaguaaguaaaaauuaaaacaaaaaaguuaaagagcuaagagucauuuaaucuacugauaugguuggcuuuguccccacccaaaucucaucuuaaacuguagcuccuguaguucccauguguuguaggagggaccugggggagguaauugaaucaugggagcaguuucccucauacuguucucuugguagugaauaagucuuauaagaucuguugguuuuauaagggguuuccccuuuggauuggcucucauucucucuugccugccaccauguaagacauaccuuucaccuuccaccaugauucugaggccuccccaguccuguggaacugugaguccauuaaaccucuuuuucuuuauaaauuacccagucucagguauggccuuaucagcagcaugagaauggacuaauacauuuaccaagggaauauuauauaaccauuagauauuauuaggaacacaucguaugucucaauagaaugaucuagaaguuacuaaguuuaaaauuccaagcucagaauuuaaacauaguacauaacuauuuauguaagaaaaauaauaaaaaugugugugugugugugugugucuguauauacuuggaaugccacauaagaaacacuauuugccucaugaaaaggaacucagguguuugaggaacaguggcaggauauuaccuuguugaaccuuuuaaauuuugaacaaugcaaauacacaggauaugcuaaaaguaaauacaaauuaaauuuuaaaauaaaaaauaaauacuucugaaaagaauaacuggagguagaaauaaauagacucuuguuuuguaauuuuaaaagccucaguagaauuugauuuuuuaauucuguucauauaucauacacacacacacacacacacacacacacacaagcacacacagacacauucugaauuguuugcccaccacuguuuaccugauuaauucuuauuuauuuuucaagagucuggugacacaacuuaucugugaaauuuguucugacucuggcuaagcucucuguagcaugagucaguucuccuacgguauuccagaacaucauugauccaucauuauuauagaauuuucuuucacauaguaauauuuaauuauaugcugccucuuccacuagacugagugaaacucuaggucacacagaaauaauuucucuuugugucuucagaauuucaguguacucuuucaaauuuaguucugccugucuuuugaaugaacugcucccagcacuaauagggucagccuauucccuacucaaaagaaacaauccuagaacccaucgaggaggugggaugugucugagaacaacuaauugagaaacaggaaccaucuugcaggucagagaacaguacaauagggugagcuuaggcuaggauagagguggugguaguucacauucugucugccauuccuacaucauugcuuaagaugccuguggaauaacugguccacaguuuggagacauaaaaucagugauuauaaaagauaaguuacuuaaaaaaaugguggaugaguggggaaagacagaaaagucuuuaaggaaagauaauagauuuuauguguuuggggaccaagauggaagggauacauuauuauaaguauaaaguucagggucaagguugggggacaaggugagaaguuaagaucauaucaguugaaauugauuaucagaaagacaaggauuaucaaugaaaauuccuuuaaugaagucugaacuaauucugucuaccuuugaagcaacaauuguagguuauugguaaugaguaguaguccccuggcagagcuucaugaauucuaacacucuggggucuuagcucaucaauauucuuuuuccauucuacaaucuccucuucaucacugguugcuuucccaacaccugugugaaaaggcucagcuuguuuuauccuaaaaaugaaacagauaucccugguucugauaucagucucaugggauuuuuaaaaauuuuaaaccauaauuuacccuuacuuucgucaccaaacgucucaacaggguggucaacacacccaccucuacccauuccuucccuagcccuuugccuucuugcugcaugccccgccuccgugguuuuauuuauggucuuccugcugcuuagaauguucuucccacccuuuucugccugauccaauccacauguccuuuaacgcucaacucaagaagcaccuccuucaagauaccaucuauaacaagcuccuuccucaacauuucaugacuguauacuuuaccucuacaaccagacauggcuggcucuggagaucagcguagauguauguguucugccauuacaugcaucuuguaaugcugauacucuuucauuuuccuucuccaacaccaggcuauaaacuugagaaaaggaaugggaucuuuguugucauuguaucgcuagugccuagcauaguuucuacgaugaacuggaaaaccagugaacuaguaaaucaaugcauauuaaacugaugaaaaacaaauaaacuacaucucgagcacugaucuuuuuccuggucuccagucaugcauuuauaaccaaccugucugggaaccaagguuaagugcacaaacucuagagacaaacuuauuggaauuaaucccagaucugccucuuccuaguugugucaucuugacaacuuaaacccuguacaccucaguuuucuuaucuacaaaacaaggaugauguuaguaccaacucaaaggcuuuuuaugaagauuauaugaguucauuuuuuaaaaagguguuagaaaagaaagcaguaaguaguaagaagauaguaaguacuauaaagguguuaaaacauaguuaagaccaccugaagaauccacugcuagcucaaauuuuacaggauccaaauugaacucucaaacauacuccucugccuuauuugcucauaacagcuaaugguaacuguuauggguaaaguugugccaucacuaccuccuucucaaauuuauauguugaauuccuaauauccgguaccuuagaauaugaccuuauuggagauaaggucuuuacagagguaaucaaauuaaaauuaggucauuagggugaacccucauccaaacgacugauguccuuauagaaaaaggaaauuuggauacacaaacaaacacgaagagaagaaaaugugaauagacauuggaaaaagaauucaucuacaagccaaggagggaggcuuagaacaguuccuucccucacaccccucagaaggaaucaaccuugccaacaucuugauuuuagauuucuagccuccagaacugugagaugcaaacuuucuguuguuuaagccaauggcagcucuagcaaaggaauacacuagcauuaucucugcuauaaugaacuacccaagaugggucauuuauaaaugaaaacaguuuaauuuucucacaguuccacauggcugaggaggcuucaggaaacuuacagucaugguggaaggagaagcaagcaccuucuucacaaggaggcaggagagagucagagcgcagcagaaacugccacauuuaaacaaucagaucucaugagaacucccucacuaucaugagaacagcaugggggaaaccgcccccaugauccacucaccucccaccaggucccucccucaacacgugggaauuaccauucaagaugagauuuggguggaggcacagagcgaaaccauaucauuaccacuucuguuuuauaaauuccuaacccaugacacgaaguccaguucaaauauaccugcucagugagguuuucucugaucuccuccaacaaaaaugaccauagaugcuucaaccgccucuauugcaauuuuaacauccuaauuuauauuacauccucuguguacucacucccaucuuccagauuuguguuucuugaaggaaagacccaacuucuuuaaaauuggaaauauuuuauauuaugaaaaaauguaguaguucaauaagauucucuaagucauuugcugaacucaaaaaguaaaauguguauaauuugucuuuaaacugcauaaugaaguuuccuauuaaaaugaaaaauuuuauauuacugacaguuuuccacaaguuuuacccuuccuagugauuuauauucugccuuauguuuuuugauaccaacuauauugugagugucaaagaacuucuaacauguuccuaauuuggaaucuuuauagcaguacuucaggagcuaacagaagcauaauagugaaaugaggcaaaaaaaaaaaaaaaguauuaaacaaauaaauucccguccucaaauuuaaaauauuuuuaaaaauuccaugugaaaguuuguaaagucaugaacaguucuaucacuauguaacauuaaaaacuugaaguggggcaaaaagacaugacaauaaacuuuuacaaggcaauagcaggcauuuuagaacauagagauguuauaccuaucacuagaaagucuuaauuguauuuuuacuaaguuucagagcuucuaacuaaaugaacagauacaauuaaaaauuugaggaugcagcaucauaaaauguacacuagucaucacuuuacagaguuucagacacuuaauuauuuguguugguacaaaguucacagagaagauauaaaucuguauauguuuuguaacaguaaucauguuuaggcaauaauguccugauucaaguaauuauuuuuucagaaguaaaauuuuaacuuacaaaaauuacuaaggauuaguuagagagcugugcacuugugaauuuauucuugaucuugccagauucauucaggucaacagcacuuuuaaacuucuauaagacuucuuaaaauuguucugucuaugugccuaaauauauauaaacacaaauacucucagcaacuaacuggacaguaagggguaaaugagauaagugaggcauucacuaugcuaccuccauuaguguuaacaagaauuguguaguuaauucccucgcacugcucuuaauuuucaucuccucuguagggucuauuccaaagcuuuuaauuguuuuguacaacucucaccccaagacaauuuucacuuaccucaguaaugaaggauuuggcuguagcaggauucauaacaaggaucgcucgccuaagagugucucgauagcgauucaguucuucuauucucauggugucaaagagagugguaaucauuuuauugauguuguuuucuaccuucugaagugcaacauccauucccugcugagagacuuuguccaagaacuccuguauuccacggauaucuggaaacaucaaaagcccaucaaaauaccugugaauuauuguacagaaggaaggcauaagcuauuucaccuauaucagaauagauuauuguuccacacuguaggcugucuaaaauuaccaacugaguagcugacggaacucucaaguauguuuaagguuugguacauuuugaaauguucacaugaaaaauguaggaauuguuauuuuuuaaauggauuucuuucuaucuacauggaaccuaaaugaugucaauccuagaaauguugggugagggugcacggagaugguuggagagaugccccauuucucuagagcaaaacaagaagaagggaaagacauucccuauuuuccuuagcauuuuaaagaguaauauuaaccucauguaagcaugaauaucauugaugacugaugaaucugaaucaagauuaugaauguuucuuaaaauaggcaacaguaucacuaaacuugacuuuuaucaguuaaacagaaaguuucaaaagguuaucuucaaagggccucagguaacuuagaccacaaauaaaagcugcauuuuaaucuauuuaauuaguauuaccuccuuagcuaaauuuggaaaaguugguaggagauaccaaguuugccuuaguaaggagaaaauacuuaaugugcaaaacauauuuuuucaaaacauauuucagcauuuuagaaaauauuaaguaacauuuuugauugcaugaugaucagcaaaauauuuacauacuuauuccaaaauaagcaaaguucuagaaauuuaucaaauuaaaauguccaguguccacgucacacuuaaauaagaaaaguaaaauucaaucuaaagaguuuaucauuuguacuuugauguguauuuaaguaacaauaaaugucugaaauaucacaaauauuucuucuuaguaucagauugcuuguuuauagaagaagauaucugaaauaaguaucuggcacaauacaagcuuaauauagauuaugcuauaaucuuaauauaguagauuuucuuuuacuauaucaugaacuauauuuuucauuauauauccaaagaauaaaauauuuaaagggcaaauacuagagaaacaaguaaaugggauuguagggaacuuaugaauagacuagaucucaaaauccuuaauagugugugcuucccugcaaguaaaauuugccucucagugguaauaguuaauuuauguauuuuucaacauacaaaccagaaaaagcaguaaguaaaaccacagaacaggaaaacaaauagccaaaaauuuagaaacuacauuuacucuuauaaacauuuacauuugcaagguuacaaauugacuaaaacaacaauuuugcuuucuucuucugaauucuuucauuucaaaauaguuguaaauauuauauguuuacuuaucugaugacuuuaaaaaucuuuacaacauauauacuguauaaauucuaucuuacauuucuuaucauuaauuaugugguaaacucaggauguuaccaucaaagcagguuaaaagaauaaaauccucagcuagggcagaggaugagauaaaagagguggaauaauaaagguguuauguauucauucaauauccaagucagaauguacauaaagguguaagacucugaaccaugaauuaagcaaaggguuaaauuugauggacuuugguugacacugguagagguacaauaacaagacuauguacauacuaagcagauguucuuaaacuuugaugugaaucagaaucaucugagaaacuuaucaaaaauacacaagcuugggccucaccccagaaccaauauaccuuuagaauacaugucagaggcccagugugguggcucacaccuguaaucccaggacuuugggagaccgaggggggcagaucaugaggucaggagcuugagaccagccuggccaauauggugaaaccccaucucuacuaaaaauacgaaaauuagucaggcgugguggcacacgccuguagucccagccacuugggaggcugaggcagaagaaucgcuugaacccgggagguggagguugcagugaaccgagaucaugccacugcacuccagccugggugacagagugagacuccaucucaaaaaaaaaaaaagaaaaaaaaaauacaugucagagcagacagagcagauuauugauuucaaauuguaaguuguucuuuauuugaguuacuuaaauuguacaucugaauacaaggcaaacaaaacaaaaguaacacugaaauagauccaagaugcucagaaaacagagcaugacuagagaauaaaguuucagauuacuuauucucugugaaaucuucugauuacaaaaauaaaauaccaguacuaguuuacauuuucacuuugagaaaaaacuuguucuccaaaaacauuuguugaauauuagacacaauacuaggagcuaggagcacaucaaugaauacccauucaaacauuaaaacagacaauaaacaaguaaacaaacuaaaaccacaaagcacacuaaguguuuggaagaaaacaaugaaugcauugguagaugauaauagggugaggaggaggauauauuuuacuuagaggaagguuucucugcaaaacuaguauuuaaacucugagguaaaguauaagaagacauuauccaagcaaauagauaaggagaaaaggcaacagcucagaaaauguccaggacauuaaagagccuguggaucaaaaaucuauaggagaccacugugguugcagccuagcuagugagacaugaagcuggauggagaggaagagucagguuauguagaucucugugagacacaggaagagguuuuaauuuuauucaaaauacagcuuuaaucuauugaaaguuucaaguagaggaucugccuuaaguggaugacuggauaugugagcagaaugaaaagcaguuuaagucuggaagugacguguuugauugcauguuuuaaauuggggcugggcgugcuggcucaugucugaaaccccagcacuuugggaggcugaggugggugaauuacuugaggccaggaguucgagaccagccuggccaacaugguaaaccucgucucuacuaaaaauacauacccaggcugaggcaagaaaaucgcuugaaccugggaaguggagguugcagugagcugagauugugucacugcacuccaacaugggugacagagugagaugcccccucaaaaaaaauuuuuuuaauaaauaaauugaucuaguaaauuaauuauccuuaauuugaaacuauauaacguuuuuuagcuuuaauuuuugaucagagugauaugcauacugaaaagugaugugacaaaagaccacuauaaccccucuguuuccuaacacuggaauccugguugucacuucuuagauaugugacuguaacauuuuuugaaaauuucuccucaacuguaaaugaagaauuuauuuguuuauauuuauuuuugagacagggucccacucuauuacccagguuggaguguaguggcaugacaucagcucauugcaaccuccaccucccaggcuuaagcgauccucccaccucagccuccugagcagcugagacugcaggugcacaccuccaugccaggcuaacuuuuguauuuucgguagagacaggguuuugccauguuggccaggcugauuugaacugcugagcucaggcgauccaccugccucggccucccaaagugcuuggauuacaggcauaagccaccacucccagaaaaaaauauuuaucuuauagaagucuucaaagauugauuuugcaaaagugucuauguguguuugcuguguauauacaaaaucuaguguagggucuaacauauuguaauuccuuuauuguuaguaaagaacaugacuauuuguuaagagaccaccacucuucccaccaacaggccagauugccuaaauuuuacugauggcuagcuacccaaaauggcaagcauaaauuacaaggcagacucauggaaugcaggaguuaagcauaaauaguuuugcuuauuugaggaaaugacaccaaauacccaugauauguggcaacugguaaguucaaugagagaagauucagagccaugcucuuuaugagcugcuguguguaagagucauuaaaaaagagaguacucugggugcaguggcucaugccuguaaucccagcacuuugggaggccaaggcagguggauugccugaggucaggaguuucagaccagccuggcuaaaaauacaaaaaauuagcugggugugguggugcaugcucgucgucccagcuacuuaggaggcugaaacaggagaaucgcuugaacccaggaggcggagguugcagugagccgagauggcaccacugcauuccagccugggcaacagagggggacuccaugucaaaaaaauaaaaaauaaaagagaguaagccuuugguuuuguucaaugaacacaaacaucaucacacaucacaaucauucagccacauuaucuguaugcugauuagcuggcagccaaugagaugaguuaucuguguuuccaaaauaaagaauauaugguuccugaccucaaggugcuuccaggugagugggugugacuaggugcuauuuauggauaacagaaagcuaaaagaaguuucuguaguuuccaguaauuucuucuacugaccagauaauuacauaacaacaggugguggaaggcucauuaauugaguuauuaaacauaagacugggggaggaggaagauguuuuuuccaugacacuauaaaggaacuugugguaggcagaauauuggucuccccaaaaugcucacauguuaaucccuguaaucugugaauauacuagauuacacaacaaagacaaauuaaggcugcagauagaauuaaagcuguuaauugucugaucuuaaaauagggagauuaucccauauuauuuggguggcucuaguguaaucacagucuuuaaaauuggaagagggagacagaacaggagcaucaaagggaggucuaacuccugaagaauguguugagacucagcaucuucagagagaugaaagacugcuggcuuugaagaugggggaaagagaucuugagugaagaaagguggguuguuucuagaagguggaaaaggcaaggaaauugacucuucccuagagccaccagagaacacagcauugcugacacugauuauagcccacugagauuccauuucagacuugugaucuaaaaaauacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcauuaccguucaggacauaggcaugggcaaggacuucaugucuaaaacaccaaaagcaauggcaacaaaagccaaaauugacaaauggggucuaaguaaacuaaagagcuucugcacaacaaaagaaacuaccaucagagugaacaggcaaccuacaaaaugggagaaaauuuucgcaaccuacucaucugacaaagggcuaauaugcagaaucuacaaugaacucaaacaaauuuacaagaaaaaaacaaacaacgccaucaaaaaugggcaaaggacaugaacagacacuucucaaaagaagacauuuaugcagccaaaagacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaaacaggaacacuuuuacacuguuggugggacuguaaacuaguucaaccauuguggaagucaguguggcgauuccucagggaucuagaacuagaaauaccauuugacccagccaucccauuacuggguauauacccaaaggacuguaaaucauguagcuauaaagacacaugcacacguauguuuaucacggcacuauucacaauagcaaagacuuggaaccaacccaaauguccaacaaugauagacuggauuaagaaaaugugacacauauacaccacggaauacuaugcagccauaaaaaaugaagaguucauguccucuguagggacauggaugaaauuggaaaucaucauucucaguaaacuauugcaaggacaaaaaaccaaacaccgcauguucucacucauaggugggaauugaacaaugagaacacauggacacaggaagggaaauaucacacucuggggacuguugugggguggggggaguggggagggauagcauuaggagauauaccuaaugcuaaaugacgaguuaaugggugcagcacaccagcauggcacguguauacauauguaacuaaccugcacauugugcacauguacccuaaaacuuaaaguauaaucauaauaaaauaaaaaauacuauuaauaacuuguguuguuuaagccucuaaauuugugguaauuugauacaccagcaauagaaacuaacauagaacuauauuuucauccauaagucuguauuuuuccaaauuguaauccacugaguuuuauuuuggagucaucuggaaaacuuguccaaauaccacuuguucucacuaauaagcggaagcuaaacauuacacuacacuuggagauaaacaugggaacaauagacaccaaagacuacuagccggggagagaaaguugggggcugaaaaaugaauuggguacuaugcuuacuuccugggugcaauauacccauguaacauaccuacacacacuccccuuguaccuaaaguaaaagcugaaacuuaaaaaaaaaaaaaaaugaagauuuuugcucaaucccauuucuaugggaucagaaacgcucaggaaaaaaacaaacaaaaaaaaaaaacaagggauuuucucucacuugaugcuucuuaagagacuauuugggaaccagugcuccaauuucuuaaccuucuuuguguuacagacucuuuugagaaaaucaaagauuaugaauucucucuccucucaguaaaugcacauacugaaaacauucugcacacugccaagauuauaaucucuuagucaacucugcuugccucccuuaaaaguaguuauuggagaaccuggauaagcauaucgucccugauguuagugauuuuuuuucuuauccagacuguauaagaggguaagguauaaacauuuccaugcuaaaaaguaaugugagguuuuguuuaaaaauagaggaaaauuuuagauaaaaagauagcaaacacauaaauacuuucccuugaaaaccuuucauuguuuuaguuacuauuuaauuguccuucaggccuaagaaaagcagauuaacuguagaagguuagguucccaggaagccgacucugggguagagauuggagacuagagaggcuaucagggacugcucucgggaauaacacugugccccaagggaagggaacaagaaagagccagcagagggaggcuacgaugcagucucagcgaagaccugcagggagcucuggaagugggauggucuucagaguuaucccaaguuagcgcugguggaaggaggaauuuuacaccccuguguguccuuuggugaggugguuccccuaagcggaggguaauucauaaggaagguagucagcggcaagcccucucagcauuugggagaagacagucuucaguuuugaagggggauuuugguggcacaggacagaguucauccugaauguuuccuuacauuuaucaagucaaaaguuacuguuuugguuuucagggugcuuugaugauauguaaagccuuuauaaaucauuugcagucaacauuuccaucuuucauuuagaaaacaacuuuaucuaggggaaaacacacugcauuugguguaagaaaacuagguuuggauucuuacuuagccaccaguauaacccuguuaacuuagaaucauaguucuaaguuaacaggguuauacugguggcuaaguaguugaugucuuuuauuuuuaaucuucccaauauuucuuuuccuuuauucaaacaacaagaugccacuuuucauuuaagaaauaaaucuggaugccucccuuguuuucuacaugugcccaacucucuagguugcauugcuggauggucauguguccugggcugguuaguucgaacucuccauguccucuggccuaaguaauuuuuuaagggauaguacugacucuacuuugaaaacauuaaaucaauguuuucaguaugcaguggagcccauaaauaacccucugauucaucccuaaaguugauuuuuucuuuguuuuugugaauauggguaacaaauguguacauaucuaccuagcauacuggauuuagucauuuccaugcuaagauauuuugucaauacuuauuaugcauaucuaggucucuaauuuucagaaacaguuuaacaaauuacagugaagacugaaaugugaaauauggauaaucagaagaaguggucuuucuuguguaucacaaguugucccaaugcaguaguuuugcgauugcaggagccaacaugucuagugugaaaguaacuaaagugaaacagaggcaaggcagcuguucccuagacuuucaaacuacaugagucaauuuuaaaaaagcuauuuugaaguaaacuucugcuauuuguaagagaaagggucuugauuaauacauuuuuuuuuaaagcaaacaucugauacuuugauaaggaagaugaaggcucaguuccugucuuugaggugcuuccaguuuaguggaagaaauuaacauuuaaacaggaaaugauauuuuaaugugauaaugcuaauaacaacauuuaucuugauuuuauucugccauuguuuaauaggaaaauggaauaaaauauugauaggaacuaaaaguugaugucuauaacauucuagcaaccaucaauuucucagauaucuguauuguguuacuuauuuaggccaguuucccacaacaauccuccaagagguaguggcugauugaagcuuaaugauucauuuuauuaaaucacguaaaauaaugacuuuacuaucaucuguaaaguaagauuaauuuuaaucucucuacuaaaaugguuuauauuaaaguagauuaggguaggaaaaaauccuaggaaauauuagaauuuaauguauauuucuaaacugaccccaaaaaaggcuuuuaaucagaaauaugacacgguauugcucauuccauaccaguggucagcaucuaagcagauauuucucaacauauaaaagugaaauucaugaagauagagagcagacuggugaugaccaggggccaagaaggguagagggguuaagggaauggaaagagguuuauuaauggguaaaaauauacccuuggaagaaauaagaccugguguucaauaaaucaguaggaugacuauaguuaagaucaauugauuguacauuucaaaauagcuaaaagaaaauaauucaaaugcugcuauugcaaagauaaauauuuaaggugauggauaucucaacuacccugauuugauuacaugaauuuaucaaauuaucauauguacccugaaaauaugauauguacaugucauauguaucaauguuaaaaauuuaagaaacauaaacaaauaaaucuguuucaagucuuugcuuaccaugugccaagcacugugagagguacuuggaagagaauguugagcaaaacaaaaaacaguucuugcccucauggaguauauuaucuauaccaucugaugauaccacagacuguauuacagauagagguauccugcaauacuacucauuuuccaaacuacaguugcaauuuaacaaaauuuaguggcauucucuggaauacauaaaauaguaauucucagucugauuauuguuuugaaauaucacuuuuaaaauauugaauucaauaggaaaagagauaugucacuaaguuuuugugucuuauuuuuuuccucuacucauuucuuccuccucuguguagauuaggcacauuuaaucuuuuuaaucauguaauacauuuuaagaccucacuuggaguagaaaaaggcuucaguacuguauucagccagucuugguguuucugaaauuauggcagaaugccaagcauuaaaauuaauauuugaaaccuugggcuuuuuuuaaaaauaggaaggaguaugucauacugcuggauauaugagauacaucauugagcugaagagacuuuucccaacacgugaauagcaaaacauacuuuauaaauggcuugcuuccugagaaaauaaaacuuuuaaccauaagccauuuaaaaaaucuugcuuagaaaaaacuucacuucaaaaagaauuugagucauuuauuauuuuguuggcauuugugcugcauuuuuacuuuguauuuaaaaaauaaagauaauuauaugcuauacuagauuucugaggugacacgaucuggcaacaguggcccaucacugagauugaauuucuauuugauaauagcuugugaucugagcaugagaucauaauauuucaguauaagaggcaucuuuacauugaugcugaucaauauuuguuaagaacauuuuacuuaugaauaaauccaaagcaguagaauauauaaauuuuaccuacuuaacaucauauauacuaaugcaaaggaaaugguucaauaagauguuuggauuaauuauaugcuuauugaugcacauggaaguaaaugagacaacugaaagcuggaaaguagccaaaugagcaauaaacagcuuuaagacugucuagagagaaagucaguaauauuauagucaucagacauuugaaaacacucucuggguaaucauaaacauuugcaaucaauuaagaggaauguguccauuucaagggucuugauuaaaccuacaucaagacuacacagaauaaacauugugauucuuaggaaugcauucaugaggaugguccuucaaugcucauuucaaaagaacacauggcaauuaaauuguaaguaaagagugauacggugaagaguggugcuuaaguaguuuagaucacuagacuauguacugacucuaguuugaaaacauuaaaucaauguuuucaguaugcaguggagcccauaaauaacccucugauucauccauaaaguugauuuuuuucuuuguuuuugugcauauggguaacaaaaaguguacauaucuacccagcauacuggauacagccauuuccaugcuaagauauuuugucaauacuuauuaugcauaucuaggucucugauuuucaaaauuaguuuaacaaauuacaguggagauuuauauaagguuaccaccaaccuuguugcagaauaguaaaggcuauccugaaacuauaagaaaaauaacagaaagguuaagaccauaaaauaauuuuuagcugaccaaaacaaaaugaaacaaauaaauauaaacuaaacuuucaaaggguauguucuaaaagggauuuuaaaauaaugaauuauaauaaaacaauuauaguuuccuuaauuuuucuuauaaguaagauugcuuucaaaccaaaaaaggagguacauguguauauguaugccuacccuucacccuucuaccaaagagucaucauguaacucagggugguaacucagagcccuccauauacuugaccaaauuauuugguuuaagaauggaaaaggacccaaacaacauguaguauuugauguauggauaaaaaucccuauguguaucauacacacacacacacacacacacacacacacacacacacaggaaaugaucuuucuuuaauacaaucaucugucaggauaugcuuuaggucaccagagucugcuaacuugacugagaaugaagccaacacaugaauagaaguagaggugaggauaugguaagagaauaacuauuuucauuaaguucauguaccugcaucauuaucauaauaaacuguuuagcucccugucauugaaguagcccuccaaucucuacagcugaauccauucuaauagaucuaccaauauauccaucccaauauuggguuguuauuguuacuaggcaaggaaacuuaaauaacucaaguagcucauuugaugaagagcacauuaucaaccuuacuguuugcuucauucuaguaaaucaguucuacccagcuuuuccagcccugaaauuuaauguuucucucaucaguacucucaaaagagaauaauuccauuaaaacaauuuaccuacuauuuuucuauucugacgagcaccuccucuuauaacuuucugguuucuguauuauuucaguugcaagacucuuuuauuauggcaucuagccauugucagauauaucugucuuaauucuuugcuuagaccucucugauggugagucugccuggaacgacugccaauugccuuuaaugagccucuuucaauaccauaauccaccuguuugacaaugccuccucuuggaaggcauuugguugaaaucaugacuagcauguuaagccaauugagaacaaugcaaaauuggaaggguuggucaauaucauuaacacaaugaagguaaaacauaaaauugaaaagcaaaaauuaugauaaagaaaacacaguacaagugcuuuguauuuuaaaaagagguaaauaucucacaucucucuacagcaacaagacaacacguggcauauuuuguaaucaguaaauaugucaggucuuaucuucucauacagagagauggaaaaacuagaauagcaagggauaaagccacuuagaaaggugagauaucugaaauuaacaucaaauucaaaaaugguaaacugcuuguggugcuuaugcaguagacaucuaggguaaguuuagagagguaucauuuuauuuacuuauugauaaacgacuauaagcaaaacagacuacuuauuuaauauuauuccagaaaauggcucauuuugaucaauguguguguuuucaguuucauauguacuuuuugacaacuagaaauguccaaugucuaaaaaugaaaaaagcugcaucaaaaaguaacgaauucugcaucgcuuggagucuuucuggcaggggaaacagaacugucaaucaaagauguggaagaagagaccuguugaaauuugcuguuuccagaugccucaucaaggaacaaagcuggcuuaucagaagcaccuguggaguuuuaaauauauauauauguugcuaugcacccugcaaaauuuugauugaaugguuuuggaaugaggcccaggcauuccaauuacuaaaaagcucuucuagagauucuaauauacuuucaaauuuggguucccaguggccaccaaauuaaauucucaccuuuuuuuuaugacucaguaaucucuaaaucaucaugauucaauuauguguuuaguuuaaaauuaugauauuucuguaaauuguuuuuuuuuccuuuuuccuuuccuuuaccuuuuuugucuucaaauauuugauggguuguucuauauuguaauuuuuuauugaaguuuaauuuacauauaauaaacagaucuuaaaugcuuaacagauuguuuauuguauuccacuguuacuaucacucaaaacaagauaauggauauuuccauuaccacuaaaaguuauuuugugucgcuuuccagacaaucuaccccagacacauagaugugaccacugucugauuuugaccacgauagcuuaguuuuguauuuacuggacuuaaaauauauggaaucauacaguauuacucauuuauaaaugugagucuuuucucacuuaacucaguguuucuucauauuucaauaguucauuacuuauuuugcucaauaguauucuacuguaugaaaauuaauuuaaccauucucaaaaugaugggcauuagaguugcuuccaguuuuggauaugaggaauaaugcugcuaugaauauucuuguacaagaauucguguggcuauacauucucauuuuucuggagugaaauaggugagguauacaagguaaguagauauuuaacuugguaaaaaauugccaaacagcucuccuaaguggcuguauguuuuacauuccaaccagcaaaguaucagaggugcaauuggauugucagucuuugccuucagccaaucuaguggaugcagauuggcaucuccuuguaauuuaaauuugcauuuuucuguggacuaauaaaguugcacaguuuauuugccauuuauauaucuucuuaugugaauggucuggacaaggcuuucacccauuuaaaauuguuuuugguuucauacuggugcuuuuuaagaguuuuuaaauauguguauucuuugaacacuuuacauauuucacauauuuauacguuuuucggaucuauguuuuagaauuuauugcacaguucauaguuugucuauuucuuaauguuguauguuaaugagcagaacguuuuaauuuugagaaaguccaaaauguucuuuuugguaccuaagaaaucuuuauauauccugaaguuaugaagauaaugucuuauguuuuccucuaaaagaguucuaauucuaagguuuuaguuuuaguaugugauaaaucuugaauuaauuuuuguguguagugagagaugagaguaaaauuuauuuuuguuuugauuccauacagggacccaauugguucagcaauguugcuuaaacauuucaccacugaauugauuggcauguugguuaacaaucaaccccacucuaugccuguggguugauuucuggacuccuaauuaugucccaugaaucuauuugucaauccuuaugccaauaucaaaaaagccuugaagucagguaaaauauuucauccaaucuuuuucuuugcucuuucaauuguugcggcuauauaagaucuuuacacaauguuaggaucagcuuaucaauuucuucaaaaggcucuaaaaacaauuuaaaaauuuaagauuuuugauuauuaaaucuauaaaucaauuuaugaaaaauggauaucuuaagacuaaaauuugaaaaucaugaacauauaucucuccauuauuuaguucuucuuuaaauacucuuggucaauguuucauaauuuuuagcguaaaugucuugcaaaauuuugcagauuuauuucuggguauuugauauuauguuuuauuucagguuuaauuuuuuauugcuauuagaaagaaauacaauuacuugcgaauauaggcuauaagcuuacuaauuaaauuauaaguuuuagauuucauaggauuuucuaugugcauuauuauguauugagaaauaaagacauauuugcuucuuccuuuucaaauucuuuguguuuuauucuuugcuuuauuucaguguuagaauuuccaguagaauauuuuuuguguguggaggauauguauucuuuuuaauuucugauacuggcaaauuuuguuuucuguguguauuuuuuaaaaauggucuugcuggaguugaacaaugagaauacauggacacaaggaggggaacaucauaaaccggggccugucagggcguggagggcuaggggagggauagcauuaggagaaauaccuaauguagaugaugggucgaugggcgcaacaaaccaccaugauacauguauaccuauguaacaaaccugcacauucugcacaugugucccagaacuugaaguauaaucuuaaaaaaaaauuaaaaauggucuugcuaguguuuuaucaaaauauuuccuaaaaauuaauaauuuuagacuuuguuaacuuucucauuuuguuuucuguuuuauuuccauuuauuuuuauuuucuuacacuuuguguuuaauauagucuuauuuuguuauauucuaaagguagaaguuuaauuucuugcuauuuaagcuuuucuuuuuucaaauaccaacaucaacuugauuaauuaauuaauuaauuugcuuauuuauuuauuuguaguuacuuaugcuuggggcucagugaauugaugucuuuaauucaauuuuggcuaauuaucagucauuuucucuucacauuuaucuuuguuuucccaucuucacucuuuucuacauagauacuaauuagguuuaaucuuaguguaaguaggaguccuguuucucaugcauguaaauguaacugugaggaagacugauguuuaggauuccuucccccaaucaucuaugcacacacucuccagauacuaauucaauauccagccuucagauugucgccuuucauuaaaauuauauuaccuauuuaugguauugauuuuuuucagcuguuaauuucucauuaucaaugaagaguuauucugguuacauuagcaaggcugcauuauaacuaugcagagagaauacuggacugagugccauaguaaacaaaacaaaacaaaauuaaccaaaauaaagaaugacuuuuuuuuagucucuuagcuuuaaucuccauaugcauauaaaauguauuucaaaauuuuccagguguccuuaaaauauuuaucuuuuucauagcaaaucaaaaagcaggcaaaaguaguauuuuaaacauacugcacuccuugagaaggcagaaugaaaaucagcuugcuuuucaagucaugaaguauaaauucaacuagcauuuauuccaaccaauuuuuaaagaaccuuaauagaaagcaaauaaacacccuuuuuuuccugaagcaagugccacucaagguuuuaacacaaacacaaucauucuucaacgcuuggaaauauuggaaggccuuuuuucuauaauauucauacagagauauuccuucaacuaucaaaguuaaaaaaauaaaaagugaaagaaucagucugagcugaaauaaaugguguuacccaugaagauauagagcuuggaguagaccaaaaccagauuugcuugguugaacuugauaguagcuacuugaaacagaaagugccuugcuuauugcuguacaauaggucucuggauccacaaucccuuccccuccuuuccccuuuucccuggcauuagcugccuuaaaagaaggauucuugccauaagagagacuaaacacccuaggcacguaucaauauucugagaaaucuuggggaagggagggacucagacuucuauggcuuugucggauauagcaccuauccagcccugggggaagaggggaaaaugcucagauucaacuauuugguggggguuucagugggagagggaaaggcacgugacauguagcuggguuccuuuauaccaacuuaauauacuguuguugcuuccuacauugaguauauaauuggaauucauguguuauaugcuucuaauuuccuacuucacaaauauucaaggagauuuuccuuauugggaauaaugucacauagagacaugcuucuucucuccccagaaagagaucccuaucgcuauguuggacucugggcauuucugacucugacuaaugacuaugccaguugggaccucugcugaagagaagaagccccuccuagagacucacuuugggauuauggacuuggugcuccccaaauauggcuaccagguacauccauuuugaaaagcagcuauuagcuuucuaauggacucuuaacugaaaccgaaagccugaucuaugaaugaccugacauuccuaucuugaggagggucacuucgaauucagcaacuaguaauaugugcaggggccaacaagcaugcacaucaaaaucaaauucuuccuuuagaagacuuuaccuccugaagcuaagugcugacucuaaagggccgugagaugcagaaguuccauaaacaaauggugaugacuuugcugaccugaaaucugaaaguguucguuguaguuugcuuaggucauucaagcucagcaccugcuaugcaguacugaaaauggacaugcuuacucugcuaagugggcagaacugaagccuguucucauagcucuguacaauacucuccuccaugguacacauauauauguguguguguguguuuguguguguauguauauauguauauauacacauuaugacugcugaucuguugucaacagcuuagugguuugguaugccacuuagagaacuacagaguaguaacauuaaagauaccacucuuuggagcugugaauuguggaaguauaucaagauuacaucaggguuacucauggagaaacccauagugaaaguccauuaacugaucagaucaacuggacucaagcugauuauugagacagacacacagauugccaccauugcugccugacaugaucuaccauuuaccgugucuaccauucacagaugggacacaaagcaaauaacuucuguuaccagggccugcacuguaugcaauacuugugauuccugcugaaaguugaccccuuguauccuaguagggaaagccaaagaggguuguccacucccacugcaagcacauugacuauuuuggccucugaucacuucuuaggacugccugaaaguguuguagauacuuuuuuaggucguguuauuauuguuccagucugaucagcugauguagacacuacuuuagaagcucuuaaaauuaaucugcgucauguuuucagcucacuggaccauuuucagccugacaaauguaugcaaaagaugcucaacaauggccugguagucaaggaacucagcguaucuuccucgcucucuaccaucaacagacuuccaguguuguugaguguugaaacaaucuccucaaauguugacuucaaaagauguccagcuuuaucuucuucaccuuuuccuggcucauauaccuuagugaggcugcuuguucacuuuaugaauauguuccaagaaagaaauaauaucaucuugggugauuucugugcaaugaucaacaugaaagucgugugggauuaccuacaccuacuuuuaauuucaaaauuucauucugaccuuuucugggcaaaacacuucuuucuuuuuccccagagcagccuguguggcagccuugccuaaacggagcuuaugggauuuggacucaauuauguuucagucuccuggaguuucuuguuuuauugauaugauucuggaucauaaggauaaugagcacuuugugaggacacagcuuguucaugcaggccaaagugggggacacaaucagucucuguaaguuuuauaaaaauguccuuguagcucuugcaccauuuuuuauaaaaagucuaugugcaaacaggaaauaauugagaaaaaagaugacaucacaguuauuaggaugaaauacaccaauuugcuggagguagagggagagcaccaaauaagaagggaacauucacagaccccuacaauuauggggaaaggacagauguuaaugauauuugucuuucaaaaugacuucuggaguauucuccaugaaagaaaacucucugguacagaacauccaaacuaggauaagugucuuaaacuucacugacuguuggacuugccuuuucuuaccagauggcucuauucacgacuugaucgccauucuuuuauucuuagaaauaagucuacugaaaauagcacaggaugcaucugccacuccuaugcagaaugcuugucaauaccucuaaauaccuucucugccacuauucucacucauuacaucgggugguaauaaagccacuaaacugauggcauaaaacaaggauugguaaacaauccuuaaagggcuagauaauaauaugucaggguuauuuagguuauauugcuuuuguuacaagugcaggacucugcuacuguagcuuaaaagcagccaaacaaaaggcaaauaaaugaacauggcugaguuccaauggaauuuuauuuacaaaaagagauuucaagcccaacaguaguuugcugaccccuggaguagacaaugaggacggaccuaaucaacuacucucacaaagucucucuuaaacaagaacuggacugaauuauucuaguaauugagaacaccuggcguuaccagagggcgaggaggucacauaggagguaauauuuguuugucuuccacccagcggguuccugaaauugggccuaacccuucccuccaccaacucaggcaaaccaggcccacuuccaguacuauaacuuuuguaugaagauuaccacccuucugaagacacaugauuugaacauuaggguagccauaagaaauuuucaacuguuuaaguaaagaucagcagaagauaauauaguacacuaaugagaucucuccaaagugaggcuaccuuuauuuauuuaugggagcuacauggagcaauaucugugaauccugugggcaguuuauccuacuaugggauucauccauuauaaauuuuuucccugaauuucacugaagcaaucaauggcaccacuucagcucuggaauucauucaggucagcuucaacucacuggccaggguauuuauaggugauagguuuugccuaugggcaaugguggaaucuuuguaaccacaaauaaauccuuuuguaucuaaauuaaugcuucucgccaaguggaaagguuuaugcagaaacuuaaggagagagccgccuggcuuuuuaaaguaaacuucagugguucauaguauuuguucagcugacuggguccaggacccuggugggcaugguugagaucaauccugcucauuaaaguccuguuuauagucucuuuaaauaaauacagaugagaaaaacugaauggauuugaucgcaauccccaccauucagauuaacuagaggaguggcaaucucacgggggaaauuuacuauuagccaacaacguuguagaaagaaugugacuauuacauuauugggagacaauucuccauaggucuccuguguuacuacacauuuugaaaacaggaauucuuauuagggaacaagacacauggauuccccaagcucaggguuucucagcugccauacaagcccauuacacauaggguauucacuugaacugcuccacauuguuuuguggaacuugagggcaacagaaacagacauuacuaugagggucaugcugcuugcuguaccaugaguaauaaagucucucuauacaaucuaaaagccuaguauuuuccaccagcauccaugaaagugaugcaggcuaacuugcuagcuugcaaauaggauaaaauucccaaccuuuuacaauuucugacagcauuacaucacaaaaguuagcuguaagauaucccgggacuacagauuuucagccaggaauauugcacucucaaauuugguauucuauuugcaaagaaaaaagaacaguuauugagccaggcagguaaacaaaguuugagagccaucagaguuuaccuuaaaaagccagguggcuuucucaaauuucugcauaaaccuuuacugggccagaagcauuaauccgacaaaaaaaugauuuauuugagguugcaauauuucuacuuuugcccacaaggagaaggcagcuauuucuguuacagauaggucagccuguuuugucccaaugacuuucucauuuccaugcuuucaauaauaaguaaaccuuccuaauugacauauaguauuuucccuuggcauuaguauguuggaauucugagggcuugaagucacuuuacugaaaaugauucuauguaauuuauacacuuacuuuuuauuucacaaucuguuggaaauuaaucuuauucuuauaucuauaauguuaaaauaccuucauggcugaaagcaaggacaggaagagaucauucauauuugaauuggggcuucuccacuuacuggaaguuaccugaccucccacuacuucagcuuuuucauuuguaaaaauaauaauaauaaaauaauaacuacuacaaagggcuauuaugaggaguaaacgagauaauacauguaaaacacuuagaacagaggcuggauauaguaaauguucucuauuagauuagcccuuauuauuacauucuugggugauaguuuauugcaaccccuuuauacugauaaaugauuaagaucauaggcucugucagacguuaaaucucugaucugauacuuccuaguuauguuuuuugugaacaaguuaccuaucacuuguuccugucucccuauuuguaaaauugugacaguaaaguucuuacuucacagagcuacugagaagaucaaaugacaugauaucucauucuagugucugacaaauuaaaaugcucagagauauuauuuuuaauaucuuaauugcugcaauauuugaucacacugucuauugguaggggggcuguuucucacauauuuuugccucuugaaauacuauuaacuuccauaaucaagagugaagucauuccauaaagccuucuucaaucacuggugccaaaauuaaauacuucuuuacacaccaguagaacugaguuuacaucauucauaacacuuaauccacuauuuucucuauuaagaaagacacaucuguuguuaacuguaagcuuauuaaagacuaagacuauguuuuguaauacuuuuuaucucauaguuugcauugcacugagcaagugagcaaugaauauuuccagaaggacauauuuuuaaaagcugaacacuuccuaaccuauuuucaagcauuuuaaaaugugucuugaaucaauccauucaaauaaaguuuccacauuuuuuucaucuuuucaucuguugacuuagaagcaaagauaucaguuuucuuuguuaaggaauuuaaaguagacauuuauauuuugcccuuaauuauaauuaacugcuuuugaaaaggagguuucucuaauuaacuugauauagaagucuaaaucuuuuuaaaaaguauauauuuuuuucuauacaaaauacauuuucaauaacauuuggccccaggaagcugccuaauuccauccauagauuccauccauaguuaauccauuucuuaaugaaagcaauucuucauaaccaagauaaaagucacauacaauuccaauguuugaacuuaaaaugaugacacugaugaauggauaaguaaauacaaguagcccucuucaaaguacaagguauuuggauagcuugauguuuauuuuggacucuaguccaaugcuuuacuugcaagauuaauuguaaguauuaaagggaaauuuucuuucauuaaacaagggcauuacuggagauaauguuagugauagaagcagaaauauuuuucauaaauuauuaagcuaaauaagugaaaaagcaaguuuaucccaaaaauaaaauuccuaaagcaaaccucagaucuaacaaaugacccagucauauauuacauaauuauuccaucuuauuuacucaaauaaaaacucaggagaaaagaauaagaaauuucaaauaugcauaaaugauucugugacuauauauuuauuuaguauauauuuucaaaauauaguuaucucacccguaauaaaaaugucuucuuuuauacaaauuaccugacuauaauauauguaggacuuggaaacaaacuaacaaggaauuuucuuucuucauggucauuuauaaugaaagaguaauauucuuguuuuaauguugagaaaaugccuuaaucaaaaguuccuuuucuguucuaaaucccagcacuuugggaggccgagguggguggaucacgaugucaggagaucgagaccauccuggcuaacacguugaaaccccaucucuacuaaaaauacaaaaaaaaaacaauagcuaggcguguuggcacgugccuguagucccagcuacuugggaggcugaggcagaagacucucuugaacccaggagguggagguugcagugagccgagauugugacacugcacuccagccugggcaacagaggaagacuccaucucaaaaaauaaauaaauaaauaaauaaauaaauaaaucacuuucauaguacuaacugaaaauuguucuccccgcuuaaauaaaguuacuguuuuuaaauuuauuauuucaauauauguuugaucagaggucauaagaauaucauuuaaguaaaaaaagaaaauaccauuuaaguuauaaaggccacaaauaaucugacuguaagaaaaucaacagucuuauucagcauguugauuccaaagaguuuauuauguucacuaaauaauccuaucagggaauuucaggcuuguguugaguucaauccuuacuuuaacugaugagccaauuauuuuuaauauccuuuuuguuuauuuuauucauuucagucucuuagacuuuguucugugaccccuuaauaacgugaauuaagcaacaaaaauaaggauuuccgucuuggagacaaaggaguguguuuccagagagugccacagacuuuggcugaagccuacccaccaaguuuaauaagacucuggcugccaaaaccccaugcaaccauugaauauuuagggcuaaauguaacugccacuugcucucccucccugagaguccacaggagcucuuucuuauuuguugauuccuagauuucugccaacuuguuuguucucaauucuauugauggcacuuucuggacgacucuuguguaacuguucuccaauaucguucacauugcuggguagcuuaggacaagaaagcauuuuuuaagauguuuauuuacuuauuugcaaagaaaaauaaguuaugcuacagagagugaaauccucucugacuuucuuuucagaaaacuguaaaaacugaacccauuccuacugaacaggaaauuuuuccaagacuccuucucaagacauaaccucuaagaaaacacauguuucaaaauaggcauucuuuaucaagaucuguucauuuccccucauuugaucauacucaucucuauuuuauuucugccacaaauaagagggaaucuauagauuaagauauuggggaucggucaguuagaaaaaagguagauaaauucagaaaaaauaaauguaaacaaaaauauuauuuuguuuaguuguuaaugaaguaccaguaaauauacugagacaaagcauuuuauucucaaauuaugauaaauuuagggacaaugcuuuguguuuuaccuuggaagauuaaagaauuuuuuuuuuacuacuuaguacuuuugugagacuuccuacuguagacaacauauaauaugaacuguauggugauauaauuuuagugacuccaaggaguuaaguacugaguagguauuaaagucuacacaaggguguaagcaagauuuuucagauuucauuuagccaaauaauagaaagagguaaauuuucaguguucuaggguuauccaauaugaucuucugcauuauagagagguauacauuuuuuugaaagggaagaaagacgguguuguuuuuaugacuaaauucccauuaguugaaaaaucaagauguauuggaaucagauucucucuagaaacauuuguaaacuaagcauuaaguagguacagguauuuauauuuaaaguugacuuuauaccaaaauguuggacuuaaauacauuaacacaauuuucaguuguugcuauguuuauaagaaaaauaugacaagacaagaaaaccacaaauaacaaugaguaagacccuugaaacuuuuaagauuuaaugaauuugcuucucaugcaaauaucagcuuacaaaaccuaaacaaauuauaaacacuuaccguauucacuaucauagaauauaaugaauuucugccaggcauacucugugaccacucuuaggauaacaucaugcaaguagacaggugggcgaacugagagaguguagucaucauuccuguugcuccgggugaguccacagccacuccuuggggucccagcuguugagcgcugaaugaagaggugggggauaugcauggcgucugccaaagacuggagggauccugcugacgugcagccaauggagcugaccagggccaagaugccuugauucauaaguucacaggcugcaagaaagcacaguaauauucaaaaugucaguggguuucacauaguuuucccuuuuugagaagcacuggauggauaaagcuuacagauuuuuuauauagcuaugaaaauguuuuagaaaggaacauucgauaugaggagauccucaaauuacaaagcacuauugguauuccaagaauucugcucuuauuaucuaugcgaccuugugcaaaucacuuggcuucucuuggcucgguuucaucaucuguaaagaggguaaaauagcaugaaucucgcaggauuauugcaaggauuagagaaaacagugucuguuauuugccucucacaugauagauauucaauuagugguagauaaacuuuuguaauuaucaauuuauaauucagagaaaagauaauucccuacugaaggcauaauacaagguuucaaaaaguagauaauauguaaaccggugaauaaacagaaagaugaagguuuggagaaaagcauuucuggccacugaaaacagaaugauucugauaucuaaaaacuugaugacauugccccuuuccauaaacuggagaaacaaaaauguuuuuguuauuuuccuugacaguaagaaagcuuauggucaaaucaaauaauuucaaauacuacauuguagccagugucucauucugguuccuagaucaacaauuuauaauuccuauuauaugguuacaaucuauuuuuauuucacuuuaacucuucuaugugcauaccucaaaauguacuuaaaacuagaucaaauauaaauuauaaguaaauguaaagaaauuguauacacagaaaaaagagugaagagguaauguuucauaauggcaaacuuugaagauaaaaaauuaaaaauaaguucaaaaaucagugaagaaaucaaugaaaaaauuauuuucauuuuauaacugguucagccuuauuuuagauuuuaggcauucuagguauaacauucuuaagauucaaaauuuauuauaaauuguuuuacauaguucuuuaaaaacuuaaaggaaaacuuaaugguaaguucuuguauauaauuaacuggccaguuaaugaaggcugauuuaaagugcaagcuuaaaagugcuguacuaaugauaagcauaucaucaucaaauaaauuuauuauuauuaauuuauuaaugcuaagccaaccaauacaugcaaaauaaugaauaauuauuugagacauauuuuucaagcauugccucaugaaagagauuauacugauuuccaauaaaugugaaagcaucaaggauguauuuuuuuuuuuuuuuuuuuuuuugagauggagucucccucuguugcccagacuggagugcaguggugugaucuuggcucacagcaacuuccgcauccuggguucaagugauucuccugccucagccuccugaguaggugggauuacaggccugugccaccaagcccagcugauuuuuuuguguguuuuuaguagagacggaguuucaccauguuggucaggcuggucuggaacuccugauguugugauccaccugccucggccuccaaagugaugagauuacaggugugagccaccgugccuggccuggauggaugcuucuuagaccauaacauugugaggucuaauuuuagcaaaaaucauauguucuagucauguucaugaauucaauuuucauagaaaauaauauaaguguauacuuauaauuucaaugaauuaaugcaaaaagaguagucaaauuuuuauuucauuauuuugguauauaugaccauuaaugauuuauauaagcaaauaguaaguaguaagucacuuuuuagaagagauuuugguuuguagcauuuaaaaucaaaauaagaaagugccuuaagggguacacaguuggagucaaucuuuagauuacacuaauuacaggaaauuaaguaaauauaauauuuuacauacuucuaccacaaaauuuauacaguuauaaacauugaaauuuggggaaaaauuuacuuucaauauuauauucugucacauguaacaugacaggaaaauugucuguuuuagucuucagauuuagaaggauauauuccaaaaugaaaagucauauauuaaucuugcuuaguagauacauuugcuuuagcauaaaaucuuguuucuuccaacccacuguuacuuccuauuaaacacgaacuaagcagauacuaaaaccaguuaauuuuguauacaaaaacuuuguuuuuggauuacuguuugguauugccuaucgugcuauucauauuagcaagaauaacugaaauuuuccuacaaaaucaaaaucggaauaaucaaaaauugcagccagaaagcauauaaugucaggccuaaaagauaauuuagagaucgugcaguccaaggaugggaaauuggcuuuaccugcugugcuuuugaugacuuguugguaaauuggcauccuggaacacuauuuugagaguuugagacucaauaagaaaaaguaccaaaaucauuuugucagguuucucauagagagugggagagugguggccugcaaguuauaaaugcgcaucccucugagagggcccaauccuuuauugucaagaaaucacaaaugcacccacuuaaaaaacaaaauagaugacccagcucucuaaccaaucauccuuuucaccacaacaagcaaacaauggagucuuguaguuguauccuuaaaauuuugcauagcgaaguaaagauaaagcucuaaauaggggaaagcucaauuugagauuguuuuauugucaaguuuguugaaaggagguagucccacugaagaggaaaggaagagcucacacaaguaaaaugaauugggacuggaugacucaaaacaaagccgcaguugugcacauauaagaacgggccuccacagcaaccugccauuuccccuucaaggcuguauuugaugcccauuuggcccuauuuuaccaaaacaaaaugucgguugaagcauggcagauagaaauugauuugcuuuggaucuacagggcccuagaugaagguuaguauaaaaauaggcuauaacucauggcagcugaagggagauuucaggaaauaaaaggcugcaguaagaacagaagcaaagcuuagcaacgcagacuaccuuuugcaagaauuucaugucuugacaauuaagagacuauuauuaugaguugcaguuucauagaaugcauagucaguucauuugauauaguaugagaacugaauuugaaagaucagaacguguauuuaucaacuauuuuaaauuaaaauaaucuaaaccuaugacaucucaauggcauaguucuuuauuauuauuucaagccuugugauuuauuuauacuauauaugcacauauacguaaacaucuauacauacagaucauauugaaaagcuugcugguuuuaugacuccaguuguuugagauucugucacuaccaaagauguuuggagccugcacuaacugccaaaagcacaacuauuauuuuuauuauuuuuaauagcaauugcaacacuuuugcccuuuguggucacucugcaguuauggaauuuaauucugcucuauaaauguauccauuuaagcuaagauauauucauguacacuaacauuuucauuucuuaagcuaaauauuuugagucuuuguuuucuuacuaaguaaaacaagauuaaaaauaaaaugcauaaagaguuaaaaaauuuauuaccucuuacugaaaaugagaacucagugaaauauuuuuugguagcaucauccuuuuugaacauauaucuucuuugugaucuuuuuuuucugacuuauuuauauuuaccaauuugucccgauauaacuuccuccggugauuuuaagacacaucaggacuuuagcacauuacaucauacacugcugugguuggaaugugucccccaaaguugaaauauugaaaacucgauccccaauguguugguguugggagguggaaccuaaugugauguguuugggucaugggggcacuaccuuucugaaugaauuaaugcuauuauagcaagagugggcuccuuaucaaaagacagguuuggccuccccuuggcuuucucuugcccucucuuugcccuuccuccauaggaugacacagcaagcaagaagaccuucuccagacgccaguguauugaucuugacuucccagccucuuaaacugugagaaaauaaguuucuguuuauuauaaauuacccagucucaaguauucuguuauagcagcacagaagggauuaagacauacuuauucaucaauauaaauaaucaacuuucaaccacguccaaggaacuucccuggagaucagagaauguauaugacagguucuauccucaaagugcucccaguuuguccaccauagucuuuccaaaaucugcccugcaucacaaucaaaaguggagauuaaaaauagagagagagaugacuaagucuacuccuagaguuucuaguuuauucaguccagugugguagucauguauuugcauuaugaaauguuaccugaauaguucugauguguaacccuuucugagaaacaguagccuggcggauuguaacuucaaugcucuuucaaguaauuguugcagaacaucuaauauuuguugacuuuuuauuauuuuuucaauaaucuucagucauacucaacaaugaccauaacugggcaguggaacuucacuacuuguguauucuuucuaugaugacuaaauauaaucuaauuacuuuuuuucuguuuauuaacaaaucacaaauauacuauuuaugauugcuuuuuuaauauuccaccaaaaagcuccagacauuugcuuuuauacuucuaggaauacaguaacacaaaacaauuucagcuuacccagacauuuagaauucuuugcaaauaugauuuuuagcaaccaucugagaugugacauuuagaagauggucuauauuugggaccucaucaauguaguuugccagaaauaaaaucaucuggaacaaauucuuccaaauaaagcuugccuuaauauguaaauaguguuacaagguccaaguuaaucauaauuaucuacuuaggaagugaaaauacagaaaaaauauuuuaauuaaaaauuguuaagauuuuauuccuucuuacaaaauagaagugcuuaaaugguugaucaccagccaucaaaugaacucaguugaguaauuuucagucaacuauuuuuucacucaucuaaagccaacgugaaccuuuaauuauaauuagugauccaaaccugagaagaauuaaacauuuaaccuggcacauauuauaagucaccuuauuuuucaauuuauaucucauaacaaccgugugcagaaaagcuauuauuauuccaacuuucaaguaagaaaauucugacucagugacauuaaaugcauuguccaucauaccacuagugaaucuguaacacuaguaaauggcagaguugggguucaaaccugacuuagauuagaaugucugggccaugaagaacuacaaaauaaaucauuguuuuuaaacagaaaggcccauaugaaaaauuaggaggguuuuuaacucucccuuauuacaaaauucagaaaaauucagccuccuagauauaaaaaagaaaaaaagaaaagaaagaagaagaaucccuaauaguauucucuuuuaaaaaauuuuuaguuugguauuaaaacauugauucucuauaguuuuagcuccaaauaauuucagcuccauguguuuauaaaggaaaauuucaacaaggcugcaaaaugguacugagaagaaccuagaaaguauugaguacacuuuuaaucagaccuaaagugauucuaccaucauugauguaauaaaaaugauaaugaugaaauauuacuuuauuuuuauuuuguuuggaguuuaaaaaaugguuucacauacauuuuaucauuugaucagcauggcuaaauugaauauuuuccuauuccccuuuucaaaacuaaauugaggcuuauguuuacauugcuauuaaguaguagagacaaggcuggaacacauauuuuuugauauuuacuauguauauuuauauauaauuuauauauuuucauaaguuuuauaaaauuuauauauaaaauuuaaaauacaagacaaaaauuaguaaauauacaaaauacaauuauaugauauaauuacaaaaauuaguaaauauacuaaauauaauuauauuuaguauauauaguacauaaauauaauuauauuuaguauauacaguauauaaauauaauauaauuauauuuaguauauacaguauauaaauauaauuauauuuaguauauacaguauauaaauauaauuauauuuaguauauuuacuaaauauacagauauuuacuaauauaauuauauuuagcauauuuacuuuauaauuuuucaaugauagauuucauagcucccgauuuaaggaaauucagaucaaucuccuaucuuuuuaucuuuuuauuuuaguaacaauucuucaaagaacacauauauaugugcauauauauaccuguauauuauauauauaaaauguauuucuauaucaggcaaguaccagguacucagggugcaaaauggcccaaaauaggcaagaguauaaugggugagacagaagauauucauaugaauguuuaaugacauacugaguagguuccaggccaaaagagaacguuauucuaugauagcccaaaaacauuuuuccucaacuagagauuggggaagccuuugcuacagaagugacuauagagcugcaauuugaaggguaaguaggaacuaauuaaguggauggagguuaccuugacgaaaaagaguaaagaaaauguuuccaaaagaagaaauagaaugugcaaagauccugugacacagagacaaugaaauaccagaaaggcagaaagaggagccaaguggcuggagugcaaagagcaugguagagaguggugcaagguuagaauggcgggagaggcaagaaauaugaccuaugauggaguuugucuuuuuguuauuaauaugaaggagaccuuuacaugccuuagcaccacuauuuauccacauuuauuuaacugccuuuagucuuguauuuuaaauuuauuuaugaguuauguagcuuuucagaaauuuuaaaauuauauacaaugaaauugucagucuuuuaagacuguuuugcuuaacacuguguuuagaaaggccuuuucccaauagccugcaaauuuauaaaauuaucaguuuaucuaaaacaacaccuuaucuguccuauacuuaauaacugauuggcagcugauagaagauauagcaauugcacuuuaggaaacucggugagugcagaaugucauauuuggucauuauagguaaaauuuaaucuucaccuacauaaucauaaacauaacaagcaaagagugaggauuaaacauaauuguggcaagaaugauaaucagaucauauuauaugucugucuuuaaaacuuuuuaaucauuuuauagaaauucuauuuauuaaaauuauuguuccuuauaaaacuucuuggauuugaaacugauuauuucuggaugaaugacagaauauuuaauauaguccagaaaauuauaucccauaaaaguaagaauaauaucuugagaaagauguggggaacaguguguuuauguuuguguaagagaaagauagagaaugacaaaauaauauuuuacauugcuuucucaguuacugcuaucuaccuagaauaucacaacccaaucucagaagucaucuucgauuauuucuucacuuuuguuucccaugcuccuccaucucaacuugguuaucacauaauguuaauuuuacuccuaauguuucucaaaacuauucuuuuuugaaauaucuacugccaguucuuuaauucaaaugauaucaccacacacucaauuaccaaaacugucuuuaagcuggcuugauuuuacagcacuuucuccaaucaucuauacuguaagcaaucauaucuauuuuugaaucgcauuaugucauucccauguuuuaaaggucaucaauaaaagacugagggacugcuacauacuagaagagacuaagcaggaaugacaauuuaaugaaauaugggaucuuaggcaaaaauccugaaacagauagaaaagucauuaauaaagagguugggccgaagcagguggaucacuugaggucaggaguucgagaccagccugaccaacauggugauaccccgucucuacuaaaaauacaaaaauuagccgggaaugguagcuccugccuguaaucccagcuacuugggagguugaggcaggagaauugcuugaacccgggaggcugagguugcagugaaccgagauugcgccauugcacuccagccugggugacagagagagacucugucauuaaaaaaaaaaaaaaaaaaaaaaaagagguuggugaauuuugaagaaggucugcggcucaguuaguaauacugcaucaauauccaaugacuauucuugauaauuucacuuucauuauauaagauguuaacauuaggaaaaguguaaagaauauaagagaauucuuuuuaccauugucgcauuuuucugaaaaucuaaaaccaauuuaaaauaaaaauuuaaaaacauaaaacuuccaaugucaucauacaacuucugcaagugaaaaucaaacucuuagcauggcaugcagaauucuuuaugaccugacacugauuuacauuuucaugcucaucucuaguuccuauuccuugcuauuguaucuuccugccauuccacacacucucccaccgccaugcuauuuuaauuaccuuauuucuucagcagucuaugugcuuauaaaaagagauaguugcucacgccuguaaucccagcacuuugggaggcugaggcaggcugaucacuaggucagaucgagaccauccuggcuaacacggugaaacccgucucuacuaaaaauacaaaaaauuagcuggcgugguggcgggugccuguagucccagcuacuugggaggcugaggcaggagaauggcgugaacccaggaggcggagcuugcagugagccgagaucgcgccacugcacuucagccugggugacagagcgagacuccaucucaaaaaaaaaaaaaaaaaaaaaaaaaaaaaaaaaaaaaagagagguaacuucgacaucccaauacuuacugaguauuccaauucauaagcauuauacauaacuucauuuauuuagcuuuucaaauaauuuauuuaagcaauauuuuguaguauucaguguacaugucuugcaccuuugucaauuuauucuuaaguauuuuauacuuuuauauucuauuuuaagugguacuuuuauuuuaauuuccaaauuucauugccagaaaauauggaaauacauaagauuuuguguauuaaucucauaucaugaaacuuucuuaaacucacuucuucuaguuuccuuuucuguaggauuuucuacagagagaaucaugucaucugcaaauaaaggcaauuuuacuucuuucuuuccaaucuguaugccuuuuauuucuuuuccaugccuuauugcaccagcugguaccaccaguccaauuuugaauagauguaguaauagcagccacccuuccccuuuuccugauuuuuagggaaaaauauucaguuuuucacaauugaaaauaauauaaccugaagguuuuuggacuaugcucuuuaugaguuugagaaagucuccuuuuauugcugagaacagaguuugcucaggaauagagcuguucagaguuaucaggaauggauguuagauuuuauuggaaguuuuuucugcaucuauugagauaaccauaugguuuuucuuuuuuagucugcuaauaugggcaauugcauugauugauuucugaauguuaaauuauccuugcaaggauaaugcuggcuucaguaaauggguuagaauauagucacacauuuugaauuuucuggaagaguuuguguauaauuaaugucauuuuuccugaaaagucugguagaacucaccagugaaacuuucugggcccggaguuucaguagugagagaguuuauaaaaucagucuuaaaaacauauacaggcauauucagguuaucuguuucuucaggugagcuuugguaacguuuauauuucaaggaauuugccuucuucaucuaaguugucaaauuuacugaaauaaagguguuuguaauauuccccugaaauuugaagugaugucagcucucuuuauacgauacugauaauuuauaugguaucuucuuugaucccaaccagucuggcuaaagguuuaucacuuuuauuaauuuucucaaagaaacagcuuuugguuucauugauuuuucuuuguugcuucuguucucuaucucauugauuucggcucugaucuucacaauuuccuuuauuuugcuuaauuucaguuuaguuugauuuucuuuuucugagguagaagcugugauugucaauuuuagaccauucuucuuuucuaaaauagacauuuaguccuauaaauuucccucuauguacugcuuuaguuuaccuucuuucugcugaauuuccccuauuauucauguauguuauauucaccuuuccugcuaacauauuaacccuaguuacuuuuauagucacugugauaauucuaacaucuaggauauagcucaaucuauuuuuguugcuuuacaucuugacaauggauuguuuuuucuaauguuucuuauaauuuuagacauauugcuguaagagacugcagacugagguaaauagaauauauugauacagacucuccuccuaccaggcuguugguguauggcuguagcaaucuagucaggaauugauauggauaugugucuuguuguugcccucacuauguccagugcaccacaggcuuuggauuccucuagcagcaggcugcuauuacuuuguaguauuuagaauagggccuguguugccagagauuuuuccucaguguuucuuuuucucccucagguuuuaguugucccuucacagcugcaccaaguggaggugccucuguccucugugagucuuggguccuuccccugugguagacaucuguuguguguuacuuugcacaagguuaucgcggaccugguccagccuccguuucacacaggucaugugcaacuugggccuaaggguguugucacuguuacugccccucaucuuugaaacaccaccuuucauuugugauuggucucuggagaguuuccugccucccagaaugugccaaccuuggcuuauaucugugaaagauccuggaaccaagacaguuuccugaccagcucccaggagucuuuaccaguagcaauaggucuuugcauguaccccauagauaagaggauuuuucccccuuccccaagaucuuaaggcuuuuacuuucuagggauaaagggugaauagaugggaaaaacauagucaacccuugaacaaugcagaguuuagaagugucaacccccacaguaaaaaauccaccuauaauuuuugacuaccccaaaacuuaacgaucaauagccuacuguugccuggaaguccuacuaauaaugugaacagauuauuaacacauauuucauacacuaauauauacuguaucuuauaauacaguaaacuagagaaaagaaaauauuauuaugacaaucacaagggaacaugcauuuacaguacuguacuauaucuucaauaccauaaguuuacauuaucuguuuauaagauaaauugucugucugaaaugccagucaaacucagcugcagagcucaguccacgguacacaucaagcaauuaaacauuucuuguaaugucauggcuucuuuuuucugccucuuggaaacacuuccagcaucacuagucgcacuuuuuaugggucccaugguauuauccaagguuugcaguauugcacuaaacuuggugaaaacuaugcaagaacugugagagguuacuuuuuacugcaugauacaauuuacuggagagacaaacugcucacacuauguuacuugcaacauuugaccucaccacaguugcaacuggaguuggcugugaaauuaucacaguaguacaauauguacuacaguuaauuuuaugcaguuauaauuuaaugccacauuuagacauuuguuuauauuucuuuagacugggcauggugccauguaaggucuguaaguguguguguaaguuuugauacauuuuaacuucccauaauagauuuguguaaauuuuauagugguaaaugauagacuaguaucuagucauaaaauagacuaguauccaguuuaccuuaugaauuaaugaccuaccuaaccauuucuuauuguuuaaaaauauuucuaggcuauaccauucauaugugagucuuuuuuuuuuucaaauaguugcaaaccuccaagaaaauuuccaauauauuuauugaaaaaauccacauaaaaaugggccugcagaguucaaacuccuauugcuuaaagcccaagaguacuaugccugguccccugcagccauaguuccacucaggagagcucuguuucauauccuucugauaccaacuuucucaagagcacuugcuggaagaguacuucaauagccugcaaauaaguacaaacuccccuugugucugcuauuccaaauaaauacaguaguucacacuuagccuuuaugaguucauaaaaauugcaagugauucuuccuagccuguguggaagacaguaaccucuuacuccuagauuaucucuaaggacagacuguuuuguguucugucucucuuugaaaguacuugucccucuuuggauguuggguuauuugguuacuuugagaaaaguuacagcuugaaaaaaauuagaguuuaauagauuuuuggcuuuuucucauugugcaggugggaaaaagugcuuuguaucuuuuuacauucaaagcagaggaggaaguuugcuccuugauuauuccuauaacauacuuaagugcuuguugcauuguaauuaccuuuaugugucagucuucuggauuugacauuguguuuuccagugcuuuuuuuugacauuguguuuuccagugcuuauaaacucagucacuguuuuuaauuacauuuaaacagacuucaaguaguaguuuugauuagaaagagugcacugcuucugaauagcuccauggauaauuuuuuuucuuuuaugaauauuuuauauauugacagcuuugucauucaggcacacacacuacauaaagaaaaaucauaacucuucaugagaacucucuuaucauggcccauaggcccuuuauaagcuucugccuggccaugaauauaacccaaacuccuguuuccaucagccuuucucacucuauuuuggcucacucauugguuacccuguuuugugaauucacuuuuccuucuauuucuucuguguggaguacuccucaccuagauauuccuucaucuuauuucuucaugcaaauccucaguuccugcagccccacucauuagcaucccuguuauucuuuauguccugaccuuacuuaauauuuuccuuaauaguuaucaucauuugauuguauuuuauauaucuauuucucuauuuuuacucuuucuuccucacuaaaauauaagcuacauaagagcaggagcuuuauguguuuugcucaaugccuuaugcccuaaaccuagaacacagauuggucuguuuuaggcaccuaaugaacaugucgugaaugaauaauugaguaaacaggaaagguguggucuaaucauuagggcagacaugguguaaaguagguuagauauacuauacauguccuguuagcccuaguagcucauuuuauguuacucagauuuuacuuuuuuuacagaaauaauccacuccugcugauaaagaagaucccuaaauggagucaacaauaguaugaggaagagaguggaaagaaucugcccuucauaagaaaaguguuguuuggcauucccuaugcacacuauuugaaaauauugauauucuuuuguaauaagacuagaauauauaagcucuaugagaggaaagauacacauuuuuaaaaacucagauaugcuuggcguauagaagaguucaguaaauauuucuuaaacugugaguauaacguaauaaauuagaacauuuaauucauagcuagaaauucauagcuagcauacuccacaaaagcuuuuauaguagugauauaucaaguacagucuguugccuguuuauucuguaaacauucauuucaaaagugccuaaaguuuuauuugacuaaaaugaucuuguaauaagauauauuuuagauaauuuuaaaauuggcagaagaauguauuuugguuuaaaaugaacuuaaauggcuauucuauuuauuuuauagcaacuaucaaaacucauaugaccuugguaauauaguauauucauucuaauucauuaugguuucucuuuuuucuucuaucuuuaaucagugauucuaucuugaucugauuaagacauauaguuggcagcaggagcuggaucacaguuauccauucaugaaucaaucauuauuauuacaauuuuuugauaaucacauuucacuuagcauaaaaugcauuuggauuuauucucugccaggaaguaaucuuuuaccaucugcaguuuguuaucauauucuaauuucacuaauaaugccuuucaacuuaguagcagaagcauuucuauuucuggggaaaaaaaacugucuaugcacuuuacaaagcuauggaacagugcaugaggucagaaacacuauuuaaugguuagcuuggccccugcuagcagcaauuaugaagugaaaggagauaauuccugaaaaauauaguauaaaauuuguggcaaaagacagcuuuucacucagucauguggacuccuuucucugauauguuuuuauaaguaguauugugcaaguuuaaaaggacuguauuuaaauauuugacacuaauacuuuuugugugcaacuuaaauauaaaaagguaauguuucuucuaagugaagacauaaaaucaaaacacuaggcuaacagaaaaaucuuucuaaccauugacaucagcaugaaaaaauuaaaaacugaaacaaccaacaaccaaguaagcccccauuuuuccuacuauugccuagaaucuguugcuuucagagaaaaggcaugaguaaaugugcucgcucuauaaucuagaggccuaaguguaagugaggaaucuugauuuuuaguuccaguuuagaugugaaucaguguugugcuugggcaaaagucauuuuucucuuuggguuucaguuucuucaggcauuaaaggcagugauugaccgacaagaugguuuucaggcaccucucucaggagaaaacauaacgacauuucucucuuauucucuucuccuugcuucaauuacugaccaguccuuccuccaguuggcacauucuaacuuaauugguuaccuuuugaccugagaaaauucuguuucuucaaagcggcuuuacauacucaggauucauuaucagacauuuuuacuuuacuguuucuauguuggggguugggugcuacuagagucaguacacccuuguaagcuuacagugauagcaguaugaugaaaucuauuuauaauaugccuuuuaaauaauguccugguauuuuggauauuuuuccccccacuguguaaggguuuauggauuuuucagagaaaugcuuuccauuuacaaugaaaccaauuucuucuaaguauauauauacacacaugcauauauauauacauacacgcacauauauauuauacacacacacauauauaauauauaauuauauauuaauauuacauggauugauauaguuuggauguuguccccacccaaaacuaauguugaaauguaaucucgaauguuggagguggugucuugugagaggugauugguucauggugguggcuucucaugaauggguuaguaccagccccccgauacuguccuugugauagugagucaguuuugggagaucuggucacauaaaguguguagcaccucccuccucucucucuuguuucugcucuggccaugugaugugccugcucccccuucaccuuacacagugauuauaaguuuccugagacauccccagaagccaaguagaagccaacaucaugcuuccuguauagccugcagaaccaugagccaauuaaaucccuuuucucuaucaauuacccaauaucagguauuucuuuauagcaaugcaauaaugaaauaauacauggauguauauaaaaucacauuuaacaccuucucuucccccacaccuccccgcagaauagaaaagagguaaagcucuaacacgagauuacugaauuuuuuuuuuuguaaauaggaaaggcuacuuugaguaggaaauuauguuucuuguggauauauaucaaagaagcagucucuagaaauaacauuucugaugaagacauucucuucccuauaucuuuacaggaaacacaguaaucuuguauaauugauuacaucuacuaugacauaguucccugaacucuuuucacaagugauauccauagaaauuguuuuaacgagaguuagauguuccaauugcaaagaaauguucugucugcaguaauaacauaaugauauuuuccauaauucugaaaauuucauuucaaagccuuuuuaaucuccuuucacccccacaaaugaggcaaauacaguacuaugaucacucuuuacuuuacacauacuuguacacagugaccauuguacucugcuugccucguaagguuuuugcuagucacaaauuaaaacauguaucagaaaguccuuucaacagcaaaguuauacuuuacuauaauuugcauuaccauuauucacauuuuuuaaacugaaggauucuaaaguauagcuuagcauaaaaugcauuugaauuuauuuggaguuauugauuacugaagaucauaaucacuuugagauuaaagucuauaaccagugauucaaucaacuauuaaggauaugcccaaaugaauaaaaaagaaaagguaauaccaggucuucucacucuuuagaagcuuacaguugcauugaagauucuaggcuauucaacauuaaucaaauacaggugaaauauuuuaaaaaggcauauaauuaaauauguaaauauuacuuagguucaaagaggacacaugcuguaauaugauuggaacuaauuuagccuaaacuaguuggauaaucuuugcuuaagaggcacauuaacucuuaaguccuuuaaaaaggguaccaguuuuuaauuauuuuuuuuuacaggcacagugucccugcuuaauaaauauuuguuaaacaaauaauaagguggcucuugaaaguuuuuuuuucuaacugaagaggaaaaucucuuuuucuugaucuuagcuugagcuaaaauaggguaaucauaagugcuauggucugaauguauguguuccccccaaauucguauaauaaaaucucucucaaggugaugauauuaagauguagggucuuugggaggugauuaagucaugaaggcagagccuuauaaccugaugaaauaacuucaaugggauaaguaaccuuauaauagaggccugauggagcuuccuucuccuuccaccauaacagaacaugggcccuuacaagacaccaaaucugcuggcacuuugauguuggacuucucagccuccagaacugugagagguacauuucuuuuguuuauaaauuacacaaucaaagguauuuuauuagagcugccugaauuaacuaagaugauaagggugcuuggcaaaagagauaauuuaagaauuaauggaaauaccaucucaaaaaacauguacuaccucuagguuucugggcaaccucacugcaaauagcucaacuuguaaugcagucaucagagaaaggcuugucauaauucaguaaucaucccuuauuuacaauuuugcuuuccaugccuuuaguuaccuggagucaaccauggucugaaaauacuaaauagaaaauucuaggaauaagcaauucauaagcuuuaaauugcauaccauucugaguagcauaaugaaaccucacaccaugcugcuucuucccucccaggaugugaaucauccacacuguacaugcuaccuacccauuagccacauaguagccaucuggguuauaagacagacugucuccauuauuaaguaaaauaaguagagcuuguauucaaguaacucuuauuuuacgucauaguggccccaaagugcaagagcaaugcuggcaauuugaauaugccaaagacaaacuguaaggugcuuccuuuaagugaaaaggcaaauucuugacuuaauaaggaaugaaaaaaaaucauaugcuuagguugcuaagaucuaugauaagaaaaaguauuuuaucuuauuauaagauaaaaauauuucuacauaauucugaaauuauacaaaaagaaaaagaaauuuguacauaguacauauaggcuacaguauuaucuauaguuucagucgucuaccagaagucucggauguauucccuguaaacgagggaggaccaauguauuaauuuaagaggaggaauuucauagaguaccaggaauuauaaauagcauggaaaaguagucauuucugugucaggcagagagaacugcugauugaauauuaauuuguccaggcaaaucuuuauccaggaauaguaauuauagucccucuuauccucaucaaauaauggucuauuuagugaccaaagguuuaauaguaaugagaugaacagauguagugaaauuacuguguuacuuuucucuauauaucuuaguaccaucacauguuaauuuucuaugaaaucuuuauaaaaagggagaacaaauaccauuuugauaaugacauuuggucaguguauaaucuaaacuccggugugcugguuacauguguaugcucugaaacuagaaugccugaguauuaacucugguucuaugcuuuuuagcaguguaacuucagggaaguuacuuaaccucccugaguuucauuuuccucaccucuaaaguggaaaugguaucauuauacaccacacaccacuaaguaucacuaugggaacugaaugaguuaguauaucuuagagcagugacugauacauagugaacacucaguaaauguuagccauuguuuuuagauuugaauuuucaagucaacggaauccagaaagacuguguguaagcuaguguauuuagcaagggcagaugggauacagcuaaacaggagcuuaaagaaccauaaggaaaaaugaacuguuaacaguuguagauaaaauuuugaaucacuauugauacaacaaaugacuaccagcuaccugcuucaugcaaacccguguuuggugcuguaauucaagaaaauaaugaauuccaugaaaauuccuucuugcaucccaagcuuuaguucugaauuuuagguuuuuaacuguucuuacaauguuccuaucucacaucucuugcauaucuucuuuuaguagcauuuucagaaagagaucaaacuuguuuuccaaccuggggaugccuuuagagcuacacauaaguuaugacugggagagauaaaguaaaaacagucacuucuuuuggcuuuuccaugagugcaaucagaggaaucagcuaaaauaauuaaagcuaucagcuugaaauuuucucuuacugugaguaaauaaacuugugcaaauuguguaugucccugaaacaucuugcuaagacacugugaugaaaccaaugucaaugacacacaaugacagucugguuuuuuaaucagaauuuaaaugagauaacuuuuaaauauaaucucucaguuucugaaauuuuaaaacuagguuaugaucaucucaugauuuacagaacucacuuggguuuuuuucucuacucaccaauaaguaaaaaaugcaaacaaaauuuacuaguaugaucucaaaaauauuuuuuaaauuuuaacacauuuuccucccuauauuucccccguuuuuacuuuguauugaaaaacacaaaaacacgauagccucaaucuuauuuaguaacucuucuuaaaaugacgaauaaguuuugaagaguaucauuuccauuuauaaaacaacagaaugauucgccaaaucuauaauggaaacaaguaacaaucuacuuggaauaagcacauucuucaaucaauucauuauagaaauuuuuaagacaaggaugauuagacugaaaacaaacuuaacuaaagcauuaacaugaaaugucauuaaacauaugcuaauauacguagaagacugacaccaacuauuugggaugcaguagaaaauuauuggaaaauaaggccaauuucauuuccuuucaaguuuuagaugugaaacacaauaaucucugguucaagcaaaaagaucuggaaauuugguuaaacccaaucuuuuaguuaguaauucacaaggaugcuuucuaccuugaugaaacccaugcagugucaccuacucuguccugacuuugugcuugccuauuaaggagaaacaacauggaagaaaaagccuagacaaaagcugguaaauguggagagagaaacaauccacacugguagaagcucuugaauuuaguauauguccuggcaaggagcuaguaaaugcuguuauaaauuuauuuuacauuucuaaaauuauaauucuauuguaauucauaaaauuauaaaauuagaucuuauuuccaaagcuccaagcaguaggucacauuacuauuucaaagcagaaaaagaaaaugcauaggagagaguuacacacaaaaaaaggcauucuugauuuuauuaucuguaaguagugauggaaaaaauacaagaagaaaaauauauaaauagauaguauuagguuggugcaaaacuagcaaaaucugcaauuacuuuugcaccaacuuaauauuauguuauuauauauauuauauuuuaauaaauuaauguuauaaguuuuacuguuauauaguguauaccauuaacauuguaacauguaaauguaacauuaacagcguaauauguuaaacauggaauauuauuaaauauaauauauacacauacauauauuucuuauguuacuuaaauuucugauauugugggacauugagaaaagauaauuccuuuaacuuuaaacaaaauauauuuagaaacuacacgguaggcuuuggugaauaaaauacaauucuugaauuuaaauauuuuuuaaucaauacggaaauucagccuggauauauaacuuccuaaauaauacuuguacaauucaguuuauuugucugcaaaaaggagauauuaaugcuuacaggucuacuuagaaacauuaaaauuuuugaaagauguaagcucugauuccaguuauuaaaagacaguuacuuuuucauuucaaaauucaaaacuauauaaaauaaaauauuuagucccaaagaugaaaaugcuuauuagaaaaaucaacacuaucauccacaauuuuuacacuugacagcuaaccauuagucacauccuaaguaucagccaagaucauuucuuauguuuuacucuauacauuugaguauauccauguauaggcuguguaagugggaggaaaaugagauugguucacaaggaguuaggagaaauuaauugcagauuugcugcccugaguaaauacuccuaaaguuuauuguaaaacuugauuguuauaaaguauguaucuucugcacacaauucccuaugcaaaacccauuaaggauugugcuaaagaugaucaaauuguuaagugaaacagaauccuucauauacagaauuaucagaugugagugaaaacaugcacaccucuuagugucaaucucuuuuauuuaagguuaaaaugauaucauuauaauucuaaacugcaaaugcuucccauauguugaauuucauaguacuauuuauucaauuucuccuuucgcccgagaaaguuuuguauuucaaaauaaagagaguguaagaaagcccaaacaucacuguuaccagauaagagucuugaaacagaaugcagccaucucacuacaauuaauaccucacuaaaauaaguuugcucucuuuaaauaguaaugucuucaacacaacagauaauuuuauauuaggauaaaauauuuucaggcaacuuguuuuauucauagauauaugcaauuuuaaauugucuuuuaaagauagugaagaucuaaaugagaauaauuaaaucagaaacaauucuuauacuauuuuaguaaguggcacugacauggaaacugccuccuuuccugaauacagaaaauacuuuuauagagucaaggucaacuucguucccuuucaagaguuuaaaaauguugaauugacuuuaaaacuaucuaaagguuuauuuuaauaauacauaauggaaaugaucucucuuuuuagcccugaagugacuuugacaaacucuaguuucacuuucuugaguaugaaugaaaagauuaagacaaaaaaaaucaggaggaaucagagucaaagaaaauguuugauauuuucuuacuguuguauucacauuaucacagggaguauaacuagugcacaacacaugucuaaugacgcucuuuggugaauguaucaacaacuaucuuuaccaucuagccagaaaagacauuauauaagagauaagcaaauaugauucucuucauaucuuuguauggauaugaggacaacuuuauaauugcuagauuacuucucuuccucuucuuccucauucuccaucuuauuuugaaauuuugguaaauauaaaaugugaaaagaaaauaauaacugaaauucuuaccacuaaaaauauauuaucaaauuauauucccaaguuaaagauacagcauauuuuauauuuagauguauaagauuuagagguuauguaaaugagaaaaccuuaagcucaaaucccuuuaaaagugauauuuguuagaaugaauuauauagcuccugggaauaaaagaauuaacagcaagucuguaacugccucauuuccuccugggaggggucaauguccaccuuaaucagaccucuuauaaauauucuaauguauuaccuagcugagccacaggacaggugcucuuaucuaagaauguuuuugagguugaggcuauucuuagucuaacuagauugcuuaguguaaguaagcccuauuugugaauuaaccuggcauuuacggauuccucgaaagcacuugacuggagaauagaagcugucagguagugucuaccucaaugugguagccaagugucuaagaagucauacacuuucugggugcuuagcugucauuuaaaaagcaaaauguguucuaguguggaaaaagauacuuuugguagcugcaccagacaggauggggaauauucuagagaagacugcuguaucucugcuuaguuuucacuugugccuuuuacccaucauuacuaaaugccacuguuuaguauugugaguugcuagucugcuuugauaauucagcccuuuaugguacaagcaguucccagccuucacuuucuucuuucauagaauuguacgucaauacccuuuggcauauuauguugcaaugcccaucacuagaauuguuggaguuuauuuuucuauccauugauuuuaagcuuggccauaugacuuacuauagucaauggaaugcuaguagccaggauuuggccuugucucugguacgucuacuaucuaucagaaaagcauguucuaucuagccgcugguccccaaauaagagacaugugaagcccaucugagcuggcccuucauagccugaaucagaaaaaucccagcccacucacagauaagaaaaauaauuuuauuguaacccccugaaauuucaagguauuuguuaggcauuaaaaaaaaaaaaaaaacaagaaaaaccugaugaauauauaaaauuaaaagagauauuucuacaauggcuauuuauuuauuuauuuauuuauuuauuuauuuauuuauuuugagauggagucuugcucuguugcccugguuggagugcaguggugcaauuuuggcucacugcaacguccgccucucagggucaagcaauucuccugccucagccuccugaguagcugggauuacaggcacaugccaccacgucuggcugauuuuuauauuucuaagugaagugggguuucaccauuuuggccagucuggucucgaacuccugaccucaggugauccaccugccuuggccucccagaguaaugggauuauaggugggagccaccacacccagccuuuaauagcauuuuauuucaccuguugcauaacauacuuucaaacuugcauuuaaauuaacuagccaaauuggcuucugcaaaauuuuguaaauuuauuuuugaaaaacaaacuaaaacaaagucauuaggaaaaaaguuagcaaaaguaaaaauauauguguugaaaagucacauauuguagaauuaagaaugaucuaauccuuccugccuucuuuggcuauuucuaugagcacuuauggccccgugaaauuacaauuaucaucaaguuaacauaaaugcuauuccauuucauuauauaauuauguuuuccuacagaagcugauacuagcauuuaaaauaugugacuuuuggaaaaacauaucauuccaaauaucuagaaaauugacaaggaaauacuaauuagcauuuccuuccauggaaacacaaauacuuuaucagaauauagcaggcagucagaaaccuacuaucugcacaugugggaggacccggaggagaauauuuccuuaccauuugaaaaguccaauuuuuuauuuuuccaaaaaagcaaaugaaucaacauagcuaugacaaucuacauugagacagcuucaguuugacuagacccagaggauagaggcugcugcuaaccucauuaacuggggagucuaaaaugcugucaaauuacacacgcagggagguuuuccaguaaacgacagcauuucaugccaaagcaaacucucuccaugaaaauaucuagcugagcuuugacuaaacauaaacuuuuuguugaucuuaauuuaaacuauaagcagacaaaaaaaaucucugagaaaggaguacauuaaaaaaaauagucugugggcacaaugaacucagguaaaaaauaguaaagaugauaguggucuagauaauuugaaaaagaaacuaucaauauaauugguaucaggauuauauauuuaaugaccuuguuuuauccaguaauaaggugauaguuuaaaaacauacuucucagaauacuuuuuuuuuuuuaaagaucacuguauuuggaaaauacagugaggaaaguuuaaagcuuuuugaguaauagaauuauguuucauuuaucuuuguauauggcauagaacauauguuuaauuagaaugucuuucuuaacagaaaaacguuaaacuaauauuuggcauauccauagaaugaaaaacauaguacuguuaacauauuucauaacaauacauaaaguguccaaaucaaucaucauaaaauugaaaauaauuugauucaacaauuaguccaguggcucuuaacuaggagcaauuuugcucccccaggugacacuugacaauaucugcauacauuuuuuaaugcaucaggacugagaagcauguuacuggccacuagugagcaugauggaauugcugucaaacaucuuacaaugcauaggaugcccacacaacaaagaagcauccaguccaaaaugucagucauguugaauuuaggaacucucccuuugucugaaaugaaacaacucauuuguccaaauaauuugaauuucucauuucagacuucaauaaaaguuggagaaaucuugaaaccuuuuucucuuccagauuggaauauuaacauuuuauacucauuugccuuaauuauguuucuguauuucugccaugcauuucaaauguuaucaaauggaagagugcuccuugcauuaaccugauugauacauuuacauuauacauacuugccccucagcaagcucaaauuacuaagagcuccugguguuucuagagauagaauuuacuuuuuggugaaauuuugcaagguggcuucuuucuacuaugugaucaagugcaaugcaaaugguuauacagcgucagaacagauugaauacacaccuguuuugcugaaguauuacuagcauucugauacaaaggcaaccaaguaguaacaauuucuuuuauaaugcaguuauuuuaauauacugaaauugcauuaaauuuacuggguaaagaaaagcauuuauuuggaaugagccaaaugaaagauacuuuuaauuaggauauuuaaaauaauuuuagaauuauauaacuuaaaaauauuuuuaaacauuaaaaauguacauauaugaugccuuaagaaaauucaguauguaauaggaagaaaaguuaguucaacuuaaaaauugagaguuuggagaacuuuucuauuuccugaaguagaacaaguauucuaccuuaaacagugauuuaagcaauaacggcacacauagcagagagcuuacugauuaccaauuucaaugguguggaaggacaacuaaaaaaaagccacgauuucuuuggcaaacucauugccucuuaguaguugaacuaaguccaaauaaaaacaaauggugaugaauauagacauucccaauucuaaagugaaugaguaggaaaauagugaaaaaauagaaaaauauuuaaaauuucucauaaaagcaauugcugagcaaaguuuaauaaauauagucacuuuacuguaaaguauagcuaugaccccuaguaauuuauucauacuggucagcaaauauucagaaaaauuggcuucuugaagauucuuuaaauuaaugcacacuguauuaagagugcuugagaaaagaugaaguuaaaucuagcuuuuguuguuaguuuauuauuccaguuauucauauuauuaaauuuuaauaauccacacaggguuuuaaguaaacuucacugaaucuggcaauucaaugcacaagauucacugaagcacacuaacauccuucuuuauuuuggggaaaauugaagaauaaaacugaagguauaacauauacaaugaaaaaaagucaguaaagucugaauuuuacagcaugacuauuugcaucaacuuuuaaugucauuuuacuuccuaaaaauggaggggaaugacgaauugaguaaaaaucaucuuugaacacacucaucuugacaagaaaugaaacuuugacggaauugccuagcaauccuaccugagcucacugcauaccugaaauauaaacuuaauauuaaaugcagauaagaauucuggcgggugcuguucauugaauauuauaauguuuuccccuuccauucuuuucccuugcccguuucccacuucugaggcuaaaauaaacaaauacucuucuucccagacuaguuugaggcuaggggaguucauugacacaguuguagucaaugagacuuaaggaagcccuccucaagguuagcaguccugauaaaaucaauaacgcauacguagagauguuuuacuuuaugucuuuuuuauuuuuccuggccacccucaucuucuucuugcuuugaaacauagucauguuagcaugugaguuaugaugcugcugcagccauuuugugaccaucagggaaugaacaacaacaacaaaaaauucaaagaauucuggaaccaagugucucucgacuuuuucuucuaaauaauacaugcucuuacauuuuaugugacuguaggucacauuauguuucuuuuuguuaaaagcuuuacuaacugaaacagggacacugaaauauguaccugucaagcauaaguaaucccauuucuauauugggaagucguaauugacauugaccaaauauacuaagaugucuaagaaaucucugucuuucuaacacacacacacacacacacacacagacacacauacacacucacacacuucagucacuuuuccaguuucuuuuggucucuucgcaaguuucucuucaauuauauagagcuguauguccuuuaauuccuucuuguuuuuauuugcaugcuuauucucauuaccaauauuuuauaaaauugaaaaacauuuuuacuucggauuuauaaaauucuguccagaauauuaaacucagaacaauuuucuauuauaaugauccucguggcagauacuuguguuuaaucuggcaaaauuuaaaagaaaggaaugaccugauucuaauuaucuuaccuguagaaugcaugaauuaaaacuauugcaaacacagcaagauucaguagcuaagcaauaggugagaaacuugagggcaagaaauucugugcuuucuucacugucacuguauuuggccuuagaaaaguaauuuacccaauaguuugaaaucaaugagaaacauauauuuaucaugcacgaauauaacuggaaauuaauacucuuauuaaugaacaauaaguuagaaauaaaaaagguaauuauaauugaaaaaggguaguuagaaauugagggugguagaaucuggguucuccucauuguuuacuuagaaaguucagauuauugcauuagaagaccuuguuucaggcuuaguggaaucuucagauaugcuacucuuucauuuauuuuuuuuucuagucuaugcagcauuaaagugaaauccauguuccuucauuuauauuccuacuucaaucacgcaguggcugauucugaucacuauuauuuccuuugagaacaggagcuuuauaaucaagugaaugaucagugugguucuuccuccagaccucuuaagcucauaaauaaauccccauggucagcuaccucuaagcugcugauagaaaacaaucaaugugcagaucugaccuccauuaaacaacaucuauaacucgaacauauguuucuuuuauguuucaaaauacuuuuccuuuucaguuugggugaggcuugauauacucaguuugcauaacaguccauauguagcaauucuacaccccugcagguuuccaaacugcucuaagagauaaagaugucacugcaacacacagaaaccuaugugggaccuuaaugaguucagaagaugauggcaucauuaaggcagcaaagaauucagaaaagcagcaugucguaaacuaagagugugaauucaaaaggugacuuuuggagaugaggggagcauaaaggggguucuuucauaauacuauuggaaaggaguuuaguuuguaaaugaguuacaaggacagacuguagcuaaauaguagcaagaaauuucagcggauacauauucuuguauuuguaagcaaauuaaauauaaaaguccuaagaucaugcuacccaaaagaacacacuuuaugcuuuuuguuuuuuuacuuccagagacaaauauaacaguagaaaucaauuuguucaauaaaauaauuuggaauuuagagugaauuauucaaggcuuucagguuguuuuaagucaaauguauuauauuuuucuucaugaggaaaaaacuuacaagaaauacuaaguuuugauuugguaggcuauccaauuuauuaucauuuuuuauauguuuuuguuguuguuguuguuguuuaauuauacuuuaaguuuuaggguacaugugcacaaugugcagguuaguuacauauguauacaugugccaugcuggugcacugcacccaguaacucgucaucuagcauuagguauaucuauuaucauuuuuaaaguuaguuuuuaaccucugugggcaagugaagaaccuaugaaugaaacauaauaguguggaaaacccagcacugcuuugucaaccuagcaaccucaucacugcuagaccacagagagagggguggaacuuugugcaguaaggucucaugauuccagccuacucuucuggguauaguucaaaaaaccuacacuuuacuuugcagaaauaauugaaaaagaggaacaaaagauacuaugaaacugcaucuuuaccaucuuacauguaaauaaaggauuaaaguauauauuaaaacucauuaacauaucaaaccauaagaagguuauaucuguuuuucacuauguggaugauaacuuggcauugugauaagaaaaauuaucacaauauuagauaauagucagugacauaguacuuguccccauguguguaaaaaaggcugaaaaugauagaaugaaggugaaaauaaggcauuguuuuaucuauuuuuaaaauaucuaguuguaagauuaaaugucuuuuuucuucuuaugauccuggauuuuuaaacuuguuauuuucuuuugauuuuuuuucaaucaacuugauuccuuacuacauuucucuuccagauuucaaaggaaugugaaaaauuauauuuccauauucaaaaugcauuuuuaucuucuuugaaaacaccaucuuaacaauggauaaaaucagcuaauauugaagagacucuaccaaagcagggaagaggugguaacauuauaaaacugguauagcaugugcuuacauuuaaauauaaagagugccacuuauuugaaucugagauuuaaauugaagugugcaguccuugucuugggauagaaaaguuuaccacaugcuccaaauuugucaacaaaucagcaaauauaaaccaggcuggacacaaaugguauacaaauauacaaugacuuuccugaauggcaaguuuauuauucaaucuaacagagaaagacuggcaaaauaaucccuuaaacuuauuuccuacugugcuaguuuuuuuuuucuuuaaacaauauuacaauaauauaaaaauacuaccaaaaguucuauaaaauaaaauuacaaauaaguucaaauuuccauuguuuuaacauaucuuaauuuuugcgaaugcuauaauucaguuauuaaaauuuuuuucauaguuuuaauaaaaauccauacuuugcuuguuuguuucauuuagcauuucuaugaggaauuuugaaaaaaugguuuaguuugccaucugccucuuucagguaacaauuugaggccauuaauaaaaauuuauucuguauaacauaaaacaaacaaaaaaugcuuuuaauauauggcuaacacugccuugggggucuguuggacaguaguagcaauuagguccuauacugcaggaugaaauuguggaauuaucuggcagugaagaguuaugagauauuuugaauagauugagaugcaaaacuucaaaaagaaauccacaugggcagaguguggcacaaaaaaggaauauaacauauuguuaauugaucuugguaagcauccauguguuuguuguguaagcauccaugacuuugcuccuuucccaguauuauccagucuccucuacuccuuuuuauacagcuauagcucucuaacucacauuaaguuaaugugcuauagcagauuaaauugcuggcauuucguuauuugaggucaagucaucauuaucuuuguuuugguuaagucaccuugagguucucuuuagcuaugcaaauaugacucuuaacaccaauuuuucuaagaaaaaguaaccuuuucuuuaaaaugcaugccagugcacagugggaagcuaagucuucauuuauucccuucaguauucaaugagacuuugauaagucugugccuucgaaggagagaaaagguagguauccagaaaaaacuagacagaacuguuggugaccacagccuacgaacaccaacaugugcacacgagaacacacacuuaaauucacaugcauacacauacacacuuauuaugaauaaucacaaaacaagacuucaaaaaaugcaacauagacaaaucauucccaaacuuuggcaugcaucagaaucaucuaaagggcucaguaauacacauauucuugguguugaccacuaguguuucucacauaacauaucugggaaggugcccgguauuaauaguuucgacaaaucuccaggugaugcugcugcucugggacaacgcuuuaagaaccauugauauugacuacugugauugcuuauugcuguagaacuugcuucaguaauaguagagugggaggcgagugugccacuaccuauaaaaauuugguaggggaguacauuucuuccaccgaugguaccugaugcuauauccucugacauaugugagacacugcuaggacaguggaaacaguaaagguaaauaaacuucuuugccacacugcuaagacagcccuaaauuuuguguggcccuaugcagcacugauuaacugcaaaauuaagaauaaaacgcuuaggaugacugaugggacacuccagaauagaaacugagacuaaucccuuuggaaugaagaaacugccuuggaguuccucuggaguaucugaugagggcugccaaggagaagaguaaacuuuuuaaaauucagagaaucaggcucagaaucauaguaacuuaaauauuaaaagaauugucauuguauauugccauauacagucaugccacuaacaucucaaccagugacauuucugauagugguugacccguaacauuguaauacuguauuuuuacuguauuuuacuuuucuacauauagauauguuuagauacacaagugcuuaucauuguguuacaauugccuacauuauucaguauucagcacaguaaugugcuguauagguuuuuagccuaggaauaauagucuccaccauauaacccuggcaauaaugggcuauaccacguagguuuguguaaauagacuuuauacuguuccuacaacuacaaaaucaccuaaagaugcacgucucagaacauaucccaucauuaagugauacaugacugccuaucaauuaaaguugcguaagugugcuacaaacagcugcccucuccaugaagcagauagugaugaauacaguagaaguguacuuagaugagaaacuuggccaaucugauauaaguuccaucaucacaguaauuuuucauguuuuuaacuauuuuuauauuuuauuauaaugauguaaguccaaagaaauugacuugugauauaaacaauaaagcuccagaaauauucauaaucuguuuaaaaacucagauaaaauaaguugauuauauucuagacugacaaaaauaauacuuugccauuuuuaacguaauugccaaguaaagcaaauuagaacaaaaugaauuugcaaugauuguucaagacagaucagggaaagugacugauauaacaauaaaguacagauaugaaagcaaaaacacuaccuacaaaauaaugagauagaaaaaaaaacuggacaaacaagcaaaagaaaacucgggaaaaaaaggcaaagaaauugcugaccacauucucucuugcucuuuguuaguuguggcagcauguacaguuuuaacgaaacauuucagguuacagcucaguaagaauaguauuucuauaugcuaacuucaaucaauuagugaucuucuucccaaccccacauaauuccagauucauuaagucaggaaaaauguaaaaccauggaaagauacuccuuucagaauuaaauucuaaauucuuccccaucaauagcuucuucagcgaucucagacaaguuaccgaacuuuucaaugcuuauguuuuuucucagcuguaaaguugagggaaucacaaugaccuaucuugcacacuugaugaagagagcaucugauaaaaaggaaacaaaaaaagagccauugucuaggucugaggugacaugugcaaaaagaaugcuaccaucuuugccucuuggcaaagggggacagagggaaagaugaaacacuuuuucagugcuuuggcauuugguauaugaucuguccauaugucccaaacuuaaauucagagucucuaccagcaaaagcaacugcuuuuauuucuucuuaaucaguaaugcguuucucccccaagguauuuacaauguagaauaaaacuacagcugcagaauugaacgauuccuuauuuuuauaugugccuauuaaugaguuuuaauaauuuugggcuccgaucauacuauuacuagcaauggucauuacacaugccaaauuaagauccucaaacauugaggcagucagucuaaaacuacauuuguguugaauaagagugauguggagcacuauuuccucugaauuuguuuacucacagcugaaaaucccucagugguaugaccuuuauauucagcauuuaaaaagcuuaacaauacuuucccccagcagcuuaaagcaggagauaauucuuucccaggagaaaauacaauuaaaaugcugcaacgccuguuggagaagugaaagcaaggauaaugacagcuauaauagaccaaauaauuguguuaauuauuuauuuguuugcaguggaaggcuuucaauauuuauugugcucaguucaauuugauaguacuuuugucauaccuguagcuucaucuaggacaggacuauccagucucaaaugagaggcaauugcuuacaaauuuaauagucgaauguauucauucaucuguaauguaaauaucuaaaaaugaacaauuuaguuuggggaaaauaaaccuugaaacauuuuuaguuguucuuugcaaauuguugguaagcaugugcacacacauacaccacacacacacacacacacacacacacacacacacacacacacaccagguauuauucuuugucuggucaaggacugacuucaugguuuccacggcaacccaguuugcucagugcucucuuucagcagcugcugauuacacuuugaauuuuauuugcauucaugauuaaggaggaguauaaaagacugagguaaauuuuuuuaaaaaagcaacgaggauagaagacauuucagucaaugacucucugcagcuuuaauuaaaaauaaaagaauaagaggagauaccaggauuucaggaacuuuuauuuaaugguugacuggcuauugcaacaauauuaaaugaagaugccacuaccaaacugaacuucugcaauuugcagggcuauacauuguuagcuacuaagaccauguagacaauuuuuguuuuccaguaauggucucuuugcuuucagaaaacaauaaacacauauuucuaggacuggauuaagauaaaacaacuuaaaaauauuuacuacaguauaauuuguugaaaucaugcauuguaccuucaggaagaaugcucuuuaauauaaaaugucacuuguacuuggccuuuuuaaaugcacagaaauuuauucuaccaauaauaacauaggaaaagaaagugcaguaauuacuagugauuaacagagcauaaauagaaagauaagaacucuggguuggaaacauggaacucuauugaguaagacuguagcauuuugaaauacuaccuuugguuauguguagcauuauuugcuaagaaaauguaaaauaacuaugauaaucacauauauuuauauuagugagcaaaaaaaauuggaagaaaaauauuuuuaauuauaccauuuauaaguaacaaauauuuuucauuucccuggguucccuugauauacuuccaaaaaaacacuguuuucuuaaaauagcaauaaauauauauuuaauuauuuuauucugcuggaaacuuuucccuuuggacaaaaauuguggccuaaaguuuguguuaaugcauuaauuuuuuugggggggggauaauuucagacucacauuuguuaaguuuaaacuaaugaaguucaaaucaaugaaauaauauuuugaauuguaauuaguaaaagaacaaagaaaacagagagucaaaagugaauacauaaaaauuauaauguuucauuauuuuggacauaacugaaucugcgugcacauauccuagaaaauuugauauuuaauuauguuuaugagggucuugcauuuuuauuuguuacauaaauaaaugagaaugcuguuagguggcaaaaccauacuguuaauguauuauuuugaaauucauaacuuauuuuaaaacagaauaauaauuuacaugcuauaauaaaagagugcagaaucugaagaaacauaucauucuauaaugcuuuguggagcccuuaauucccauuauuuuauugcuuuaauaauuuaguauuauuagagauguuauucuguuuaacuuguccuucuaauauggacauauucacccagaugaauucuacuuuagaaugcuagagcuugcucugaagcagaggccaccaaggaaaucaaagccuuuuaauaaacccaggggccauauuuaacauuugucucaauaacucuguguuuuccuugccauacuagguccuagugaauugaaaccuucuuccuauuacauucuuaacuauauucagauaaaaucaugcuccggaaaaggaaaugucaaggcugccuggaccauaaaacuuacaacuacugucuuucccuuuaacaaaaaguauagagucuaagucuccauuaagaaaaaaauuagggauuugcuuucucuucccuagccuaucuugcuguaauuuguaucuccuuuauccuauguaccuauccagaugaaaauuuuauaauaaguggacaggaacauuuucugcagcuuuacuuucacacaaauaauuuuuauggggguuuggggcgaaggaagcauuuuugaaaagggaaaaguuccucauucacuuuuaagcauuaggucaaauaacugugauuuucagaagucagugauuugccacagacggaaguuuguucagaagucccacagagagggaaccagauaccugagaagguauccugagaagagaaucagguaccugacucuccaggcagacuaggacccucacugaaaaacggagggaaaacuaaagaaauuagaaaggcauagguaugcuauaaagcagaaaagagcugaaaaccagagaaaggauaaaaacugcacuccuccucaugaaaugacaaugagugcuuccuguaugcgccaaaaauucagaacaauagagacuggcuggcacccagaugcugaaaucugacaugagcugcuagccagcugacaguggggcacacgugacuuacuaaaaaugacaacaggggcaccgucauccugaguggggcaacuaacauauucagcaaagacccuuuacuggaaaacccacacuguuugaccuguuagccuaugggccaucaauauacuuugugauuuuaauuuccaguuuccaaaaauauacuccauuucucucccuggagccuucaacacccagaacuucaccuuugaacuggcuuagaaaacaaucuuaggucucagagucuuauuuuuuuccuuagaugaguguuuuuuuuguuuguuuguuuguuuuuuaagucaucagagugaccuaggggagaaauuagaguauucaucuaccuggggucaacuguaacaugugcuugguguuaggaaucaauggaagagauaguuucucuagccaucuagagaaaaugaacaaagauuuggccaugugggaagaagugaaugcuugcuuccaggaacacuggacuaauguuguuaaauaucauuuugaacugauuaaauuuauucacaauucuaugauaaguacaauaauucugauuuuugagguauguguauauauguguggagagauuaagugaauuauugccagcaaugccaguuucuuguaagaauacaguaaaaaaaaaggaugguauaauggcacugcaguccaaauauaacaguacaucagcaacuaaauauuuaguuuagauuuauagaaaaaucaagaggacaguagaaaaaucccauauauccuauagucaguuucugcuauuauuaacaucuuauaucaguauaauacauuuguuauaauugaugaaccaauauugacacauuauuguuaacuaaaguucacaguuuauuuuggucuccauagcuuuuacuuaaugucuuuuuucugugccagaauuccaaccaggcuaccauacuccauuuagcuggaauaucucuuuaugcuccucuuggauguggcaguuucccacacauuccuuauuuuuuuauaaccuugucaguuuugaggaguacugguuagcuguuuuguaggauguuucauuuugguauuaaucugguauuuuucucaugacaggacuggaguuauggguuauuagaaggaagaccacauaagagaugugccauuuucaucacaucacauuaucauauuaaguguccauacuaucaacaugauuuauuacuacuaauguccacauugauuacauggcugaugucaagugccccuuuucuuugagauaggaguagccacauaaauuauuugggauucuucugcuugggaaaugugucucuucuuuccuguuuauuauucauuuauuuguaucaguaugggcauauauuucuuaugaagucaacuaaauuuuaauagcuuccauacaagacauaaggcauaaaagcaaagcuaaauggcaacuuaguaugaaaaugguugcuuagugcauucaaaaagaaucugauuuagaaacaacacuugccaauacaagguagaguuggcaagauggggaaguguuuccuuacaggaagagaaaagaggaucaguggauuguugacugaaaacuacucugauuaaaauacgaguacagaauaauauaugagaauauucuuucagauacuaaaaagaauuugaaauguaauuaaauuuguuucuguaaacuuucuaaacuuuuuauauacauacaacaagguggcuaagaugguuaugagaaucuucucuguugaaauuccuucagcuuucacuuuuaucuugaaaucuuacacuauuuuucucuacauugcccuuuagguaaaagaagaaugugaacuuuaaaagaaauucagugggggaauccuggcauuuuuauuccaaaagcuagaugccagaugccugaagaacgaccgacagagauuguuauuggucaucacuggucauggcuuaaaugugcaaaaaauguaauaucaugagggaaagaggagcaggugagaaacugaaaacacuagaagagcauuucaugguuauaggaagaugugauuuauggauauaaaguuccugaaaauaaauguuuauuaccuggauucaaauacacaacaaauauucaguucauuuucuauuaaugaccuuauauucuaggagacuuccaagcauucuacaaguguuucuaucuuugguugacauucuuaucaauuauaacauuuuuuuaaagacuuugggggauuaaucccacucaacucaauuauugauuuuacugcuaucauacuguauuuuaaacauuagaacauuauacagcccccauaaauacuuggcuuagaaaauaacuacucauggcauacaguucauuuuaaugaucuucauuucuucagaauguuuauaaacacacacacagugggaaaaguaagugugagagaauaaaguuucguauuaucaauugguaggcagaaaucauuuacagaaugguauuuuggucuguaacgcuggagugggaaaugagaaagaugcuggacaggccccaguucaaaguacaagaugccaagggcaaagugagguuaauaaaaguaaguuuuaagccuguauuuauauuugaauuauuacccccauauuuuucccaaacauuuaaauguccccuguuguuugucuucuguuucauggcaauauuucuuucuuuacuauaaaagggaaugugaaaaacuucuauaauaucuaaagcuccuuuguuaacuggaugaaagcaaaguuauuuuggucucaaaaauaaauuaauacauacauagauacauauauagaaauauuaagcugucauaauacaaaggaguaaaaccauaaaacugagggaaacuaggcagauaccacaugagcagaugcaccaggaagccaaagcaguauuaggagcaaaaagagagaugaagacaaaagauaaagagggaacauagaccaaggccaacuagacaaaaggcaagaguuuacugucuaucugcgggguugccuguagaaccuuugaauuaugagauaucuauauacaugaaacagaauuagacauagucgauucugcacucugccagauuuucuccagcuugcguauagugccuuaugagcagcagcaucccagaaauaucacuguucaucuaucuucauggccuacacaaaaauauaacacagggagcuagaugcaagaaacaguuucuugauaacuauaagggagugcacuagcuuaaauuaugagcuauuuucucucaaucuucauuagcauuuauuuaauuaaaaucuuuucugaguguccuaaagccauaacauaaucaaugcccagaaagcuuccaaugugaaucuuuaggauauacacugcauauuuuaaauguccaggacacuaaugauaccuugccaugaucacaaauguccugaagcauacacaagguugccauaaucucuuccaggccaugagguuaucaucuacaugauuauuacuugaauacauuuaaaugaucacuuaugcaccuuguaaaaacuuucaaguuacucucagaaaguauguacaagaaacagugacuuaaauaaccagaaugcuuaugguugcuuaagcaacaauaacaaaaucuccuauuuucucuuugauuuuucaacauuaauauagaugacugaugcaaaacuaauaucacuuuaacuuuacugcagaucaauuugaacauuuauuccuuauaaaugcuuauucuacauucuuuaaaaaagauuucuucuuuccuauauuugaacgugguucugaaauaucucuuuugcaaacguaauggacaauaguguccuuuagcuaaguguuuuuggaaaaaaaaaagaugcuuuuuaaacuaaaaguaucuuaccucaucgagaucccauucuuuucaaauguaauauauaaauugcuaaauaucuuccaaagauauaacaacguuucuaaguuucuguucuugaagauugugcaaugccuaaugagaaauaaacugaagaugucaaauucuaacaauuuguauaaacucuacgaagcuuucuccaugucuaaaucaaaggaucauuuugggauuaaagucuugaugagugagguuuguuaagauugagaaauacuuguugguuuucugcaguuaucuaaauaauuuuggaaauuuagaagacaguagucuucuacuauacugcuuguuguacuaucacuuucuucauuacuuuuucauguaagguuuucuucacuuauaacuauaaacuacuuaaggguagagacauuugucuuuuuuuauuuuuauauauauauauuuuuaauuauacuuuaaguucuaggguacaugugcacaacgugcagguuuguuacauauguauacaugugccauguuggugugcugcacccauuaacucaucauuuacauuagguauaucuucuaaugcuauucccuccccgcuccccccaccccacgacaggccccgguguuugauguuccccuuccuguguccaacuguucucauuguucuaucucuugcauaccuaugauaagcagauuccaauuacauguuugauauuugaucacaucacuccucauuuuaaacuucaucuucaagaaaacacaccaugcucuuuuacauaaaccuauguguucugugaaccuacuaucacacuuucggaaauaaacucccuuccaccccuuauucuagagaugaauuuguauuucuccuuuuagagaugguuuggccauagucugugaagccauugcagacugacuuugugcucucuacucuuuccuacauuuucaccauuguguaauguuuuauaugacguauugcaccauuuaugugucuguaucucuuccuuaugaucuauaaguuuauugagggcaaggauuaucucuuuuacucuauauguuaaugguaucuaaaaccugguagaaggucaaucagcaaguaucaaauuguuaaaaucacuuaacucugggcuuuauaaacugcaguuugauuucugaaugaucuugaaaguuaccaacaaacacuuaauugcuaaauccauaauucauuuucagucaauagguauaaaagaaacuuugucauuauacucaagucucuuaugcuaguuaaucuuauucauuaacagaccuugauaucuugccuagcaaagauaaaggaauuaucugcugggaaaaauauuuaucuucuauaaucagacacucaaacuauuguuucuuuuuucacuccucuaaaauauguccuccuaauuggcagcuaaaguauaggcccucauaaucucaugacuguauuacugcaauaguaagcaauacuggucucuuuguugccugccugcucuuuuuucaagaguggcuacuuggccuaauaucuagugaaguaaaguuaugguauggucucuuucauguaaaaauaucaaugauuuauucacauaggucuuaaugagcuaaaauaguugcuaggaauguaauuucucauuuuaucucucuaucucucucucuauauaucuauauauauaugcauauauauaugcauauauauauagauauauagagagagagauagaaauauagagauagaaauauauauauauauauagagagagagagagagaaaagauucaucauguuugcauaagauagcuucccauccaauaggcuacagucuuauagacacugauucucucuauuagauauaacuggucuccauuacaaaacagcucacuuccugguuccuccuuacuucagagacacuaguaaagccugcuguauuccaacuaaugaggacagauauguaauauauauacauguauauauguauguauguauauauacacauauauauaaaauuauacuuuaaguucuaagguacaugugcagaaugugcagguuuguuaaauagguguauauauauauauauauauagagagagagagagagagagagagaaagagagagagagagagagagagagagauuuaaaauauauuauuuaaaauauauauuuuaagauguauauuucggccgggugcaguggcucaugccuguaaucccagcauuuugggaggcuaaggcaggcagaucacgaggucagaagauugagaccauccuggcuaacacggugaaaccccgucucuacuaaaaauacaaaaaaauuagccaggcaugguggcgggcaccuguagucccagcuacucaggaggcugaggcaggagaauggugugaaccugggaggcagagguugcagugagucgagaccacgccauugcacuccagccugggugacacagagagacuaugucucaaaaaacaagcaaacaaacaacaacaacaaaauauauauguguguauauuuuugucacuaaaguaaugccaaaaaccacaguuacuuuugcaccaaccaaguagaaguuagggcucuacucaguacaauucuucacacaucagaauauuucauaauagaaauauuaacuauuucauuacugauuauguaaaaugugauuuuuucaggaguuuugagcacaauagcaguuuuuauuaaaaauaugcuaagguagucuuuugccauucauauugcuaucauuuaaaacaugaguuaguuuucaucauuuguacauagugacccacauuugagagguuaauguuaagaauuaaagcuccccucauauaaguuuaacuacauguuaagaauuaaaguuccccucauaugaguuuaacuacaacucaaugaauuaaguuagaaaucugaaaugucaacuuucagagauuguaagacuccuugaaaccagugacaguugacacuaaccuaaguaaugguauuaacaaguuuaaagaaggaauaugccagucaaaaaaugugagaaguucgccauucugcaagaucucauuaagagagaauugugagaaaaaagaaaucuaagcagugcccuguaaguuaccaacacaauauuuuuauacuuugauuuauacaucagucucugagaauuuaguucaccugauucucccacuagaugauacacuaucaguaugcaaacaaaaucagauuugcuaauuucagcuaccuugaauucaucaagauaauaucaaacucuuaauucccuucacuaauaauauuuuauuuauuuauugaaacacugaaaauucucuauuauuucaagcuuucaaauucuguugugugaaaucugauuuuuguucuuaauuuuacaaucgcuaccauuccuuuacccuuauuuuacaguuucagguuuucauaugaucucugacaauguuucagauccaagauaaccacugcuggaaacccuaaugaacuuaaccagaaagauagaaugcaaaaguaggauccagaaagaugccauaaauacagcuccuuguaaauucgccgaccucgaaaauuucuuaaaauuuuauaacagauacagugggacuuucuaaaaggagaugaguuauugaacuuaauaauuauuaauuucuuaccuaacaacagguauucauuauuucaaaaguauugggcauuucaagagugcuuauucucaguguaacacuguuccgaccgauuuuucauuguuaaaauacccagugacucauugaacaagugaaaauacacaaagacuuaaauuaucacaguuaaccaggacagaauuaauaugauauccauucugaugaauucuggucuaauuguucuuacugauaauaaccacauacccuuuacauuauugugguuuggaagaggggaagaagaaaaagaauacacuuuacaguauacuucugacaauuaaaucuuguuaaacuucaagaccaaacugaugcccuaaaauuucugucaccaucuugguccagaaauacuuuucaaaucucaaauuguuugcacaauuaaaaacaacuuauauuuauuaguuacugcuuucauuguuagugauguuuucuuucuuuuuuuuuuuuugugauucuguaacuccugcuuuuaaugacuaugcagguugcuucccaaacacaucaauuuuaagguuauuauaacuaaugagaaacuuguuaguuuuuauauuaaaguaaaugaaauugaguguuuauauauuugcucuaucuauccuauacacaucuuccugaauuuuaaaagaacacagaacauaaaucaguccaaugaacuaaaucuaaacuacauagaaaaugaacaagaauaaaacagaauuuaagguccaaaauaacuugggagaucaacuaaauuccugugcauuugacuagaagaaacaauccagagaaagaagcggucuuaccuaagauacaaaggagauuugaguuauguagcccaacuuuuugcacacuaauaccauauauuuucagaaaguagaaauggacguuaauugagcacuuacauguguuaggcacugugcaguaugguuacugucaagcugaguauuguuauuaacccauguacagaugagaaaacugaagcauaaacaugcccaaggaccaagguuaguaugagccgggauuugaguuuagcuguagacugcauugaacucagaauuuaaaagauucaucauauuugcauaagauagcuucccauccaauaggcuacagucuuauagacacuguugcccucuguuagauauaacuggucuccauuacaaaacagcucacuuccugguuccuccuuacuucagauacacuaguaaagccugcuguauuccaacuaaugaggacagauauguaauauauauacauguauauacguauguauguauauauacuauauauauaauuauacuuuaaguucuaagguacaugugcagaaugugcagguuuguuaaauagguauacaugugccauggugguaugcugcacccaucaacccaucaucuacauuagguauuucuccuaaugcuaucccuccccuagccacccacccccagacaggccccgcugugugauguuccccucccuguguccauguguucucauuguucaacucccacuuaugagugacaacaugcgguguuugguuuucuguuccuguguuagcuugcagagaaugaugguuuccaucuucauccauguuccugcaaaggacaugaacucauccuuuuuuacaguugcauaguauuccaugguguauaugugccacauuuucuuuauccagucuaucauugauggacauuuggguugguuccaaguuuuugcuauugugaauaguaacccaauaaacauaugugugcaugugucuuuaucauagaaugauuuauaauccuucggguauauacccaguaaugggauugcugggucaaaugguauuucuaguucuagauccuugaggaaucgccacacugucuucuacaaugguugaacaaauuuacacucccaccaagagugugaaagcauuccuauuucuccacauccucuccaguaucuguuguuuccugaccuuuuuuuuuucuuuugagacagagucucacucugucacccaggcuggagugcaguggcacaaucucagcucacucuaagcuccgccuccuggguucacgccauucuccugccucagccucccgaguagcugggacuacaggugcccaccaccacgccuggcuaauuuuuuguauuuuuuaguagagacaggguuucaccauguuagccaggauggucucgaucuccugacuucaugauccacccgccucggccucccaaagugcugagauuacaggcgugagccaccacaccuggccuguuuccugacuuuuuaauaaucgccauucuaacuggcauaagaugguaucucauugugguuuugauuugcuuuucucuaaugaccagugaugaugaacucuuuuucauauguuuguuggcuacauaaaugucuucuuuugagaagugucuguucauauccuuugcccacuuuuugaugggguuguuuuuuuuagaauacaaaaucaaugugcaaaaaucacaugcauuccuauacaccaauaacagacaaacagagagccaaauuaugagugaacucucauucacaaaugcuacaaagagaauaaaauacuuagaaauacaacuuacaagggaugugaaggaccucuucaaggagaacuacaaaccacugcucaaggaaguaagagaggaaacaaacaaauggaaaaacauuccaugcucauggauaggaaaaaucaacacugugaaaauggccauacugcccaaaauaauuuauagauucagugcuauccccaucaaauuaccauugacuuucuucacagaauuggaaacaaacuacuuuaaauuucauacuuuaaauuugguuucauauggaaccaaaaaagagucugcauagccaagacaauccuaauaaaaaagaagaaagcuggagggaucacgcuaccuaacuucaaacuauacuacaaggcuacaguaacaaaaacagcacgguacugguaccaaaacagauauagaccaauagaacagaacagaggccucagaaauaaugccacacaucuacaaccaucugaucuuugacaaaccugacaaaaacaagcaauggggaaaggauucccuauuuaauaaaugauguugguaaaacuggcuagccauaugcagaaagcuaaaacuggaccacuucauuacacuuuauacaaaaauuaacucaagagagauuaaagacuuaaacgaaagaccuaaaaccuuaaaaacccuagaagaaaaccuaggcaauaccauucaggacauaggcaugggcaaggacuuccugaugaaaacaccacaagcaauagcaacaaaagccaaaauagauaaaugggaucugauuaaacuaaaaagcuucugcacagcaaaaggaacuauuaucauagugagcaggcaacuuauagaaugggauaaaauuuuagcacucuauccaucugacaaagggugacguuuucuuuaaagucuguguaacuuuaauagagaagguuuaugaauauacuuauuuuguucuuucuccuuccucaagaaguaacuagcucaacauuuuuaaaacaauuuuggaauuuaagguaauagggacuugagaguucaucagauuuuuuauccuuaaauagagaaauuacaugccagagaaaucugguauuuucuaaauguucaaaaaugugcugaucuucgaaguaaaauaaaaacaauuugagugucuauccauauuaucuuuaucaacugugcugaaaaauuaagaaauacuacagacuucuguaauuaccagaagagcuauauauccuaggaccaacaaucuguagauuuacugcuuuguaccuuuccuaacgugaauucuuugccaauuguuauauuuaguuaauugaaggguuaauguuuauccuauguuaucaaguguuuagauaaaagaauggagaaauagcuuauuuccucauacagaauaaaaaaaauucgcuauuuuuuaguacaacuuuauggccauacuauguuaaaauguaacaccacuaccaaauaaucagagcucaguggaauauacacauucccugauaguaugggaacacugaaaaaugugacauaaguauugcuaguaauacauaaaagaaaguaaauuacacuugauuuuggugacaguuuaagggcaucuaaaagcuuugcuguguuuucugauaacauuauuggcuaacuuccuuaucuuuuuaugacuauuagcaaaaauaauaaaggaaagcaaaaacacuuuucucugaaagccauuauuauauuuuaaauuauuuugauuuucauuaauauguuuauaauaaaacuuaauuuuccuagaguauuuguuucuauauuaaacugauuaaguuuguuuacuugaaauacaggauuguuuuaccauaagaaauaagagcacagagugcacaaauggguggcaggggaguaggagauccaaacacuaaauuauauggcaucauauguaaaugcucauuuuuaauacuauauaaguuggagaguugcugugcuggcaucaguuuguacuccuaccaucuguaaagguaagggauauagauuuuuuucagugcaccauguauacacuacuaggaggagagagguuguuuuagguuauaagaagauuauugccaccuuuuggcccaaaggcuaagggagaaaucuaaaugaccaccgaaauauagacucauugccugauuaagguaaccagaggugagacgucuccagcaacaggaauuucccaaagaucauaaaggaucaaaacuaggcaaagaaucaacuuuuaaaagcuuccugguccacagagauuguggcuggcagccucuaugauguucccugguuauccucaucuccuaguauucaggcugucauauuccuucaccuugagauucugcugggcuuaauaacuggcuaccaaggaguaaaacacuacagaguaguggaaugucacuccugagauuagguuaaagaguccaugcuuacauuucaggcucugcucucuuaccuguuuguggugagagaagccagauaucacauugugaucugcccuguaaagagguccauauggcaaagaacugauuuaucugaccaauagccagugaggauuugaggccugccaacagccacaaagugaguauggaagugaauccuccccuugucaauccaguacuugagaggauaguagccuagguuauaucuucauuauggccuugugagagacccugaccuagaacuagaggauaaagggaagccaugcucaguuugcaggcgacccacagaaacaaugagaaaauuaaucuuucuuguaguaaccuacuaaauguggggguaacucauugcucaaacaauaaauaaccaaugcaagauaaaacuaguuaaaggcaggaugcaguggaucacaccugcaaucccagcaguacgggaggucuaggagggccugucacuugagccaaggagcucaagaccauccugggcaaaaauagugaaaacccauuucauauaaaaauacgaaaaauuagccaggcaugcucgugguagugcacaccuguagucccagcuacuugggaggcugugauaggaggaucacuugaacccaggaggcggagguugcagugagccuagauggcacuacugcacugcagccugggugacagaguaagacucugccucagaaaaaaaaaaaaaaaagcagacagugauagggauuaaaagaagggagagagcuuaggcuuucuuuaacacacggaccugagcuacagagagaagaaauauuuucuuuuauagcuacuucuauuuuuuaauguagucguguacuggaaguuuauuugcugaauggugacuauguuguuucuuaaaacgacugaaagaauguauacuguccaagaauaugcugaacacgcacggggccagccauguauucauggaggaagaacggaaguuaacccccacugaguaaaguuuauggagagacucugagacuagaauaaaguuacauuuuucauuauguucuaaguuggguuuaauauacuguguauaaaauucucuggugauuuuuuucuguugaaacauuggacaaagugaguuaugugccuugauauucaggggaauagaguuugcccagggaagaaauaagaaauguaauauaaugucuagccugcacuaaauaaaggucacacacuuguugggacauguuggugaguauauaagaaagcauaguugggacagaaaacaguucaagaucaacagacgugccguguagaagucguguucaaugggcaguauaacaccugagaaagcauucccaggcagagugaaauaucguuguauugugcaaggugauuggauucuuacuauugucggcuuguuuccuacuauuccaaguuuuuaaucccucagguuuugcaguuccaaagccuaguuuuagaaaaaauaaggugcugacguacaagguuuauguacaaacaacucuguaacaacagaugacagacugucugccuugcccacauuauugccuucuauuauuugagaaccacugugguauuguuugguuuuguuuuugucugaguuuucuucccaucugucuaaaugugguuuguuguuaaauguuacuggaaauaugucauguugcuuuauucuucuuucccuauguuguucaccugccuggguagcccggcagacucacucauauaacaucaacccaguagguagcuugacagacagaucagcucaaaggcaguucaaaguuuucucccucuuggaagucacccccuucagggagagcugacgauucaucuuggauguauauuuuuucauauugugauuaccuacuaaucacaacauucuaugacuauguguuuuucuaugaccaaugucagucaaaguaagaugaggcacauaggccccaaacuguuugguaaguuaauauaaaaugaaugaauaaauaaaugaccugcuugagauaguggggacaauguggugaacaguugaggucauugcucauagagcugcaucuuucaagaccauaaaagcauccacaaacagaccucuucaaauggaaaacaaaugaaaauucauaaaaugaaaaaaaguugaaacagaaacaaggagagagaggagaggaauggagauagagaggaaggggaagagauaauauucagggucuguguugaccaugccagaaagaccaacaguauuauguagggcaaagauuuugguuaauauagcuagaccuccuaagaucagucaugagagcaaucaugccuccacaaagaagccuuaguaaaacuucugcacaacgagguucuagugggcuuuccugauucacaauacuccauguguacagucucacacugaugcuaagaaagucauauuguucugacuucacgaggggaggacaaccgaaacucuauguuugguauuuucuuggagucugccuuagguacuucuuccugcggugguuuuuaauccauaucauuuuucuguaguaaaccauaaccauggguauaauagcucucaaugaguucugugaguccuucuagcaaaucaccaaacaugaggguaguuuugggauaacccugaauuuguaguuggugucagaagugaggguggucuugugugaacugugcucccucuaacuucacagauugcuaaacucuccacagggacaaauuaauaugcauaggucuaucguugugugugauauugaguauauauacuugggugaaaauauuucaauguuagauaacauuuuugacacaaaaaucuguguuacuuuaugucauuugacacaaguuguaaggauuuucuugaugucaauuaacagcaacaucacacuuuauaagaaaaauaagaauuauaguagcuuucaggauagaaagaccugaaugaguuuuugaacugugacagauacuguucuuucauagaguguagcucagcuguccuguaucccauggguguuaggcuacuuucauugcuugauuguuuggggucauuucugggaaaugugauuuuuauuuucaauuuaugugaaguauacauucuaucuuuucagccuaaauaugauaauuguuuucuucuuuagacaucugcuuaacaagagaaaaggcaucugugacuguaucugcaaaaacaaaguagacaauaaaugcauuggauugcuuugcaggaacauaguucucaagugacauuaguuuauuugcuuccugacagaaaacaucaauaaauacuuucuaauuaagauaagaguuaagaaaucccuauuuuauuccuuagaauauaagagguaagagacuguuaauucagaaaaauguguaaagaugcuuuuagguugcucugcaaaaauucaauaucauauuuuuauuucuuuaaaaaaaaucugcuguucauauaaauacccccagaaaaggaaccucacauuaauguuucaagauucaauuuugugauccugcccaaaauaaaccuagauaguucaguucuaucuucuuuuuucucugaugacuccuguaaaucagcucaaaaucauccuuugguuuuggcccugaccucugaaucuuucuauuuucauguuugaaauauaacuuauaauugagaugaaauuaucagggcuguccuagagcugaaaauaggccugcauucauaaucauaaacuacaggaugacaagacuugugagcuauggugaaauugaguauaguuuuccccagguauucuagaaaguucuccugucucacugagauugugcuuuccuuacuucuuuauuaaauuauagguugcuggugcccuugaaauuucucacauuccuuuagguuagucuguuuauaaugcuugcuacucuugaaguauggcuagauugagauacacagaaucugcuggcaaauuuucagguugaacuauuucacaacuauauaaaugguccaaaacaauuguagaguuacaagaggucacuacuaucuuccccaaaguugguacaaccuuacccuacuguuuuagucaguucucacacugcuaauaaagacauaccuaagacuggguaauuuauuaaaaaaaaaaaaagguuuaauugacccacaguuccacaugacuggggaggccucacaaucuuggcagaagagcaaaggacaucaucuuacaugguggcaagcaagagagagaauuuguguggggaaauucccccuuauaaaaccaucagaucucaugagauuuauucacuaccacaagaacaggaagagaaagacccaccccaugauucaauuccucccacgacacauaggaauuaugggagcuacaauucaacgugagauuugggugggaacacagccaaaccauaucaccuauuuagagccaaaguauuuacaaaaugcuuguggugucaggcagcaggggaagaauuauugacagcugaaguucuaaagauuguggauuuuuaauuauauccguaggagaguggaugauacggccgggcacgguggcucacaccuauuaucccagcacuuugggaggccgaggcaggcagaucacuaggucaggaauucaagaacagccuggccaauauggugaaacccagucucuacuaaaaauauaaaaauuagcugggcgugguggcaggugccuauagucccagcuacucgggagacagaggcaggaggaucacuagaaccuggaagguggagguugccgaggcugcagugagccaagaccaugccacugcacuccagucugggcgacagagcgagacuccaugucaaaaaaaaaaaaaaaaaaaaaauggagauuggaucauguaaagcaauugggugcaggauuuuuuaauagucauuaaaauuucaugacaauaaaugcucauaacaagaaauuucacauccucuuuuucaucuuccccaaauagcuuugagauuuguuuucucucuuccucuucucucuuucccauuccuuuccucucuuuuuuucucaccacucuucuccucucucucugucucauccccuuccucugucuccauuccucucccucuccuuguuucuguuuaaaguuuuuucauuuuauaaauuuucauuugucuuccauuugaagaggucuguuuguagaugcuauuacggucuugaaagaugcagcucuagcugggcguggugucucacaccuguaauccccgcacuuugggaggccaaaguggguggauugcuugaggucaggaguucgagaccagccuggccaacauggcaaaauccugucucuacuaaaaauacaaaaauuagcugggcgugguggugcaugccuguaaucccugcuacuccagaggcuggggcacaagaauugacugaacccaggagggagagguugcagugagcugagauugagccauggcacuccagccugagcacuagagugagacuccaucucagaaaaaaaaaaaaaaaagaugcagcucuacgagcaucaaccucaacuguucaccauacgguccucacugccucaagcaggguuuaaaauuugguagguagaaaagaaacacuuuuaggaagacagaaaggaaagaaaggagagcgggagaaaaggaaagaggaaggaaaaaauacaguuuucuguauuccaaaaaaauucaagaugaaauaccaugaaauaguuauguauuuuuauaaacuuuccuguaaagaaccacuggggcacagcuuaaaaugggugucagaaaaaaggagagaacagaaacucuacuuuucaauaguaauaguauuacauauguaguacuaaauggcuuucuaguuuguguuugauucaaugaugaaaaugcucuguacauuucuccagcuguguuccccuagcagacugggacaugcaguacucuaagagcagcuguuagcccucaugcaguuuuauuugcaugcuaagaaagagcagccuggcacaugaauaaagcauguuuauuuuuaucacacucucccaguaaguuaguuauaccuaaacauuuucuuuugagagacugggcagaagaagcuaaucaggcaauuuuucaaagcaaucauuccaauaauucgcuuuuugugaauuaaauuuuugucauauaaauaauuggaggaagacuucauuaaauauuaaaaaaaaccugaugcuauuguauauuuuguuacuauuacucuaauaauagcaguuuuuauuaacccuacuuucucaucuugaaauguaaauauuguaacuuuuaaaaauaugauauuuuuagugugaaaaaauacuccgguuuacugguacuuucuauuucaucauuuauagcuacagaggaaaaucuuaaaacaaacacaguuuaauauuaccaaaaucacaauuacauguaguguuacaauguaauacugcuauaucaugucaauaaaaggaacaacaauuauuauuuaagaagcucacauuuggaaaugcauuagaucgauaugucuucaaauucaaaauuaacaaauauuagugaaucuacuguauuaaaauguugguaaagaaauauauuuuuaaaaaguuauaauucauagaugaaaggguaggguuuuauuacagauuuuuuuugaagaugguaaaccaagaauucaguacuaaaguuuaaagaaaaauaaaguuuuucuuuauuucuauuugccauuucuuacuuuaaaacccuugaauagggacuuccuuggagaguuuauaauuuauuugcucuaugccucauuuuaauaaucuaaaaaugcuucccucuccauguaaugggaacucaggaugugauauuuaugaagauuaauaacauaauguuaaucuaaaauuguaagaaauuccacuuaucucaguuaaucucuucacaaaauaagaucacuguguuaacucauuauucuccugcucugcuuguauuuaugugcaugaaaauuuuccuuaaguaaucacuucauaauuuuucugggcuucagaaauuguaagucacacuuuuuaaaguacaucauuuacaaauguuauuauucuuacagauccucuaagugggagcagaaagcaggaccagcuaccucauuuucuaggccuaauuuucuaggccuggaguaaaaugaaaguauaggcucccuugcucaaaaauuauugagaauuuuaagacaguaauggcagacccaaagcgaauguagggcuuacuaauuacugugguuugaucauuacacaugaucuaauggaaaaauuguauacacauaucaaaaugucguacguauauauaaaaaaaaagauuccaaauuagauuugcucugcauacucacuacuaucgugguacuccaugguuucaucaucugccuaaucacgcaugauuuauuauuucacucuuccuuauaaaggcgcuagguaauuuaccuuuuggaacucuuuccggucucauuucuuacuacccuggcacucucucucucucccaagcagcguugguuuugcaguuccauggauacaccuagcacccuacugucuuggugcuugucauccccacccccucuaaaggcuugcaccaucaauucauucaaguuacuguucuagauaccuucuuuaucacucuaucaaagucaguacaccugucagugccugacuagcuuuuaucuacuuacacaauuuuugguguauccugucuuccucauugcauuauaagcuucaagagcucauggacugcgucuaauuuauucauuuuguucucaugccuaaaacaguacuuggcaaauuacaggcacaaaaugaguauuuguugaaugaauaaaucaagaagagacugaauagaaaguaugcagcaggaacauuuccaagugugaauuagauacuauaauggauuuauguucuucuaauuucuuagauaugacaugaaaaauugagauuacuuaaaaauacauguaaauauuacuauuuuaauguuaucaauaaaauaauauuuuagauuauuuaaauuuggauuuguauuuacuauucauauuaauagguauguguggugcuuuuagaaauaacuuuuauauuaacaaccugccauggaaaaauaucaaauguauccuaagauauuaaauuuguauuuagguauuucauuuagcaaaauaauaugagcuaacauguauguuuaaauauaucguuaucuaaaucucaauuuaaauuugaaguuaaaaaauguuuaucaauuucugaauuucacuguaaaaaucagugcacauuuuaacacuuauucaaucuuccucucaucuccaaagauaacaacauaugaaugugcuuugaauuauugaauauucucacugugaaaaugcaagacagguaggcaaagauuaauaaaacuugucuguggauacacucuguaaaauccagcaauacaaggcuucuuaguauacaaccaggaguacacucuuccuuuguccaugugauauauauauuacuugcuuuaaucuuuuguuuucuaggcaugcuaagaaauuguacugucccgccucaauuuucucuucaaugcuuccuuugagaauguugaaguuaguaauaaagugugaaaaauaguauguccaacugcuaugcaucagugaaacaaaccaucacaccaggcauauugacccuaaaaauuugacuguucuaacuacugauaaauaacuaauaauguaauccuauauaaauagcagccaaagagaagcaaauaaaucaccacuaccaaaaaaacacugcuuccacacauauaguucaaaaacaacugaagaaaaugauuuuauauguaaaacaaacaaaaaaaugguguugaucgcauuccacaguugauuugccaauguauuuggaaaagcaauuuucuaacucuuccccuuucuuccucucacuucugaguaacaucuaugcuucgcaucuguacaaacauucuucucaucuucacagauugccuauucuugguguuaccuacuauaaaugggcaguuuuucaggccauuaucauuuuuuuguauuuuuaaaaaguaagcagguuaaaauguaugcuguguaaguauuaaauuauaaaugaaugauauuugcauuucauuuguucuuagugaguagucauucuuaaauuuagguauucauaaauauacuccacccagcauuaaaaacucaagaugcaaugaucaggcaaggacaaaugauggcuaaaagaaaauuuucaaggaauuauaaugcugaaaaauacacacacacgcacaccucacaaaugcacuccaaauuauuaaaaauauccucuucuacaugauucuauuucuguaccaucaaaguaaaucugaaaauacuuauggaugagaaaaaaaauggaacugauuuucaagcauuaaaguauacauaacuucuuuguucacacauuguaaaauaauuuuuaaaaaucauaguaauaagaaauaaagccaagcucaggauacaaaauuguuuccgauauaauucauucuguacugaugagaaauauguuuaucuucaaacagaaauuguucccuggugaugcauagguuucucuaugcuaagaguauugugugaggccaaauaugcccuauaaauauuuuauaaugagcucaauguauaaaaaauuaagcuacaaagcaaaucucagaaaacauuugaauaaagcagaaauggguuauaacugagaccauaauuccaagcuaaauccuaauugauuauaacugcugaaagggaagauagugauuauaaaaagagaagaaaacaaccuucauuuuacaguuuguuagucaaaaauauuuucuugauauuacacuacuucucucagugaaagaaauuauaauacaucuuuaaaugaauuagaaaauuaucaacuuucccuacuuuuuguucucuucuaaguaaugaauauaauacagaguuuucaaacacaacuacuaggauugaugucuagauauuaauauuuuccagauuaacuugguuccauuucuaaaauucaaaaucaucucuuuuauucuagaaagcuuggagguagcccaggaauacacauuaaaaaauaaauauagaaugacuugauaaaucuaucaugguucaaauuucaguaaaugcuuguucaucuacauuaucucaugggaagcuauuauguuagagccaguuaccaagugaaaaugguuauauuuaaagccuauuucucacuguuuuuauucuucuuaagcuacuuacugcaaggaaggaaguuugccccggugguaggaacauuaaaaguauaauuuuuaaauauuauuauagguaaauguuacaaauuggacuacuuaaaauaauaaucuacauaaaaauucucucauauugccuggcuuaaauccauuuuaagcaaccaucuguaccaucaucaauugacaacuagaggaccugauuuuguugugagaaaaaaguagaugaaacaaauuccuacacaucauagguugaggagaauauuauaggguccuacauuacuggcuaaucuuacuaaguucagaauagggaacaugagcuucuaguauugcaugggauuaauaaauaucuguuuagccaaguuaauauugaauccugaagaauauaaacaugauacaucugucugaaaugcuguuuggcauaaacuuauggagaagucucuuuucuuuuagagaaauaugcugagaacuuaaauguuuccaaacacauuuggaguggauucaaauuuucuccuucuagcccccuuccucuuucucucccucucuuuaccucucucccucccuucuucccucccuccucuuucuuuacuuucuaucuuccuucauucuuccaucaacaaauauuaaugaaggcuuacugugugcuagguuugugcugaaugccacuuuuucauuaagcaauguacucuaauaugcacuuauauggauuaauuaaagccaguugccauuuuaguuaucauuucucugcuucacagagauaaaacagcuggucuucucuuuuuucuccucuuucucuuccuccuuguugcauuaaaauauagguuauuuaaucuccacugacaaagaaauaaugccauguuaauguaaucuuuauaauuuuguuucagugugauaguggauaagugggaggcugagcauuaggaacagaaagaaggaauuaauacuaccuaaguacuuuuuaaaauugacauuuaguuuacauacaacaauauaugaaaaucuuaaguauucagucauuaauuuugacaagugcauuugccagugaaaccaucacaccaaacuguagaacuaauguaaccuuuaaaauauauaaaauaauguaaaauacaugagguuuugcaauguuuaaaaccugucuuuuugaaagucuucaugcuuucugcuaaacuauaaagauuuuaaaauuuguacacauuuuacaggcaaauuugcuuaacuucagaagaaaauuuuaaaucucuagaagucaauaaauuuacagcuaaguaaauugaaauuuuuaaguucucauaauaaauucuaugguauaaauauguaauuuaugccccauaagcuauuccuacaacuucugagaaucaauauuauuccuaacauuaaaaucuauugcauacucauaaacagaaauuucucugcauuugucuccgagaaagauuuaagccucauuugauuggaaccuguuugcauaauacauuuuggaguuucauuaaagagggcuaagggagcaaaaaugaucuuaguaagacuugaaauuaugacauuuacaaaaauaaaugccagguuuugaauuaacaagacucagaauauaauuccguaucuggcuuuuuauuuugcaccuaccagauaguuaaaguaagagacuuauuugaaaugacuuguaaauuguuuuuauagagauuuucuuuuaucuuuuuccugcucaacaaugggcuagguggaagauacuccaaggaaaaacacuagaguaauguuuuguaaaacauuuuauccuacuucagugaacuauauaaaguucuguguaguuaaguguuucuaggugcugcugaaacacagcuacaggugcucuauuauuucuuuguuuagaauaaugugaacauuauuuagucuuaaaaauauuuuacccuuuauuucucuauauucaagaaacaaaauguaacacccaucauauuccgacguguuuuuagcuuauuuaaggaaaaguaaaaguagcuucaguuuaagauauuugagguuauaugugauauauaugucuuagcccuguccucaaggcauagaccccacuuuuaagcuucacuauaaucuguaaaauauuauaguucauuucagguauugcuuauuucucuuuuaaaaauuacauauuuuaauuccuuugugagaaaauaccacacuauuagcuguuuuagaauuuccugugugcugucaaaaaguguuuuacagaaaacggacauauguguaaaugauuugagaaacauugugauuaaacaaaguuacacagguuuccuuauugcagagcuucuucaaaucuuccaugaucuauuguguaucuuuaacagaagaauaucuuaugauauuuuuuucuugaaauauuucacuacagauuuuuuuucuuggaauaauuauuaacaucuagagaaauucuaucauacauacauaucauucaggaaaauacagccagcaauaugucauuaauuaaaaaugguaaaaucagcuauuucuaccauuaacuaauaguuauuauccaaagauacaugcccaauacagacacacacacacacacacauacauacacacacacacacacacacacacacacacacaaauguucucuguggccacccaauuuaaucuucucauuaaauguccuaaaaucaauggcacugguucacuauuuauacauaaacaaugucaacauucuuuacuggccuuuguguaucacuguagauuugggaugaaauaauaacaagaguauugaauauauguuuuaaaaauguuaaauucugaauugaaaaacgacacaagugaauuuuuuuuaaaugaacaugagggaaauauuuacaaaacaugcagcaggcaaagaaaacauuuacuauuauaucaaguuuuuaccauuaguaaguaaaaguugaacaaaauaagaaaaaaugagcauaauacuuuaguaguucacaaacaggaaauaaaugacuaaauagauacuuauaauuaaagaaagguagauuaauacaaauuaaaauuuuaaaaucuauuauguugacaaaggguaaauuaagaugcaauuuugugaaaacauuuugauuaaaaguuuuagaggauaauucagcaauaccuguuaaaauucaaaauguaguuucuuuaacuaggaauuucuugacuaaaaauguauuccuagaaaauauugcaaagauuuaugaucuaaaacauucauuacaacauuguucauaauagcgagcuugcaagacaaugugaaaaaauuuaaauguauaccaauacaugacuaaaaaaauaaauuacaguauuccacacaacgaauuagaaugcauagaaggaaagaaucuguuugaguugguauuaaagaaaguuuuaaaauagcauuuuugguauccuaaaaaaaaagagcugauucuuucccucauuauauaugcccacauauaaauauuuaugcaaacuuauaaacauauauauauguguguguuuguguguguguguauaugcguauguaugaaaaaggacauaaucaaagauagauacaucugcauauacauauacacaaacauguauuuaugaaagaauaucuauggaaagauuuuuguaaauaucuuagauucaagaauaagaguuuggagggcauucauuuaauugaauaauauauuuucuguauuucuggcuugccaauuuuguauucugguuuugccaaugaaaguaauggcaaaaacugcaauuauguuugcaccaauguaauaugaaguuuauguaaauaaaauuccucucuccagaguugaagcuauaaaagcuuugguuuuuaaaaauuuuaucauuuacaaaauaauauuguuauaauauuuauuauuuaaaaauaauauuuauuauauaaguauauuaaaauuuauuauaaaaauaauauauaauauacauauuguaaauauuauaauauucauauuauaaauaauuauaauauucauaauauacauauuauaaauaauuauaauauucauaauauacauauuauaaauaauuauauuuauaguauacauauuauaaauaauuauauuuauaauauagugauaauauauacaauauauaaauaauauauaagauuaagauaaaaauuauauaauauauauuauuuauuauuuaaaauuuguuuucauucauuuuuuauuuacaaaaauaagcccaaaauuuccuauuuuuuuauauuuagcagauggauuucaaaaguaaaucugaguccuuuaauaauuuuuaaaauuaaauaucuaucauuuuuauaauagaaauauguuaaauaacucuauuaacauuuauaauauagaucucuuaauauguucuuugaaguagaauuucauuuucuucuaaguuauuaauuuuuccauuguuuagcaaaguaguuuuagacaguuaucuauaaauuauccaguaagauugcuuucuggaaugcuuacaaagaguauauaagaugcauucuaaaaaugcuccaguuauuuucaugaauaauacaaaacuuauuuuuucaggcauuuauauuuuauauguaaaauuuccauaaaccuggaaaaauaacugaaauaucaauuaucaauuauuaaugggccugcccuuaaugacaggauuauuaauuacugauuuuuaaaauauuuuucuuucucuuuuuuuuuuuuugagacaaauucucgcucugucacccaggcuggaaugcaauggcacgaugaucuuggcucacugcaaccucugccugcagugcaagcgauucuccugccucacccuacggaguagcugggauuacaggugcccgccaccaugcccggcuaauuuuguauuuuuaguagagacgggguuuugccauguuggucgggcuggucucgaacuccugaacucaggugaucugcccgccucggccuuccaaagugcugggauuacaggcaugugccaccgcacccagcccauauauuucuuuuaaagaaacacaaacauuuuaaauauagacauuggguaauaaagaaaaguugucacaagucuuuuauuucuuaagguuuccccagaauaugaaagacugaaugccauaugauuucagauuuucuuugauauuacuaaaaauaauuccauuuuaaacccacauuuuaaacccacauuagucuuugacuauucaugaucagcaaaguuaugcaaaacuauguuuuuuuaccauuuauugguguucuuuucaauaaugagaauccuuuugccacaguggcauauguaugugaacuuuuaauaaucuagugauacaaucauguuauuaauuaauaacuguauaugaacagcaggauuucuuugcauuuuuucauagaauuuuaaaauuuuauuacagcuaaaaauauuaaaauaaaagucaucuauuaggcugaaaagaaaaauucauagggaugucggaacagaccagccauuuauccuugguaaauucauagaccauuacuuuuuucaugaagacaugauacuaauuguaauaugacauugcacucaaauauuaccucaauaaaacuuuaauuuuaguuucagauuguuacuuguaaauaucaaauaugauuaauuacugguuugugaauucaucaacaauacacacaaaguaagugcuauuuucauucccguuuuauaaauugugaacuguggcacuaagaagucaaauaucauguccagugucacagaauuaauaaguaguagaaugaagaaucugaacacaggcaaucggauuccacaaugcauucucuuaccucuaugcuaucauuuacuauucuuuaaaguauuguuuuaaaaguuuuuuuaauuuguaauuuuuauggauguauaauggcuguacaugagguacaugugauacuuugauacgaucauacaauguguuacccuuuaauaucucucuuaaaacgaugaccaaguuuugaauuuuauacaaaaaagagagcaucuggagccaauaagaggaaaaaggugaagggaaggcauccuuuuaagauaauuuucuaaggcuuugggcauguaauccugaccauuaggaaagcagcagcugugaugugagugaggguaggagagccuccucaagaguccuacuagucugacuaucuucugcccuuuuuuauuauuuuuaaggcuacgaauucugaaaggaaaaggaugugaacauggaagauauguuaauaaccaaaauguagaucauuuuugaucauuucacccaggucuuaaugccaaggucauagaacugaucacagcaauugguuaaauaagagucaccuaucucaggguuucuuaaacuugaaaaacuucaggccccaagaauauggucuuagaagacagcuugaaaaacucaaacugacaagaaaacaaaaacauuuauucuucauuuggcuccaagauagaagcaaauguaaguaauaaaaaaaauugugguauuuggcuguaagacugucaucuaauucuucuaguauguauauguguacauguauguguguguauaugaauguguaggaacacugacauaauuuauaaaugaaauaucauggagacuuuuagauccuagagaauauauauuggaacucagucugaaaaacauugaugaauauaaagaauuucauuaugaacacugcagugcuauuucacaacauccucugauuuaacuaaagacucccuuuauuccuucuugagcuagauaacucacauauugugaaauaaaauacuacuaaauaugcauuuucugauaaggacugguauuuaagggaaguggaucuagauuauuuccacuucugaguaggccuuuuacuuuuaauguaaaaguuuuguuuugaguugaagucucucuuuuuuacaccuaugucaaugugcuccuacaaguuacuaggaguuuuagcuuuucauugauaugauaccacuuugcuggauacaauagaugaaagcaaagaauaauaagaaaggcaggaaccuaauccaacaaagaaaggauuugggauuuuuuaacuuacuuucucuuuacaccagugguaaaauuagauuuugauuauugauauacucaauuuugaaauugauauacucaauuuugaguauucuuugugaagaccuggugaauugugcuauuuuauauucauggcugucuucaagcuuuauaaauugcucuuaaaauggaauugaucucucaguagauaagcacagcuaacuuuucguuagugaaaaccagugauggaugaauaacgacucaaaauaaauaaaaccuccacuuuaaaccacaaugccaacaucucucaccaagcauaaagccaaacaagcugauauuagcuaguucuguuucucuuucuacucaggaugaaguuguaauaaguaaugacacuguuauggugaaaacuaaaggcaaaccuagaagaaaaugccauuuuauauaaaaaaguggccagcuaacugauuagucccugaguaacugaaacuuccuuguagguuuuuuuuuuuuuuuucaacaaaauacacugggaacuuaaaauuaaaauaaaacaauuauucuucauaaauugcagcaaaauuuuguucucaguaucucccaacauuucauagccuauccauuauaucuaucucucuuuccuugagaaaaaguauaauuuauacugaacagugaaaaacuguaggacauaauaaaaaucaguuuguguuuucuuccuguuacguaauuagauuguaauccuccaagaaguccucucucacucaauuucuguaaccuguugguuaauugaugauuaaggagauguucuaccaaacuguucaggaacugacauaggaguaaaaaaaaaaaaaaaaaaagcuuacugucuuaugucuuggugcacauauuauuugcaauuuauuuuuucuuuucuuuucuuuuuuuuuuuuuuuucuugaaaaggagccuugcucuguccuggcuggaguccuggcuggagugcaguggugcaaucuuggcucacugcaaccuccaccuucuggguucaagccucagccuccugaauagcugggaucacaagcgccuaacaccaugccugguuaauuuuuguauuucuaguagacacagggcuucauuguguuggucucgaacuccugaccucaagugauccacuagaaucgggcucccaaaagugcugggguuauaggugugagccacugcgcguggccauauauauauagaacucaggugaaguacggagaaagaaagaaaaagauuauuaaguauuuuaucacuaauacucuuuucuacaaaauuuuuuugaaaguagcagcagcaaaaguuaacuuuucauucuccaauaaauuucauacuuaaauauagguuaggcugaaaauaaaguagcuauacuaaaaaaggcuacccugucaacuacauacaacaaauuggcuauuuagaaucuaaaacuguauuuuauuuucuuauaggaaaaaaauuauuuaaccuacauacauaguuaacaauguccaugagcaaaauugcuauugaguaauuuguauaauaacauuccuauucuugguuuugcccaaauuuuuuaaaaaauccccaugggaaacaaaauauuaccuuugaaauguagauaaguuuuaaaagauacaaucuguuuaggggauuaaagaauuauugacaagacuuccaaauuucauuauugauaauuuucaguuuuuaucccuucaacuagacauuuccacccaauucugucucaacaugaauucaucuuuucugugcaauuaccccaaaacgugacagaagcaucauagaagagaauuuuuuuaagcaacgguuuuagcuacucaagaaagucauuuaaaaaaaauagacaaaauuucaaaccuaauaaugugauaacuuauucuaaaaacaagugugcucaaaaugacuaaaguaguugaauuuuaauaaugcacuugacuugauaucuaauauggcuugcauuugucuucauuuaucuuuucuuuuucuaagccuccccucuuucuauaaucuuuugcuaguuuucugucuucuauuuuguuucuugcugcucccauuuucacuuuguccuaucuguauguguuagauucuuucccuugcuccuucuuuggacaccucuacauuccaccacauucaaagacgcugauccagccucccacuuccaacugcccagagaggggaugggcagagaggcagugcauggaguaaaguacauggauucuaaagacuaacugucaaauucauggcccagaacagccacuggaggaccucucuuuacucuacuauccucuugguuauacuagcuaccucaaagcaacauaaauuaauuuacagaaagcgcuuaaaauagugcacagugcauuguaagcacucaggaagaguuacugaucuauguuaccgaaucccuggguucagaggugaauagaggucacuucauuccuuaacuucccuccuguuuuaggaagcuagacauccuucccuauuuaaugauauuuucuauuccaauuuuugauacauccguuaguauuauucccucuuucuuuaguauuauuaccuuuuuucuuuucaaugguuccuuucccugaacaugcuaguaugcucaagccucucaucuuccaaacacacauaaagguaaacauuuaaacacacacacacacacacacacucacacacacacuucccccuccccaaaaaaaaacacauuaucuuaacucuuuguagauacuaccuaucugcuucuuccccuuuauugugauaauucauccaacuuugguuuguauuuguuauuuacaugugcuuaucuuguauugcaaucugccaucaacaaguccauucuuaugaaauuguuuuguuuuguuugggggguugagguuugccugcuauaagaaacacugaucuaguagcuacuuuuuguauuuuuccucuguaggauuugccaagauuauccagguuccaaacucccuguuuugaaagucugucacguccauguaguguacuuaaaggagcuugaguuuaggaguaaaacagaauugugggucuacuaaguuuucaugacaguuuuuguguuccaugaugaaaauucauaauagcaccaccugauguugcugugaggauuaauagcauauauaaaucaccaggaagguccuuguucaugauuuucauuuccuauguguugagcacuuaucuaagcaauuagcauguauaaaaccauuugaugaucacuacaacccuaugagguugucugcuauuuuuauuugcauuauaaauguggauagcuuucauaaaagagcuaaauuucccaaacaaaaucuuagcuauggguaggaccaagacuugugcccacacaauguggcuccagcaucugugcucuucauucccuugcuguauaguagcuuccuuguugcuuugacuucagaacauugcuuucucaagauugucucucucauuuccauuuuccccuucuuuagaucuaucuagucuaugccagaguuccauuuuuggcccauuaccaauggguuuuaaucuuuuagugguuacagacagcugccaaaaguuaaaauaccuuuuuuucagaaugaagcaccaauguguauggaagcaugguuucacacccaacauagggagauucguuuaccucaugaagccucucuguuaagaaccuuacauuaagcauuuaacaaauucuguuggucauuuauuuuaaucaccucuugaaguuuucucuuucuucccaucccucugccacugacuaagaauaucacucaccaucuuuuuauuuuuccagugaaaugaaucuagaguagugaauaacacuuuuguauuaaauagauauggaauagaccccccagauccacuauuucauuagccuugagcaacguacaguucuuuguucuuacagcaaaacaaguuaggauaaugauguagacacuauuaaugcacguguguguaucgcagugcauauuaacauauuaaaauuccaagugacccauuagucaaucuuuuauaaaaugcuucuauugacugagaauuucacaauuacauuugaccauaagccauuugucauggaaaucucauuaauauuauauuggccacuacauaaauuaucuuccuugcuaaucucacagcaugucuucaguauugucaucaaaagugaccuuucugaaacaaaaauuucucaugugucuacuccagcugaaauuuucugugggggccuggauugucucuauguaauaauucuucauauaccagccucaauuuaccacccugguucuuuaugcuguaguuccagccccagcaaacuacgugauuuuuccuuaagauaacucuguguuauucauauuauuaucuguguacauuucccucugcuaagaaugcccacuuaucucugugcugugggcugaauguuuguuuuccucuuaaauucauauuuugaaauaguauuccugaagaugauggcauuagagguagggcuucuggguggugaucaggcaugcaguuuccagaaacuugagaaauaaauuucuuugguuuauaagccaccaagucugugguauuuugucauagcagccugaacaaacuaaaacacuuuagcauguagaacacccauauuucuauaagccuuucaacugacacaugagcagaauuaauuuauucccuuucucuccacaaagugcucaaauaucuuacuuuaugcuuguucaauuaucauauaaauuguuuuauagguacaucucuuggauucagucuuuaccaugaaauuugaucuucuggagaaccagguaaauauuauucaauauuuuaucaucuuuuauuucucccuuccacuucuuucccuaauccuacaauaugcuuuauaaaauacuaguucauaauugccccucaaauaauguuuauuaaaauaaaugaauaugugagauauauauauauccuuuaauuuuaaacauuaaaaguggauuaguuaaauaauucugauuaagaaugauuaagaaguaaucaaaauuucuaguaacuucuuugugcaaauacagauuuacauagguaggauauaugcaagggggagucacaaaguaugaauuaguggugacaguaaaggcaauacauacauguauacuaaaaauacugacugaugacaagcacgaaccucuaauacaggaauaguauuuaauacauaacccccuaaaauauguauguguguguggguauauauauauaaauacauaaauccccaugcuaaguuaaaaucuuuacaauuuuuagcacccuugcuaaaaagcaacauauggauaguguauguaggcuuauuugaaaucuuuaagaaguuccgcacauggaauauuaacuaaauaugaagacauccuguguuuacauaguauuaacauauggugucaauaaacauaaaguuauccucaauaaauacagauuaaaaaaacucaaccaacaaaagaaggcuauaaaacucuuaaauaaucauccauaccaucucucgagaucauccaccuacuuauuuagauguuuuucguuaugucaacuuccucuaccacugugaaaugaagaccugaucuuagauugugauuaaaaggaaagcagacauuacucuguaaucacuagugcaaccuuucuuugagaaggucaaggugguuuacaaauguuucugucacauaaauaguaauccucauauuaauccugccugguaaguaauuaugcauaaaauaucccauaugaauuuuagcaaagccaucaguauauuaaauauuaaaggaguuuuagauucuaauuauuucaaugucauguucaaugauaaauguuuuauauauauaugucauauauauucauagauauaugucauauauauucccacguauacacaugcauauguauaaucuggcucagcuauaauaaauuucucauuucugcagaguaaguuuuuauuucuccauaguaagaauaacuuuagguaagcaauucaaagaacccaacuauuuaaaggcaauuucauucaguucuuauguuuuugcauaacuuguagagauuuuaauagcacagguuuuuuuuuauccuuauaguauccuuugcucuuuuuauuaguacagucucuuuugauccaaaaacucaagccauuuugccuuacuaauuaauguucacaagggacaacuccagaguccagcucuggaugauacacaucauccaucaugauguggcaauaagcuaccaccaccuaucaaaugcacaguagauuuacaccacguugcccuaggccucaguagacuaauucuguuguacagguguuuucauagauuuuauuuugguguggauaaucaaaauguagacaaagagagaccuuagguauaguauaugggggugaugcuaaggaauaaauggaugucugugugugaguguguaugugaaucugcaguuuugacuaaaaacacauuucugccucugcugauuugaaggagagacaaaacgaagagagggcaaagagggaagugcaaaaauaagugguguuccaauugguuuaccuucaucuagaaugaaaaaauuggaagaauaaugguaaaaccugcaccagggaacuauuacuccuuaaucucuucuuaucugaaguacacuuacaggugucacuauacauguuuuuuuuuuuuuuuuucagccugauaauacaauauggggaaauuucagaguucacagaguuuccaggugaccaacuauuucagugcuagucaucauuccuauggcucaggucucauuuagggaugggguaaagggaagguacuuaaguauugucuauguucuauaguacauaucauuguacauuauaaaaccgaagcuagaagcagauccgauuuaggaagcuuaaaugacaaaacaagcuagugagaauuccagugcuguucuuucuauuggauagcaauauaugucuaacuccagaagcagcuccagaaguuauaauuaacuuuagguggauaaaaacuaagccaucucccagucucaaagcuccuauuguguuccguuuucuuguuuggaacaugauacaucucgaugugaugccugagaaacuuaaauauacaaaauaauugucaaugugacaugguaagaaauauguuuggucucuuuucccauuuccugacacacagcuuuuaaauucuugcaaucucugaaaugguaaguauuuucauaugcuaaugagauugcugggggcugggggcuccuggaaagcccaagcaugggggcugguuuccaggggaaccaaccaagugauuagaacuuuaccaauuucagacaccccagugucccacacaacaccucuggggagaagaaauggccugaauuuuuuuaucacuacuggcaggugauauaaugaaucaggccuguguauugaggccucucuaaaacccccaaaagaugaguuucugagagcuucugcuuguuuaggaaaaccuuaguaccucaaaaugaacagaaaaucauuggcaauaccuauacaaauuuauagaaagaaaaaacacagacagcaaaaauuuucaacugaugaaaauucucuuccuuccaaaaguaauuaaaaaaaacagcaaccaagaaacaacaacaaaaaagaaacaaaaaaaaaaccugucuuaaauauauuuuuaaaaaauuaccuggacauauuaaaaaauuauauuucuaaucagugaaacaaaaaauagcaauggagaaagcauacaaagaugugaaaugaaaucuaaaaaggucagaaaagagaagaaaaagaaaaacaaacucagcagcaaagcaucagccauuagguggcuacagaagaauagauucuaaugaguauuuuauaaauggcauauaagugccauugaagaaggaaaugaagaaaacucaaacaacacaacagaaaaaauuauaaagguuauaacugaagaaaguuuuucagaaauaaggaucuucagccacauguugaaaagucacauuuugguaauucuuaaauauguucuagaaaaauuuuuaguucuuaaggauauuuuaaaaaaaauccucuggaguuucaggcaaacagaucaauuacuuacaaaggaaaaaagaaaauuagguuguugugagaaaucuucacagcaauagucaaaauaaggcagcaguaaagccuuuuuuaaaaaaugcaaggaaagucuauaugugcuaagguaccuuucuggcgucaagauuauaagugcaagugcugggaggaugggaugccuggagagaacauggaggcucagcuccccuuuccauguaccuuccccagugcagcucuuccauuccgcuguuccugaguuguauccuuuugcaauaaacccguaaucuaguaagcaaacgguuuuccuaaguucugugagccauuccagcaaaugauuguguacacauacacauaugcauauauauguguauguauacacacaucucucucaaaaauauuaaugauugauauaaauauuuaaaagaaaaauguagguaaagaugguggaaugaaacuguaucauauaaucaucuaucaucgacucuuuaguagccaguaacagaaaucuaaaaugauaaaaaaaauuuuuuuaaguaaguuacugucaaauaaaccaaagugaauaaccuccuacuacgcauaucaaaaguggcacuuaauggcuugacucuucuccuuuccaucugacugcuucaaauacuguagaauaaagguuaguugacaggaccuugauacuuccuacuaauaucuuagcaguauuaucauaauuaacauuacuuauggacagaaagaggccaaaauaaugagcagggagcccuagggaaaacuaaagguaaagcacuugagaagaucuaucuuaguaaaggcaggaggacuuugaagaaucagggcaccaccuugaauugggguaaaggcuuaagcaucucaccaaaaucauaaauuuuaauauaagacaacacugucuuagaagagagaguagaaugcugaucuuccagaaauacuuggaaauagaaucagagaaaccaaggucuccacuucuagcugcuaagggcaaaaagaccacaaacaaacaaacaaacaacaauaaaaaauuccugaauucagauauugugggagaggggauaaaauggacuucaacuacauauguuagaauaaauaggagauuuaauucaaauuacugauuuuggccccacaaggaaaaaugaaaaucaagaagauuaugaaaaugucauacauuaaagagaauaaggaagauuuuucuccaaagagaguccuugcguuccauucagguucuggcuuuguauguuuuauuacaaaaggaaugacuguggucuccuccugauggugagguugguguugagcauccuucuaucuauccucucaccagacccugauuauuuuucacuccguacaaagcagcccuuugucuccagcuuauguucagagugauagcaguguaguaagaaacuacugagggcugcuuucaaggggaaccaaccaagugauuagaaggccauguguauauuguuuucucuugcaguagggaaaguauagagaggaucaugcaguuaauucaguagauuccuucauuuccucaucuccauucuuuuauucauauauugccaaugcaguaaaaaaguuaaaaacauuucuuuguuuucaugccaucaaaaaucccaaaaaauuuugauuagaaauacaaucaucugauuugaauuauugauauuuuuccaacaaucuaaccuaaaaaacuaagagggaaauuuauuucucuaugggccuauacuuugugaagagaacauauggugauccaaggacauuaggcaagccauuaacaaaggccuaugaaccacuuuacaaaauauuuuugaaaugaaaauuaaugaguagucuuuuuugagagcucuuucauaguugaacgcagcugaaugagauucauuuggaaggagaaauuuuauuuauauugcuuuuuacuucauuaagcaaaaaaaaugaaaaacagcuaucuauggccgaugcaaaagaucacaaaagcaaaaauugauauauaccacauuguaaaaugcauuuggaaguagaugauuuacaucaacuaucuccagcaauacugccaugucuacuaccaucaaaacacacaaacaccacuuccaucaaaacacgcaagcaacaacaaaaaaacugaagaaaaccccacauauuuacaaacagacacaacuugcaggaacaguuuaaaaaacacauucauuuugaaaagaaaaagaaaaggaaaggaagagaaagucagaaagaaagaaaauucaacuauauagauugggauuugaacuaaggagacuucaaaggcuguuacuucauuugcaaaggcauauacaaguuucuauacauuuuacaacucuaccauacuguuucagcagaguucuugcacauacaguauagguuuucuugcucagaauuucaacagauuccuaaauuuaugguaaaauuuucaauauuuuaauauagaaauccucccaagaauuuagucacccucauuuuuuacgccacuuuagaagaauuuugcagagaguaccaucagcucuuugagagaaaguuaagauuuuacaaagcucuuaguccauuuaguccauuguuuccguuauuuaggcuacuaauugagcuuuaaauugacugccaucuauuaccuacaugaaaaucaaggauuuuuuuuuuuuuuuuuuuuugugacagucucacccuguugcccaggcugaaguguaauggcacgaucuuggcucacugcaaccuccacuuccugggcaguucuccugccucagucuccugaguagcugggauuauaggugcccaccaugauggccagcuaauuuuuguauuuuuaguagagaugggguuucaccauguuggccaggauggucuccaacuccugaccucaagugauccacugggcccagccucccaaagugcugggauuacaggcaugagccacugugccuggucauuuuauuuucuuuauccauuaguuugaacugcaaaauucuaauuugucagaacauauuuaucauucuaccccuuuuaacaccuuuguuuuagccugggaucuacgauuaaauauauucaguguucacuaucuuccuuugucaaguuuauuuaauaaucccuaaguuagauauacucauucucuugugaguauaguauucacaaaauaauuuuaaguuuaaaacuaugucuuuauaaucuugaugccagaaagguaccuuagcucauauagucuuuccuugcauuuuuuaaaaaaggcuuuacugcugcuuuauuuugacuauugcugugaagauuucucacgacaaccuaauuuucuuuuuuccuuuguaaguaauuugaucuguuugccugaaaguccagagguuuuuuuuuaaaauauccuuaagaacuaaaaauuuuucuagaacauauuuaagaauuaccaaaaugugacuuuucaacauguggcugaagauccuuauuucuaaaaaacuuucuucaguuauaaccuuuauaauuuuuucuguuguguuguuugaauuuucuucauuuccuuccccaguggcacuuauaugccauuuauaaaauacucauuagaaucuauucuucuguagcuaccuaauggcugaugcuuugcugcugaguuuguuuuucuuuuucuucucuuuucugaccuuuuuagauuucauuucacaucuuuguaugcuuucuccauugcuauuuuuuguuucacugauuagaaauauaauuuuuuaauauuuccagguaauucuuuaaaaauauauuuaagacaggguuuuuuguuuauuuuuguuguuguuguuucuugguugcuguuuuuuuacuuacuuuuggaaggaagagaaauuucaucaguugaaaauuuuugcugucuguuuuuuuuucuuucuauaaauuuguauagguauugccaaugauuuucuguucauuuugagguacuaagguuuuccuaaacaagcaaccaccgguggaaggucagagaaaauuuuauugccuuuauagauuucuucuucaugaacauugucuuguguaguuaaugaaaaaaaaacuuauuuaauuggggguguuuuuauauuuugauauuauacgguuuucugauauagugacucucuuuuuuuuuucaguagggccuuuaauuuuaaccuuuucauucuuuuauuuuuccuuuagccacagagccaccaaagaauuuuccauacacuucuaauuugccccagaaaccauaucuucccaagacuguuauauuuagucucacauaauuucaaacaccuucuuuucuauuucaucuguucuuauaucugugcucaauauuuccuuagaccuauucucaguaucacuaugggauucucauuugugggucugauuuuauccacucucagccgcugcuaggucucccccucuccuccugaugcacagucucugucugucuuucuaauucagugugggcuccagagccagaacuauuguuacaggugucauuuauauacuuugcugagguaauuuuaaauuuguuguauugaauguauuuuaguuaugcuaaaaauguuuuuguggguaguuaugcugcuuauaaucuacaugguuuuuagagaugucuguguagacuuggauagaguggaagggaagguguuugugagaggugauauuuuaagacgcuacuuuaaagaaaugcuagaauaggccacucuaggauuugauuuaggagaaauccaagcaaauagaaaagcaaucauaaauaaacuaaguuagaauaugcugagacuaaaaauaagcaaagagaccagcgugguuaaaaugggagauguaaauggagagugguagauaaugaaauuuauaagcuagguaggaggcuuguuuucuguaucuauggauuuaaccauucuggauauuucauauaaaaagaaacguacaacgugcaaccuuuuguggcugacuucuuucacuuaguuuucgauguucauccacauuguagcagguaucaguguaucauuccuuuuaauggucaaauacuauuccauugcauguauauacuaugacuuuuuaaugauuaaucaguugaaagacuugggguucuuuuuauuuauuggucauuuugaauagugcuacuaugaacauucauguaaaaguauuuauuugcauaccuguuuucaauuauuuugaguauaaguuucuauuugaaagugauaaguuauuugagaguuccgaggaaaguauccauuuugaaaagaucaugcuugcugcugcugaaagaaugaaagcugggaaacggggaagcaggagguuauugcaguacucuaagugacauacuacaaagauguggacuaggacaguagcaggauucacaguggaaagucagagaauuugguauaaagucuguaggcagcaccagcagcacuuauugagugaguuagugagaauauaugauaaauuaucauucaagaauaacuccuaaauuuguggacugaacauuuugaugaaugaccauguuaucuauugagauaaaaaauuuaaaaaauuaagagaggaacagguuuauaaaggaaagucaacaguuccuauuuugaaacugucuauucugucuauucuuguuagacauccccaugagauggguguugaaugagugaaucuggagcacaguagaaacacugguaaauuuacaaaucacuggaacagauggaaucacauaagcagugagugcccuaaaggcuaggucccuagaucauguagaaguaagaaagagaugcaagagauaggccuugagguagacagaaaaaacaaagacaaagaaacaaaaccaaaaacugaaacuaaaaugggaagcaaagugaaaaaaauacuuucaugauugacuaaugaauugcuugggccaaauucuaauauaauauaaggacagagaacuggccauugaauuugucacaauggagauuauuagcaaccuugauaaguacaauuucaguggacuagaguuggcugaagagagaaacacaagugaaggaguagagaauaugagucaggacagcucauuuaggaguucugcucugagggggaguggaagaugugacacucauuagaagaguacauggucuucauugauauaagagugucgugauauaaaauaagagguagaacaacacuuuugccugcuauugggaaggaugcuguagaaaaggagaaacucgggauucauaagugugugcacacacacuuguagggggauaauugcaggaacaguguacaaauggcagcaaggcuuuaaguacaugaagauaguuuaggcuuugccauaggugguaaauaaagugcauaggcacagauauagcuaggcugauggugcuggugaugggaaaaggaggcaggacucuaccaguugcuucuauuuuccaaauaaaaugaagaacucuaagaaacuauaggcacguuguugauuaggguuguggacccacuugagauaauggucauuagaccaugaucaaaucuaaaggugaaaaaaaaaagacuuuuuuuggucacuguggaaagaauacaggugcuucuuguaauacagguucauaaucuuuuaucagccucuccuaaaaugugauaugucuaauauuugaaauccuggcaauauuuugcauauaccacauuuuauauaacacuaccaggaaagucuuggggcagcaucccauaaucaagcauauuuucuuauguuuccuuagcaaagauaucaauagucacacuaaguauuguaaauacacacaaauccacccacacacaagccuuacauuuugguuuggcuuuuauuuuuaaaaagucaacacacuuuuaguuuucagaaacuuucaaauuucacaauuguaaaguccuguggauguuuaauguucaguauuuccuuggcccacuaguugcugaagauguugaaacuccaaguacaaaagugucucugauuaaauagaguuuuagaaacaccacauacuaagucauauuccuggagauuucugaugcacauuagcauaagcauucuauaaagacacagcuguuuaucucuaacuccuaaacaaacauuucuucaagguacccugacaccagcaccgcuauuaacauggccagacuaauuuuuccauaaacuaggauugaagagcaagucaaagauugcucaaaauagugaggagagauaagaaaaguaauaucacaaauguauguaaauuauucccauauaaaaugcuuccaguaauuguuuagccauagccauggaaacugaauauacuuauucaugccauauauuucucaauuuagauagauguaggcagaaaaagauauaaagcaguaggaccauuuguguuagacagguuuccaguuguaaaauauguuaaagaaaucaaaauguuuaaaugacuaugcaugucugaauucauggcuguaaacaguaauuaaucaauuaaaccuuuuacaaguuuuauuuuucaaaaaauugcccuguaaaaucugcccuuugagaauaacuuuacugaauaaaaagauuaaauaaauaauucuauagacuggcaguuuguaucauuuugguaggcugaauaaccacaaagauauuuaaaugcuaacaucuuggaccuauggauguuauuuuauauagcaaaagacacugccaaugugauuaagauucuugggauguggagauugucuuugauuauccagguggauccaaaauguaaucacaaguguucuaauaagagagaggcagagagagaucugacaacauaaaaacaauuaggagacgugaagauggaaggaaaaggauguagucgugugugaaaggugucagcaaacaaggaaggcaggugaccucuagaaguuagaaaagaugaagaaauggauucuccccuacagccuccaaaagaagccagcccuguugacauaaauguuggaauucugaucuccagaaauguaagaaaauaaagcacuguuuuaugccacagagccugugguaauuuguuacagccaucauaggaaauagucuaaucaucauaauuuuauauuggcucuguuuauaugaacaaaucaacucugaaucuauuuuuuauuugacuacuuucaaguaccggggggaaaaauagaaaacaaagcagaaaaucauuuuucaucuacuuaauuugauauuuucucuuuugaccaaauuuacucuuugcagaugggauaaauuauuuucuaauuuccaggaauguaugacaccgagaagguuuagaccuguaaauauuuagugucaacaauacuuaaaacaaagauggaaaacaugaccagaaugaagucaucggcccaucaacuauguuuuuuuuggcuacgguaaacaaggucuuugucucuacauuauuaauuuggccuagcaaguauauuuuguauuacaguagaacaucaugguuaauuuuaauuuggccagcuauaauaaaaaucgaauauuggauuuguuuuguauacuaaaauuaauuuuuuccauaaaauguuaaauuaugaggugucauuuuucacauauagcagaaaaaaaggauaaaauuaucauaauuuuuauuuauuauuuguaagauugaggaaaauagucacucuuccauacuaugugaauguacauugguaagaccaugggaaaaacaauguagcuguaccacguauaugaaaaguuaaaacauucaccuuguucuaaaaauuuuauuucuuagaaacuagcuuacagaauuacuuagauaccugcacaaaaaaguguguaaaauuuuuuguuugaucacugcuugaaaaaaaauugaaaaauguagaauuggccuaaaauaauuacccuggugucuauccuuuauaauuuugugauauacaaaauaaaauaugaacucaugagacagacaugccauucacuagcauggaaaauugaaaauuuugcuuagcuccugugaauuuuaguuuucuuguuaaugcauugagacuaguaauaguucauugaaauguugaaugaauuuacugacccagcacacagcugauaauggcagauucucuguaaacauuugcuucccucucuuuccuuuaacccaugaccaucauucauuuggauauuaaauguuucaauacaaauacuauaaauaucucuaaauacuuuguauaguuuucacaguaccagcuaaauacaggaaaauuuuaauuuugcuuuuaugcagauuuaacaaguaaaacacucacuauuaugcaaaguauuugauaucuuauuuauuccuauaaguagcaaguucuagcagauaguacaauagcuuugacuccuauaauaauucauauuauucauuuacauauuaauccaaccaaaauuccguagccuaacugugacacuugguuccucucuccuuguucuaucauaagcuuauauaaucaucacuaaugaaauuggagggcguguguugaaaugaaguuuacugugauuguauuucauaaaacaaaaaagacagcuuauauacuuguguguuuacacauaacauuuuuauuuuuuaaauaaauuauaguuucaugauauguaaauauuaauuugaaauuaaaguguaugcugaauauagggaggaaaaauuguaaucauuguguaauauuaaacauguauuugcugacauaacauuauuaagccaaauaaauauguuuucaucaggagcuagauguuuaauuacuagcaaaaucauuuuacucuuguauuuucuaauuuaaugaaauacugcuauuuauuuuauuuaucuacuuauuacuuuuuugcuucucucaaaauuauuuuauuuuauuuuagauucacaggguauauuuaguuacaugguuuguuacauggguguauuguguauuacugagguuuggacuucacccaaauagugaacuuagcauccaauagauaguuuuucaacccccuucucccacccacccuccccaauuuuagaguccccagugucuauuauuuccaucuuuauguccauguguacccuuaauggaauauuuaauugauaaaaaauaaaaacuacuugacauacuuauuaugguuuaacaaaguaugaaacauauauagaaaaauauuauagguaaauugcuauuaaaucaaauuauuaguuuuuaauauauaaaauaguuacaagguuauucugcugugcuagagcacuauuaacaaaauaacauuuuaauuuuuuauaaguuacuaugcuucuuugaaucaaaggaugauaccuuuauuugaucauauugggguuagauuauuuuuaauaagcuauagauuuuucuucuaguaaaauaaaaguucugccagaaagggcaagagggcagcaacaacaaaaaagguauaucagaaacuucaucuaauagcuccaaucaugguauucaauaauucucagcaugucuuaaauuuauuuugaaaaucugaugucagauuauuuuaaauauaauuauuauguuaagaauuauguaaagacccuggcuaauagugucuuugaugacaaaacaaacaaacaaacaaaacacuguuacuauucucacuaauacauauauuauuucccaaguuaguaaauuaaauaguuacugaguuauuaacucuucuaaguacgagaauuuuucacaaaagacuauacauuaagcaucucggccaauggaagcaccuuucuuaaagcccugaggauacaaaauauuuuuauuuuucuccaaugagauuguuacauuuaacugaaauucucauauaaaaaugcaaacaaguuuccuuuuuauuauucuuuagaauucucuuucagaauaccugggagaauauuauuugaccaauauaggacaaacuguuccugaugaauaaaguucguaucuagcugagaauaauaaaauccugucauauuuuaaauauaucucuaaugaaaauauaaacuaguaaaaucuuuuuggagagcaauucgacagcauguaucagcaaucuaacaaauuuaugcucuuaaucccagcaauuauauaucuuauggcugucuugaaaaaaauauauaacggucaaaagaagcugugaucagagauuuuauuucuuuguuguuuaugauagcaaaacuaggaaaugauucaaaaaaucuaugcuaaaggaauagauuuauaacucauuuugcauucaaccuguugaaguuuacuuuuauaaaaggacuaauaaaauuaugcaguaaccugaaaaauacuaauaaguaaaaaauauaagauauagcaacuuuagaauauauauuacucccacacuaaccuugauagucuauagucuguuuuuauucaucuuuaucuuuaucagagggugaccaacuaucccaguuugccaaggacuaacagguuucccagaaggugaguauccuguuaaaaaucuguuaaaagcaggaaaguuccaggcaaacugggaaaauugguuacuuuacuuuguaagccucugacaaauguuugauaaauuaauuaauaaaugaagacaaaguucuauacauggugcaauuacaaaugucauacauguuugcacugcauagaaaaguacacaagaauaacgcaugcaaauuuugacaguggcuaggcuaagaauuaaggaugauuuucuauuuuccuaccuuucuauguauuaaaaguuuuauacaaugagcuuucauuuccuauggaaaaaaauaguacauuaaaaacacacuuaaauuuugagcaacaguuugagacaccaauacaauaaggaccagccaagaauauugucacaaagaacauuuuaaaauaaaagaccucaagcuauaucauaauuuucuacaaaucauuauugaucaccauagcagucucugaguccaaaaaaauaaauucuagaagggaaauuuuaaaucuaagcauagcuuuaccaugaaaugauugcaauuaaugugaauauuaguuaaauaauauuuuuuuaaaugauccucuuuaacauaaauaaaacgccaucaaauuuuuaaaaagugagcuuauuggguuuuagaagaaaaagaaauuaucccauacauuaauucuuaaugauucuauagucauggacccucuugaaaaaaaaaaaucugacaagagcuauggacccucuucccagaaaacacauacacauauaacauucuguaaauaauuucagcuuguuugaacaauaauacugaauauauuugcuauaaacaugccaaagaaaaucaauuuccucccuucugaauauaaaaucucaugcaugugguacuacacugcaauuaacugaaaccacacacauuuggaaacuuaacuuucuuaaaggcaagaacucuguagucccaauagccucaauuaaauuucgaagcaacucauacuuuaauuugaaaauccaggaaaacacagaaagaacauguucagaacuucuauuucauuaugauguagagaauauaauuuucuuugauuaagaucagugaaaauaguucaaaauacauaaauaaauaauacuguaagccaauaaaagguaaccaaggaaagauaguuauuuuaauaaugaaaugauuucaauguaauguauauuccaaauaauugauuaugagaaauuaagaaaugauuucaauguuugccuaguuucauuaauuucaagggagcaaguucuggaguuuuuagaguagaguaugaacugucaacccaaaugucuacauaaccauaggauugguucaggggaguauaugaaucaaguuagucuaauuauuccaaaguauuugaacuuaagggaaaauaaagccauagcuuuuaggagccaccaagaaggacuccauaagauaugucugauaugugauuugacaaauuuuccuggaauucacgauaugugaguaauaaauacauuucauuauguuuugcuguucuuuuaauuuuuuccaugagccacuaagaguuagauuuucugauauuuuucaacaugaagggucuuaacugcugugcugguaucacacaacuaguaagugacaaagcuaaaauuucaaugcaggacuucaaacucugaagccuauaggauuacuugaaaaccauuauuuuauaaaagaagaaacugagaaucagagcgauaaaauuauuuucucaguguuuccuaaaaccauuaggccuucacugcugugaggccagaccacugccuucauuucagucagcagagacacaauccauauccucuucaacuucccucagcuaccugagguuaaggaugugcuauaacaauuucuuccaagaaacuguuucuuucuaacacuaucaaaacaaaauaaugugugucuccuugcuuuucaugaguuaauaauuuauaucuccaaggacugcugcacuagggucucugaucuuaugaggaacccucucccacuccaaguuauuuuaucacauaggguuacacagacuuagagagagucuuaggaucagagcucagguuccuuggguuccuguaucuuacucuucugacuauaucaaacuuucagcucacacauuaugaguagacaugaacuccuuucacucaaggauaaugcuuccuaacacacuagcucuuucacagccuugacacauaaugauuuuguugugguaguguuaagccuaaauguugccacauaacuccuacuguaucaccuacuacaucucaauuauuaauaggcaaaacaccugaagugaauauagaaauauuauuuuaaagauauaagaugucaaacaugaugaugcuuuuugauaaucaucaagacagcaguugguaccuaacguaugauggauaaaccucuuucaaggcuuucagaguuuuagcaacaugguucacuuuuaaauagccauauuuguuaugagauaauccucuggauaggacaggcugcuugcuaacugucuaucugguaagagugugagagacaggagcagaaagggucaacuggagaagcauaaugcauuugcugccagccugacacuuauagcaaugcauuuagacucuuauauuugcuacaagacauuaggccugcuccaacgggugccagaagucauaaugaccucuuguaaguacacuaucauuucagaccuugaaaauaucucagagaaagguaauuuacuagauggaaucugagugaucuaaaagaguuuagaauuuuccggcuccugacuucucauuccccaucuccaacauguagaaugaggauuuucagcacaucaaucuccugaagacaucaguaauguacaaugcaaugcaaauguacacuguaguguuaagguugaccuguuuccccauguuacagacccagacacagauuugagguuuaugucuucuguguuacuguuucagccaugaguuaaagaaacauacaugcauauacacacacgugagugcuugggcaaacauauguauaauaugauaugauaaaaauaaauaauuaaaaaccuuuuaguagcaaacaucgaaauaagauuauuauuuuuuauuuuuuuuauuuuuuuuuuuagaaagagagagagucuuguucugucaacgaggcuguagugcaguggcauaaucuuggcucacugcaaccucugcuucccagguucaagccauuccccugccucagccucccaaguugcugggauuauaggcuccugcuaccaugccuggcuaauuuuuguauuucuaguagagacaggguuucaccacauuggccaggcugauuucaaacuccugaccucaggugauccacccacuucagccucccaaagugcugggauuacaggcaugagccacugugccuggccaagauuaauguuuuaaugacauaacucuauguuaccauguuuagaauagaaaaaaaaaaacuguuuaaaaucaugacaggugucauuacaguauggaauagcaaugaucaguagaauaucaagucuuccaaaaccaagaaaucaaaaagauaggagaaaugcuugcauuuuuaaucaagcccagauacuuuaacauauuguagcauuaucugagaagucuaaaagauagagaaaaugcuauaauuguuuauugugcccagauauuuuggcauacuguagcaauaguagucauuuccagaugacaugaaaugauaucaaaguaaugccauauauaguucagagaauaaaaaacugaauacauuaauacuauuacauuuuuacuauuacaauguuauuauuacaauauaaauuuugguauugugaaacucuuacuuauacaaggcccuaccuuauuacuucacuucaguuaaaaucaccucuuuagcuuuucaagauauauuaaaauuccauaucucuuuuucuagaaaacuagcucuucucacaaugguaugauccuuuuggguuucaaauaguaaaaauaauuaaaaagagaauauauaaagcaucuaacacagugugugccaguggccaaugugcaauauaauuugaguuuucucccuccucacuccaucuucccacaaugccacucaaaugcacaaacacauuuuuaaugacacauaugaaaggagagaauuagaggagggagagagagaauaaagaagagagauguauccacuugugaggaaaagugagccaauaaucucaccucuacugauaagcauaaaauuuguauacacugagaaggaagaaaugucucugcccacuagaggagggaggucucuagagcuaagggcugagaugauaugcuuuggcugcaauucugaaauagaacuugugagaaaggcaaaggcaaaccuuuuauuccuccaaggacaguuguguguuggcuguuuaacaaccagcuuucuuagaaaaaaaaaauacauguuugcagaauuuauugauuucuguaguguaaauacucccacuguggcuggcuaucgaugugaagucaccaaacagaguugggaaauaugccugugugagcuggcuccaacauacacuguagcauagguucucauucaccagguucucaccacaggauuugguugcauccagggaauauaccaaaaugccuucguuggcaccaaugugaaagacugugugguguuugccuuuaaaacauggccuuucaucaacuugaguuauugaucaauuuggggucccaguucuauauguugcauguguugaacaucaauugagagccagcuuuucuuguaaaauauaagaauuaagaacaaugauagggugggcaugguggcucaugccuguaaucucagcacuuugggaggccgaggcaggcagaucacuugagaccagcaguucaagagcagccuggccaacauggugaaaucccaucacuacuaaaaauacaaaaaaauuccccuacuugggaggcugagguaggagaaucaccugaacccaggaggcagagguugcagugagccaagaucccgccguugcacuccagccuggguaacaagagcaaaacuccgucucaaaacaaacaaacaaacaaacaaacaaaaacaauaacuuaaagugcgaaacauguuacaugauucuaaggauuuguugucuaauauuaagaucacugaguuuauaaaacaaacaaauuggaauauaagguuuuaaaucuauuuauguagcccuacaucuuuugggccucauugcuauguuucaguuugcuuuuuuccuuccuccauuucugcaucuauucuaauuuccuuauuuaaaugcaauucuggauugguuuccauguccuucaaacugcaaaggacauaucuucaaacaccugcaaccuucaaagacaaucucauuguauccucagacacuggauaaaagaugaggaacagaacagggguuugcuucuacuggccccugaaaugauaugcugacuggaaaaacaaaucaguucuauucaguaauguuuauaauuuaaagaucuuuacugaaacaauccugggaacaaggauacaagaaaacauaaaugugacuuauaucauauuuaaauuauagccacacucuuaagaucacaagucuuauaaacugcuuuauaucuaggacccuccaacaaaugucuaccugacucauaauagauacuuaacaaauaguguugaacaaguaaguuaauucaaugcucuguagucuuugagguuguccaaauuucacagaauaaucagugaccugagaucuauguggaaacaaugggucagucauuuucuuaaacaccuaaccauccucuccaaauugccuauguaaagaacacaguaucaugacuagauugaaagagaaauaugggagaagagauggagauuaauuuuaacauuaauuuauuuuggguaaaaagaaauauaggcauaacuccacaauauugaaaaauuuuguauucccuauuauuuaauaguuuuauaauagaaauauuacauccacacauaaguucacauuggguaagaaacagaggugagguaaguagggacaagcacacauaaaguucacaaauguaagggaagagaauacuguaaauuuacucagaaaguaacugcauucaacagaaaguuuuuuguuuuuuuuuuuuaaugcuacuauuauuuuugguacuuacaaugcuuuguuuuucaagaauagccaaaugaauuuuauaccaaucaucuugggcaauucuuuuauuauuauuauuguaaaugcaaaaucaaguacaaacaaaaagaagaaaaaaaaauagccacucucaaguaagcuagcaaaugucucgcaaggccaucuguuccaagcucaaagcacuguaauucgauggauacacaaaugcugcauuuaauuuuucaaccugagcauauugauuauuuuaucuaauaugcugcagagugaagccaguaagccucacucugaaaguagcugcaauggaaagugacaagaguuuuauuacugcuagaagguaccuagcagagcucugggaaaaauuacagauuuccaacgcaaagaggucauaaaaauuuaugagacacaacaaagaggagaaaaggcagacagcagcaggaaacgugaaaaauucugaaaggcaucucaaauauaaguuuaauaauguucaagucugugacauuucauuauuaucuacugguaaauauagaggagaggcaggaagcauuuauugcucacuggacuacaaaaaucuauuguuuuacagguaaaaucaaaggcagucaugugccagcauguuugauccaagcuuaaauggaaauucucacaaauaaagaugaguuucacuaaugugcacuaauuauuccuuauuauauagaagucacaauaugaaauugcaaaauauaauacugaagauaaaggaaaauggaaaagauacauugcauuuuauaaagauaauaccccaaauaaaauaacuccagauaauacuuuaaaacuacaaaacuauacuaucagugccuagcuauuauauaaaauaauucaacacauuugaggcuccaggggucauagaauuguugcauuauuugugcaccuagaaaugaugaggaguugugguaaauaaaucugaaguugccaugaaacaauauuuaucauccauucucagagacaucacuauaaugccccccucugaccuaaauuuugugguuaaccuuugacccacucauaaaagugguuuggaaaagucccguauuuaccuuaugagaauggcucauccucugagauaaauagugaaaauguaaagauacauggucuuacaggcaacccaguucuuuaaacuggguuugccuucuucuaccugaugcaacuuuguacagaaaaggagucaucguuacuggguauccccacugacuuuccugaaauguuacaaaggugcagggcuacgagacagugcaauuuaccuuugccaauguaccucuuauuccccucacauacguugauauaaaguauuggaaaauacauuuuuguauuuaaaaaaacuucaaaaauaucacuccuauguauccuguaaugugguaauguguuuuguuuguuuguuuugguuuaagaguaaauuucaaaaugucauuuggauuuaauuccuaacuuuuguguauuuguacucaggccuaaauuacucgcaggugcagcugucagucuccugauacuuuuuaguuguuuuaaauuuaguuuuuauucauuaauuuucuacaacguuuggcaagcgauaaaauccuuuuuaagaaacucagaucuacaaauguguagcagaucucagaaaagcauuuuccuugcuuuuuaauuguugccuauccuauacuuagcaacauucuuuaacuuuguuuacugcuuauaaauaaaaccaacuugagacauucgauucacauucuauuuacccuuugggugguuaaacagcauuaauuauuugcacggagaugguuuauuaauuucuaugguguggacuucgucagauaaugauaucucauuuacaccacauuuauuccaauucaugauuucacacuuaucgucaguuugauagcuuacuaugcuuuacucugagauucaaaaacaaagacuacaguaauuuuuuuggccuacuuuuauguuuugccaagaguguccugauagucuguauauguccuuuauaaaucccuuuuauugaaucuucaagaguauugcaaaccaugauuauuacagcccugcaagauucugagcuuuaaaauuuaaacaaagucaggguuucacaccaauucucugugugacuuggguuaaugcuuaauauucauaaaucucagguaauuuaaauucauaaaaaauaaugaaacaauaauacccuauucacagagucauuguccguaaugcagaaaauauauaaagaguuuaguguaauucuuggcauauugagcugacauucaagauggcuaccauuaucaucauuauugcccacuuuucauaauaguaauuuuguuauaguauucuuuaguaacaauacuacaauaugugugcuagaauaauuugaacuaaaguacauucagacuugucuuuuuuagagcuaucaugcuuauguuuuuacuuuucuagagggcaauggaaauuguguuuguauauuuucaguagucaccaucaaauccguuucuagggcugucaucuuuuguucuuucauuuaggucucugugucugugaaaguauuggacuucauuuuuuuuucuucagucauuucaaauuaucaugauacaggguauaauauuugcaauguaaauauacguagcauuuacuaacacauuaaaaauggccagaaaaugugaugggugugguggcucaccccugucaucccagcacuuugggaagcugaggcggguagaucaccuguagucaggaguucaacaccagccuggcuaacgugaugaauccccgcaccgucucuacuaaaaauacaaaaauuaguaggaugugguggcgugcaccuguaaucccagcuacucaggaggcugacaggagaaucucuugaacccaggagaaucacuugaacccagguggcagugagccaaccugggugacagaucaagacucuaucucaaaaaaaauuauacacacacacacacacacacacauauauauauauauauauacacacacauaucuacguacauauauauauacauauaucacacacacacacacacacacacacacacacacacacacacacacacacacagaaaauguuaagaugaaugccacucuauuuuggacccauguauuuuugcuauacaccaacauaaagaagguuacauaaaaaauuaaagaacuuagccuauuuccacuuccaaguguuugcuaucaaaugucuuuauuuuguuugauuacugugaaaguauuuuccaaagccagacaagugcuaugcucucuuuuuuaacacggagauuucaguaaauuccucccaucuagguuuuucuuucaauuccugaugccuaguucuuaauaaagugaacauuuuaaauaaauguucuuagaaucuuacaauauuucuguauguuuuuucuuucuuucauauaaacggauguuuuugucuuagcucaauuuucaaaacauucaguaaagagauguagcaucugaaagucauaugucacccagauaaauuaugaugaauugugugaaagauuuuggcucaauuguuaacagguuaauauuaugguacuuuagugcagcagaugcauauauugguguguaauuuauuuggggucauaaaauguuaccuuuuauuaaaauuagcucugucaugacauuaaaaauuucagaccagagcagcuguguugauaauuaguaaaaugacaucaaauacuaguuauacauucacuuauacagcuuaaaaccuaucguaccuuuuuuuuauugggaugcaaaccuugagaaaaucuaacuuauaugauaagccaucucggugaaggagucaccaccuccuucauaaaagcugcauuaacuucaugucccucucauucuauuuuguggaauauuuugcauguuuacauauacauacauauguguacauauacauauauacacacacauaaacaugcacacacauauaaaauagcuaugggauuauuauuauuauuuuuuuuuuuuuuuuuuuuuuuuuugagauggagucucgcucugucacccaggcuggagugcaguggcauggucuuggcucacugcaaccuccgccucccggguucacgccauucuucugccucagccucccgaguagcugggacuacaggcgugugccaccacacccggcuaauuuuuuguauuuuuaguagagaugggguuucaccguguuagucaggauggucuccaucuccggaccucgugaucugcccgcuucggcuucccaugccugggauuacaggcuugagccacugcaccuggccagggauuuuuauauauacuuaaagaucauuguuuauauguuuagaaauugaaguugaccuaaaauauuauaggaaacacagaauaccuugauacuaauuaugaggcuguuucucuucauguaucaguuaugccauuuucucuuuagaccuuacaguucccaaauagagugaauaacacaccacauguuuuccuuugucaguuuguuuauuccacaauuaugcuauuuaucauauuauuguuagaauuuauccauuuauuuuucuauauucuuccagggauuuuaauuacuucuaggauagggaccauaaguuaagccauuccauaaaaccaugaucaaucuuuuucgugucuauaaauuggguaauccaguuaaaauguaauaaauaccaugauaagcagccuguaggauuguccccaaugaucucugauucaugguugugcaauccucucucuucaagugagaucuggaucuagugaccuguuucuaauggauaaaauauagcagaaauaagggaugccacuuccaagauuagauuacaagaagagucuggcuuuugucuugcuuccuuuuucuugcugucugacuugcccacacucaaggaaaucaguugcuauguagugaacugccuuagagagcgauucacacugguuuucagccaccaagcagcaaggaacugaagccuuaguacaacaguccuugaagagcaaaacccugccuaccaccuguuugagcuuaagaguugaugcuuccccaguugagccuugagauggcugaagcccuuacugauaucuggauuauagcuucuguaaugaacccugagccagaagcacccagcugagccauuccuggauuuuuaacucaaaaaaacuauaagguaauauguuugugguuuuaaguugcugaauuuuggaauaaugugugacacagccauagauaaccaauaugaauaguuauugaauaaaugaauugaauaaauaaauaauugaauugaucaauuaauguaaauuuuaagucuguaacacaauaugcacugaagaaaaaaugucauaucacugaaaucccucaaacaucucaugaggaagcacaaaacauaacaucuaugugauauuagcagauaucuaauuaaauauugccuuauuacucccauucucgguaccauauaguauuuguauuuuaacaguuauaauuagagagaguuggcauuugccaaguucuacaaguauauauuuuuuguuuuaauauucugaaaaaaaugacaaucucuaagucuaaauucauucaauaaaauauuucaaaaaccauaucaucucauuagaagaaaaaacuauaauuacuuuuucuagcaucaauaggauuuauuuuuucuuuucauuuauuuauuucuuauuuuuauuuuuuuuuaauuauacuuuaaguuuuaggguacaugugcacaacgugcagguuuguuacauauauauacaugugccauguuggugugcugcacccauuaacucaucauuuaacauuagguauaucucccuaaugcuaucccucuccccuccucccacccccacaacauuauaaauaauaguuguugaaacaaaggaaccucacuguucuggcaauuucacugaguguacaccauuuaggcugcacuacaauuucucagugaagccauuacaugaagaguuacccuucugucuugugcuguggcuaucaacauugccuguaccuucuuuaauggugaggaaguucaaaucuuaguuccauuucccauuacuaaaaaaaaauuuuaucagucaccguauuuuagagauucugauuucuuacucguaaguuuaguauaacaguaauuuccuuucugaaccaggagagcuggcaaaaaaucaguacuugauaaaugaaaauuaauguaaaucaguuauaaauagacacaauaauauuugcacaguuuccauccuuuguuaagaaucuacucugaaauuucacacauaaaacuuuguucaaggguauacauuauuuuucuauuaacuccuggaauauuucagguuugaggcuuuugggggacaaaaagaaggaaggaaagacccuauaccacucaguuucugucaacucaccaagcuguccacauuuucuaagagcucucaacuauguuaagcaaugaaucuuugaggacaaggacuuuauuuaucuuuacguuaucuucagaacauaagaacuuaaaaauauaaauuauuuuauuguuauacaguauuuauaauauuuaguccuguucuguuacagcuuuuuaaaaaagucuguauuuugaaauaauuuuagacuuacaggaaaguugcaaauacagugcacaguucauauauacccccuaggcagcauuccuuuauauuaauaaauuacacaaccuuagcacaaucauggaaaccagaaaguuaacauugcuacacuauucgccaguggugugcuaccaaaguaguuuucuaggguugggaggaaguaacccugacuuucaguauuugccacuuuccuuguuuuccugugccuaccaugaccaacauuuaaauagaaagaauuucugugguuaaacccuauaucucauugugcagagagguauaaaguagacccucaacacauauauuuuucacuuuuucuugacuuauuggcugauuuaaucaaaaaauagacucuuuauugaaaauauuuuaccucuuauuaauacaaauaguauucuuccuagaguuucucacuuucagauguaucaaauuucaucuugauauuggcauggauuauaaauauaguccauccuucuucagauacuuuucccuugaggauaaugaauuugaaaaugggggcuuauguaugacauuuaaucuauaguccaucaacacugaucaaugcaaaccagauucagggaagugauccauguccccaagcaaauauaaaaaucaauuuuaccuguuccaccaaugcaugccuuggcugugcuacauuuucaauuuucuuucauuuuuugaaaacugcucauaaguuauaugcaugagaauguaggaauuaagcagacggugaauugagagcugcuuuaaugaaaauguauuauagaugcuuuccuccucagauguagaaccuaucacauauauaaucuauggcaauauuucagucagcuucuauaauugauguauaacuucaauaggaaguucaaacucuggaagauaacuuguggcugagugacaacaucugacucaaucauaagcggaauauuucucaaauuugugggaauguuacaguucgccuuuggguauugaaaagaguguaauaucuuaaccccuuuaaaggacaaagucaucaaaaauguuaccuucauucauucuggaaauaaaaaucaugcaguaaaucauuuuuuugucaugcuuucaggagagaagaggggagagaagaacguugacuagagauaaaggagaccauauaaaaaauauuuuuaccggccggacgcgguggcuuacgccuguaaucccagcacuuuggaaggcugaggcgggcagaucacgacgucaggagaucgagaccauccuggcuaacacggugaaaccccgucucuacuaaaaaauacaaaaaaauuuagcccggcaugguggcgggcgccuguagucgcagcugaggccaguccucagcugaggcugaggcagaagaauggcgggaacccgggaggcggagcuugcagugagcugagaucgcgccacugcaguccagccugggagacagagcgagacuccgucucaaaaaaaaaaaaaaaauuacccuuauuuuggauuaaauauauaagaaauuauaaaaauaaaauaucauuuggcaaaaaccacgguaauaauuguugcagaugagacuaucauuggaugcugaaaucagugagcaaacauuugaggagaaacaagguaucaggcuguuguuacagucucaaaaacuucccccucauauguuuuuccaauacaaagaggagaaucacaguguuacaguaaagaaaaacuguuaaacguaguuagucaagguuaauacaaucaguaauaagacuuguuaauauuauguaguccuaccaagaagcagugagagaaaaaauaucauuucuaugauauuuuauugcccauacuguauaauccaaauuuaauuuuaaagcuaauauugaaaaagacucaacaaagaagcuagcugacuacuacucauuaaaauugucaagacugggaaaaaaaaaaaaagaaguugaauauuggaggagacuccagagaccaaacacaaugugcaaugucagauucuagaacagaaaaggacaucuggugaaauucaaauagucuuuaguuuagcuaauggaaucaguaggcuauucacuucucuuggccauggauuccuuacucgaaaugaggaaaauggucaucucuaccucggagguuuauggugaaaacaaagugagauaauagauguauccaugcaugguacccaaaugaguauuagcuguacugcaaaugauggagcaacuguacuguguccaagacacaaagauacaagccagucuuucucuaacaaagaguaaacaagcuauaucacagaaaaauuguauguagacagguaaaauaucuuucugcaaugauauaagcuguuccaacuuucccucuucuugagguaauaauucaaaaucugugaggaggucacguuagugacaggcuuucugcacuuucuguuucuguucaaagacugauguaacucuaugguggcagaggaaaaauguaguagaggaauaguaugaguuuccaguaauuuagaaaaaagagacaaguacauaugagaaaaauagaaggaugacaauguuuuuauauaucauguaaacuggcuaauugugaaagucaauuuugguucauuaugaaaaauauuuauagcuguacuuuauuugaauuagaagaaacaucacagaugaucaaauugaaguuucuuauuuuaucaaucaaaaacacugagggccaaagagguuauguacccuguccaaaguuacauguugaguuaucggcacaaaaucccagucucuguccuauuacaggcuauugcuucuuucuucaaguuuaguuuuguuuucuauuaguucacuagaccuaaaagaacccccuuagcauugacauaaaauaaacauauacagaguucugacaguaaagccuuccuaccuuuauuucagugugcccuuauaguagagacuaauuggacaguuggaguuagaagaggaggcaaauaaggcaaaucuguaaaacuugacuuauuucuacuuaauuuaucuauguaggcacuaacuauagguguuuuccaucuuaaaggguucuaacugaaauauauaagaaauuauaauaaugaauuauuccuucuugcuuaugagacuaaaaugaauuagaaauuaugaaaauuucauaaucauauacuauauguuuauaaaagaauauuugauaauuugaagacaaaaaaaugagauaugucaaaugauguaaaugcaucaugagauuacugcugugguuugaauauguccucaccaaaauucagguauugcuaaugugaugacauuaagagguggggccauuaagagcugaauagaucaugaggguuccuuucuugugaaugggcuuagguaaccuuaaaaaggcacuuaaaaauggaacugacuccugcaugcccuuucaccuucagccauguaaugacacaguaaaaaguuccucuccaggugcugggaacuugcucuuggauuuuccaagagcaaacguaggaaauaaauuucuguucaugauuaauuacccauccucuuguauucuguuauauaucaauauuguuguauuuugugugccaaaucacuuuauuuaauugauacacucuucuccauccacucccagauaggaauauuccuaaaaccaccauuaguuuucacaugagggagauuuuccuuccuaucucugauugacgguagauacuuggcuuccuauaaucagagcugacccaguuugauacauaguuucuauuuuuuggcauuggcaauaauacaugcuuccucucuacuuggaggucuucagaauaggauauauaguauaauuuauguauccucuaaagguuaaugagaacgguuaaugagucuuaaugaguguuuguuaaauuaaaaaaguagaaauuauuucuuaaaauaaucugcaacuuuuaauacauggcucugcuuaacaucuauuauuauuuuauuucucucuuuauuacccuacacaacaccuuagccaaagaacuaugaaaaagcagacuuuacaauaaguggaaucugaauguccauggaggcaauguggggaaucaaaugaguaaagaauguuugagaggaggcagaagacuauugcaaaaauccuggugaaagaugaugagaaaaugaacuaaggcauugauggugaggaugaaagggcagagcagaagaaucagaauuugggaccaaaucagguguguaaacugauaaaaugggaagugugaagaauuauucugaugauuuuagaacuuauguagguuauucaauugaauuugaguaauuuuuaaucacucaaauaauaugucauugcuaaaaugacauuuucauaaauuaaucugaacguaccucaacuuuuuaaaucuaaaaugauuaaaagaaauuuacauguaauauucauauaacuacaucuauucaacugguaauauuauauacuuugcaacaucacauguuuaucacaaauaucaagagcuaauguuacuguagacaacucugaauuugacacuaucuaguuuggaaauuagccgcauccuuuuuucuuccucucauuuugaccauuucacaguucauuaucacaucuaacagagagaaaguugaguaggggaguaaaaaugagacuccuacuuaucacauauagguguugauuccugagucaccuuuuucuuuuuucuuuuucuuuuuuuuuuuuuuuuuuuuuuuaccaguacuuuagacugugaagauacuuuucuguaaaaacugaaauaaacuaaauuucccauaugucagcacaguuuguccugggcaaacucagcaacguucacuuccacauugcacaauuuaaaaucauuuacaguuguugaucugcauagaugugcguuuucccaguuuaacaaagaauuaaaauggaaauaauuuuuaaaaaguuauucauuuuguuauuagucucuauauuguauugauuagcuguguuuuuagagaaugcauucccaauauuuuccugaauuauuaagaccaugucucuccagaacuguugggaaucaucaaauguauuuauauaauaaauacaaccaacaguaauuguucccacaaauccagcuucaacucacuguaugugauuuguuggugaugcaggcacugagaaacugcauuaacuuuuaauccauaaagauacaauauaaagagauggaggccuuggaaaugaggguuagccgcagauauaaucucucugcccuugauuaaaacuuuugaacuauugaugcuuuccacauuuacaaguguagacauggaauacaucuaauaauaauuacaagaauuacucaaguguacaauuacuuuuacuguuacaacuagauaaugaucaauaauacgcacgcauuaacugcuacaucuaaggaacagagugguuauuaugucacaaaguguuuacaucagugacuuuggcagugauuuuaauguuuuaugaaaaaugaacuaaauaauuauuauucuauugggacugucaauaucuuaagacguaugcacacacacacauauauauagguauaauucagcaaacuuuccuacuaaauuauacauacauacuggaaguauuuuaaaaugacaccaaagauacagaaauauugaguuuugacugguauugaggcauggguaaugagcaaauuaucaacauugaaaugagacagaaaugaauuauauuuuuuauuucaguuaccuauuugcccuuggguaauuugcuuggcuuuucugaaauucagcuuuaauauaagaaugaagauaugacugcccuugagacuugccauggaaaguaagugaaacaaugugggaacaguguuuuguuuguguggccaugaugccagcuggguaaguagcuacauauuuuugggauaauuugccacauuuucaaacccauauuauucauucuuccucaauaaugcuuugaauacauuuaugcuauguuugaaaugaguuucaaugcuuuucuacauugcacauaggucuaauaauucucaguuuuuauaucauugauauaauauauaugaagaauaauguauuuuucuaggaguuugacauuugcacauuuguauugugaaaaacaaaacaaaugauaaaaauuaugacuccuaaaaccuaguucugucuacuacagaggguaauugauaaaugacagccucuacuacauaacaacaaauauauaagggaugcauauucuaggaaauguguuaauaacuuauuuuucauuucuuuuaauauaauucaauuccaauaaagagagguuucuaaauucugcuuccauugccuaaguacugaaucauauuaaauggugaaaugugaucuauaugauauaucacaauuaucuucaauuauuuuuaagguaaaauauuauacaaauaaauuaauuaagucaaaauuuuaaauucucauaacauuuuuuuucugaaccucaagugcaaauaaguagauggcaugacuauguuuacauagacuuaauauuuuuaaaaaggaacucuacucucccaacccuaucuaaacaaaucaagaaucuacaaaacuaauaaaucaaauguaaagauaaaauagucaaaaauuggguucuugaaguuauugcaacauauuuguaauuaauaugcugcugcaaaaucauauuuauauuaaaguccacacauuauuauuaaggcaaauauuagcaugggaauaacauauaaccuggaaaaaaucacaacccagcaaauaaaaagacuccugcuagacaaaauucuuuuaaauuacacuguagugauaaagcagauuaauugcaaaaaugagauguugucugcuaacauuccugcugaccacucuaaguaccauacaagagacuaaauuucucaggcauucuggcaauggcuuuuuuauaagugccagcugagcuaaauuugcuaaaugcaaaucucucuagguaacaaaaugcacaagcaaugugagcuggcuuuugcuugcacuaauuccaaaguauggcacaugaacccuuguaguugaaaaugcagaacuauggcuuguaagcuggguucacacuugauauuaaccuuucugugcaucacuguaggauuugcaguuuuuagauuuuagucugaauuacaucggaaaugagguuggauaugucauuguucgaaggcaaaaucacaccuugcucuuuggagacagcaacaauauauacagcagcauuuugcaaacuucagcaugcauucaaauuauguggggaucuucuuaaaacacagaauuuuauucauaggccugaaaaacgaccugagauuuuacaugccuaccaauacacugagucguaccuaaaucaucuaagguccuugcucuguguaucaaaaguauagaacaguacuauccaaauacuguuuauuauaauuauaauaaauuauaaagggagcuacauauuugauuuuaaauaucuaguauccacauuaaacaaauuuuagaaguugcaauuaauuuuaguaauuguuaaauguauccagaauauuaccuuuucagcauauaauauucaauuaauaaugacauauuuuagguuuuuuuguuaguaaugccuucaaaucuggaauauuuuguacaaugacccaucacaauuuguacuagccacauaucaagugaccaauagcuacauaugccuagugguuauaaugucggacagcacgaguauaauuuauuuuuauuuucauuuuuauuuuuauuuuuuagagacaaggucucucucagccaccagggcuggagugcaggggugcaaucauaggucuucagccucaaacuccugagcucaagugauccucccaccucagccucccaaguagcugggacuauagguaugcaccaccaugucuggcuaauuuuuuauuuguagagacagggucucacuauguugcagcccaacuggucucgggccccaggugauucuccuaucucggccucccaaagugccaggauuacaggcaugagcaacuguacacagccuuagauauaauuuacauaauuuagaaagaaacaaaauaauauuuuacuagugaaaucaugaauugugcucuuuucuaaauuucuccuucauuuuuaaucuguuuaaguguagcucuuaacuaacaacauccauaauuuguuuuauaccugcuagggaaagaaaacaagccagaggggaccccugagaccuagaucagaccauuagaggucuugaaacaggauaaccugagaaaagaaacaaaguaggaauaaaaacaacagcagcaaaaauggaaauaaguuucuugaccaaauaguucuugagugucugcuauguuccagauacugcacugaaggugagacuacaauaauggacaagaauaaugaacuuccucuuauagagguucuuaaagagaauaaacaggaauaaaggaaugagaguuagaaaucaaacuguggaaaaauguuucaguaauuauuuaauaauuacugaaaucaaacuguggaaaaauguuucaguaauuauuuaauaauuguucuaggacaauaaagggaaaaggaaugaagagaaacauucagugcgucuugguuuccuccaacaccuuuggcuauccuuucuuauuuuccuuucaugugugcccuuuccauaggcacacucuaauucuuuaauuacaaaauaccuauggauuggucgugaaucaccuucucuuacuuauauagacuaucccuuggugaucuuaaugaggacuuugucuagcaauacuaccaaauguauaacuugugcaagauuucccugucucugagcuuccagcugacuacuugacauuuucucuugaccuagcaucuucacauacugugaaaauaauucuguaucaauaacucucccauuucuguuuuucuccuagucuuuuccuucucaauaacugacauuguagcuaucuaauugcucagacuagaaauauggaaaucacccuugauuuccuuuuaucuugcucuccauauccaccugaccaggaaauccuauugauuuuaaauccaaacauauaucuugacuucucuccaacucuauugucaaccccauaguccaagucuuaauuucacauccacauuacagcaaugguuuucacuccugcuuccuacaauugauucuucaaauuguagucagaacauucucuauaaaauucaaaucagauaauguaugcuuaaagaucuuuagaggauucccauuucacacugaauaaaaucuauauuuuuuaccagggcaugaagggcuucaaagaucuggcucaugccugcuucuccauuuucaucuucuacuaugcccccaucacaauaugccaguuauauuaauuucucuucuguuucuugaaguccccauguucuuucuuaaccuugaacccuuguauuuccuguuccuuugauguagaauguaccucucccagaaauuuuugugguugacuacuuuuugcuuuucgguucucccaucaaaugucaucuccuuagggaaaaugucucccauuauucaguaggucugcaucaccacaacuucuccuguuaaucgcacuuuuuacaaauuaccuuguuagcuuccugcauaguacauauuuuaauacguaauuaucuuccaaauauauuugcuuacauuuuagcuuucugauucuuguaauaauagaugaguuucccagagcccaauacauauuacuuucuauaaauauuuacugauugauuguugaaugaauugcauagagaugaaaaaaaugaguucuacucucagaucugcuauuauaaauuguacuuuagucagucauggaugcuaaucugugagucucaguuucuucaugaguaaaguaagugucguaacauggguuccuacuuuaauguaagaguguaugauuucauaaagauaaugaauaaugaaaaagcuaauacugagaguuuuugcuuauuugcuguaaaauauucaagccaacuggcuaauauauccaugaaaucacucagcuaugcugaagccacaauucuggaagagucagcaauagacaucaagucaauuuucucugcuaauauagggagaaguauagagauaauaccaaauggcagauuuuucauuuuuguaaucuuguuuugcuuuggugauacuaaauugccuuguagucucugacugacaauaggcaaguugggaagugggaauagugugccagaaauguauuauauacuuagggcaaaauaucccagaauuaaaauuaaaauugaucauaaaaggguauauauauauaaaaucaagaguugacuauauucacuuaauauaauauuguuauagaacacacacagcacagguucaauugcuacaacugcauaaauguacauguguaucugucucuguaucucacuauucaugaauugauagguacaacagacaugcaugagauauauaucauauauucacuacgaaaaugauuuaaauuuguaguggguauuucuacacacugcaucauuuguuuauucauuuuuucacauauguauuuuaucuauguccauuguuuauuacuauaacaagauuagcuaucaguuaauuuuuauuuuuacuugaccagaucauuauuuauuaugaccaaggugaaauauuuauagugucuucuaaauaaucaacagucuaugauugaguagaagaauaaaaacaaguaauugaaaacuggauauucucugcuuauauaugguaauguucacuaauuuaaucuaguauauuaauuaaugaaaacuuggcuuaagaaaaagcacuuguaugcaguucaaugaguacaacaaagacacaaauaucauauauguauaugugucuguguauauacacauauagucauguaaauuugcuucuucucugcuuguaaguagacugccuacaccuuaggagcagaagagaauguuaguuucuuugcuaucaaaacacuccauguuucauuguuaaauauuaaauucguauucucuugacauuaucuacauuuguugauaauaauuuguaaccuagaguugcagugcucaaauuucuugauaugcugcugugcuaugauaaguuguaaaacuuaugacaagcaaguuguuacuaauaauagucuaaucauugauuguaaaaagcacuuaauuugcaaaauaaguucauggaaauuucucacgauaaaaagaaaaagugaggugacagagaagguugaaucaccacuaguuuaauucaaguaaugauucugaugugguauacaucauaugauacaauaaaugacauagauguauuuuucauugauaaguacugauacauauaaguaaugauacuaauguuguggccauuauagguuaggaaggcaaauugcaacucucucuucaagccuguuccauccaugaugacaauggucuaaccaaguaucuuaaggaauugaagauugccuacuagaaguaucccauuauaacagaguuuugaaaaacaguuuuaaagaaaaaaaaguauuaauauaaaaucaguuucacgucuuacagaaauguuuuauucuacuugcucaacauauuauauauaugcacauauauaaauaauaagcuagauguuaaucaacaccuuuuuuuuuuuuuuuuuuuuugaggcggaaucucacucugucgcccaggcuggagugcaguggugcgaucucugcucacugcaagcuccacaccccggguucacgccauucuccugccucagccucccuaggagcugggacugcaggcaccugccaccaugcccggcuaauuuuuuguauuuuuaguagagacgggguuucaccguguuagccaggaugguguagaucuccugaccuugugauccgcccgccucggccucccaaagugcugggauuacaggcgugagccgccgcucccggccuguuaaucaacacuuuuuuuguuguuuguuuuguuuguuuaauuauacuuucaguucuggguuacaugugcagaacgugcaguuuuguuacauagauguacacgugcccuggugguuugcugaacccaucaacccaucaccugcauuagguauuucuccuaauguuauuccuccccuaccccccuacccccgcgacacguucuggugugugauguuucccuuccuguguccauguguucucauuguucaccucccaccuaugagugagaacaugcagaugguuuucugaucuugugauaguuugcugagaaugaugguuuccagcuucauccaugucccugcaauggacauuaacucauccuuuuuuauggcugcaaaguauuccaugguguauaugugccaucuuuucuuaauccagucuaucauugauggacauuuggguugauuccaagucuuugcuauugugaacagugccacaauaaagauacauguacaugugucuuuaucguagaaugauuuauaauccuuuggguauaugccuaguaaugggauugcugggucaaaugguauuucuaguucuagauccuugaggaauugccacacugucuuccacaaugguugaacuaauuuacacucccaccaacaguguaaaagcguuccuauuuuuccacaaccucuccagcaucuguuguuuccugacuucuuaaugaucgccauucuaacuggcgugagaugguaucuuauugugguuuugauuugcauuucuccaaugaccagugaugaugagcauuuuuuccuaugucuguugguugcauaaaugucuucuuuugaaaagugucguucauagccuuugccuauuuuuugaugggguuguuuguaucuuucugguaaauuuguuuaaguuuuguagauuuuggauuuugccuuuugucagauagauagauugcaaaaauuuucucccauucuguagguugccuguucacucugaugauaguuucuuuugcugugcagaagcucuuuaguuuaauaagaucccauuaaucaacacaugauaaaagcaaagugucuagaagguguauuacaauucccagucauuuaaaaauaagauuuaguauucuaaauaauuacuaauaaguaucauuuaauauuugcuaaauauaaagaaguaacuaauuaucacaguuuaccuuauaaaauaaauuaucuccacuuucacaucucacauugguauggcuacuuccauuuuaguuuucagguucuggugcucuuaaucuuccuacacuuguuccagucgaaaccuaauucacuggcauauaaacuaauugcuuccccuuuaugaauuaauaaauaauagagguagaauaguauuuucucauuuacacaacagcuaugaaacugaauucucuuuagcaauacugacuuaugaguuaaggcauguaaaacaaagagcauacuauguuuauauagauaccauuccauaaaugccaccuauuguaacuauuucucuguucuuaugagaguaugggauccaaacucaccugcuuccuuauauaauuucauuaucccucuucuauuuaaacaucaaggugggaaaauauagaugggaagagcagagugucucccucuuuccaagaaauugaauauuauuucuccuuaggucuuugaggaaucaccacacugucuuccacaauggcugaauuaauuuacacccuuaaaaacagaaauaccauuugacccagcaaucccauuacuuggcacaugugcaaaggaauauaaaucauucuauuauaaagacacauccacgcauauguucauugcaacacuauucacaguaacaaagacauggaaucaacccaaauucccaucaacgauagacuggauuaaaaaaauuguguuacacuuacaccauggaauacuaugcagccauaaaaaagacugagaucauuuccuuugcagggacauagauagagcuggaggucauuaucuuagccaacuaacacaggaacagcaaaaccaaauauugcauguuaucacuuauaagugggggcuaaaugaugagaacacauaaacacauagaggaaaacaacacacacuagggccuuucagaggguggaaggugggaggagggagaggaucaggaaaaguaaccaguggguacuaggcuuaauaccugggugaugagauaaucuguacaacaaacccccaugacacgauuaccuauguaacaaaccugaacuugcaccccugaacuuaaaauuaaaaauaaaaaaaaaaauuauuuuccugagagagcuagaaaacugagauaaauaagaucuuuaaauauuuuuacuaggaucauaguacacuuaaauuauauuggauacagacauauauuuuacugaaaagagcaccaaauuguguuacauuaucuguuauucauaaaccauguuuuuauauuuuacguuuauucaugucccccacagucaaauauuuuacucuauauuucuacauuuucucuaaauaucuucuuaaaauuuugucuucuuaaucuauuuaaagaaauggccaacaaguauagggaaaaaugcuguucaucacuaaucaucaggaaaaugcaaaucaaaaccauaaugagauaucaucucaccccaguuaggauagcuguuaucagaaagacaaaaaaaaaaaaaugcuagcaaaggugaagcgaaaagagaaaucuuauacacuguugacaagaauguaaauuaguacagcugcuauggagaacaguauggaaguuucugagaaaaaaaaacuaaaaguaggacuauccuacaguccaguaacuccacuacuauuggguauuuauccaaaggaauggaaaucagcauauaaaagagaaacaguaccccccuuuuaauugcagcauuauucucaauagccaagauguggagucaaccuaaguguuaaucagcagaugaaugaauaaagagaaugugguacauauacacaauagaauacuauucugccugaaaaaaugaaaucccauuauuuguagcaauguggaugaggcuggaggacauuauauaagugaaauaagucaggcacagaaagauaauaccacaaauucucacuccuaugugggagcuaaagaaaauugagcucauggaagcagggagcagaauugugguuauuauagacugggaagaaugggaggaguggggguagggagaggugaauuaaugaauacaaacuuacagcuaaauggaaggaauaaauucaaguguucuguagcacugcagcaugaauacgauuaacaauaauuuaguguauauuuuugaaaagcuagaaaagaggauuuuaaauguucacacacagagaaaugauaaauguuugaguugauggcuauguaauuacucugauuugaucauuacacauauacacauauauuaaaauauaacuguguauguacaauuauuacaugucaacuaaaaauaaaaggaaaaaaacuagcaauuuuaacugacaacugcacccuuauuacuucuguguaacuaucuaggauuugauugcaacauaaaaaucuguacuaaauauauguaauuuauuuuuguauaaagugccuaugucccugcucuuccugcuuaaaauaugcauuaagaaaauucuuuagugguuaaucaagacagaacacauuaugagaaugcucccuacagagauuuauuucuaaagcuuauccuaucauugcuacuuauuuaguuuaaagcuuuaagaugaucugggcacaguggcucaugccuguaaucccaacauuuugaggggccaaagcgagaauaucauuugagcccaggaguaugagccaagucugagucuucuucuguacaaauuuuuuuuuuuaaaaaaagcuuuaacaauacacacacagacacacauacacgcacgauguauauauacauauauaugcaauguguguguauauauauauauaugcaaugcuaauuaacacacuacuuaccagugauaagcaacauguaguaaagcaagggguacuuuaucaaugucaaaagcacuguaauauuaugaaauacacacugauaaauauuuucauauuaccaacgauuccuuuuccauuacugaauuguagcucagauccugacuaaacauaaauauuuggaaauaauucuaucaguuagcuuuauaucagugcacuaauggaauuuaacaaaauuauuucuaaaacacaguuucucacuauuucuaaagacuaacacgaaagugauuuucaaauuuuugauguuuaugauaucauauucuagauaugugcucucagaauuuauguaugaaacaugaaagacacaggcuuaauuuagcuacauaggucaaauaucaucgauuuaguuuuagcuauuuugucuuuauaguuaucacaaauaugugcacuauuauuuauuaaacaaucuauuauuagguugacgcaaaaguaauugcaguuuuugccauuuaacauuaauauauucuauauaaauuaacagauacacaauaaaucagauauuuauucaaagaugcauauauccuguuuugcuuuggugauugaagagacugaauaaagaaagauuuugaaugggaccacuuacuucaauuaaguacaaacacuuucugcugaaaugacgauaauuuguguuaaaugacucauaauauuguggauuaguggaaucugagcuccuaccacaucucugcacucuauggcauucuuacucaaugucaacaauauuuguuagucuaaccuagauuccauuugauugagcaauacugagacauucaagaagaauuucaaacuaacuaacucuguugaauaaaugaaaacauuuggcuagaauuuuaagaaacauuuuuccauuguuagcccggaaauuuuaggauuaaccaaagucaaaauuaaaaaaucugacugagaauacauuuucuaucuuaagaaauuuuuaaaacuauuuuauguuuuaagaagcacucauucuugggacagaauugccuacuguuauugugauccuuuccucaggcaaccuugguuaucuaguccucaggcgcuccauauuucuuucaaagggaaacaaggguuucuauugguacuaggaauaguagcauuucuucacuagagaaaacaauuuuuaauaaucuaauuauccuaugucaaaaacacauugaaaacgaaaguauggaauuaagaaauuuugcacauccaccaaugcuugcugguggucuauaggaaauuuacuuucuuuaaucugagucucauagcguuaugaggaagauuaaauuacugagugcauguaaaaccauuacagcagugccugggaauguaauuacucaauacauguuagcuauauuaugauuaucaguuguaauuccaucuagaagaaugaauuuuaucaaaguuccacaaagacccucauuauauaacauggauccccaaaacauucucuuaauuguaaaauugccacaacucauuguuauuaaucaugauaacaauuuccauccaaguauuaauguccacauuuuucagcaucuaauaaggcaguuauacaacaugcagucaaaauucuuuaucuauaguuggauuguucacauuguggauuauuuauaauaagacuuuaaucuuauggugacuucugcuugacaugacacuuuacauccaucucuaucuaguccuaguugacaugugcuaggggaauucaaaaauaauuugacuuuacucuagcugaacauaauuauuuaagcaaacacgcugucaaaacuacacauaguauaucccaaagguaaauguaagugacuugaucauaaccuaugcuacuauugccuuauauuagcuugaauaaucucaaguucaguguaauuaaguaaaaacucuguuauaucaaauacagccuuauuuuugaacacauggaaauggaccacaauaugaaauggccaaacaauaaacaacaaugguuuucuuuggguaauaucauuagaaugaaugugugugucuguauagaaauacauguuuuuaaauaaacuucacaaguuuuugauuauaguaagugaaaacagccagucaaaaagaccacaaauacauaauagagacagaaaguagauuagugguugccuagggcuaggggacguggguggaguaaaugaagagugacuauuaaugggcaugaaguuccuuugcaguaaaaaaagaaaaacuguucuaaaauuacaauguggcaauguuuguacaacuaugugaaucuauuaaagccauugaaugauguauuuuuuaaguuuucuaaauuaccuccauaaauuaaggaauaaauaaaaaauacugagaaacaugagauguaucaaugaaacuagacuuugugauccucuuaaaguaaauaaauguguucugcauauauuuauauuuuaaaaagaggugguuuuugcuagauuuagguagccuaauagcuuggcuuugagguucaacacuaauuauuacugaacaaauucaaaggccagacaugcaauccagaauaguaaaauugaugacuugggaacugugucucucaacaaauagugauacuauuuuuuuaaauaaagccugaguuuuaaccaacaaauuuaauuaauaaaauuaauaacuuauguuuguuaaucuguaaaauggagauuguaucuaccuuagagguugugaaaauuaggggaauaaugacuaucaccagaguucaucacacuagcugagccucaugaacauaggugauaguuuuauuacuuagcucugcuucuauguugauaaaucaaaacuuuucuaugcaaggugggcacugauaaauuauacuccaaaauguuuuuguagccugaugcucuagacaucaggccuaaugguguucuagaaaauagacgcacaagguuccugcacucaugcuuacauucauuaugaauaagagguaagcaaauaaccuaaguagugauagaaugcuaauagagauacauccugcaccgcuuuccacauucagagaaaggagagauuacuucggaguggagggccagugaagauuucaaggagaauuauugcugcucacugaaagauguuuuguuggagcuauccaauagcuauacccucgcuugugcacagucuugucccuccacauucuacaauauauuuucauaauccugaacucaacaaagauaauuaacuccagaaauugaaagacagcucaucuuuauuuucauuauagaacuaaaauacaucacaguugaauuugaauuuauauuagaacucacgaaaugcuucaggagagaucugaagucauaaaaucagguaguacagaauacaauaaagagcuugcuuuccagcaauuuccuagaauuaaugauucuuccuuuacugguaaaaaauauuuuuuuaaaaaaaugacacauauaaauaaauaaaagcuacagagcuaagauaaacaaaugaauaauaaacaagaaauuuuccuauagacuaaauacaaaaacacuuugcccaauuuauuuuaguuucaaaaagcaauaauaauugaauuuuacugugaagcaucggaguguguuuuuauuaccugguuuaguuuauauucaauuugguguuucauaauuauuugaaagguugauuucugugauauaaaaucaauccagcaaauggugaaccaugcuuaauuaguuugcucaaugaauccacuacaauucacaaggcucccagauuuaauauaauuuagacauuuauuagagggagaugcugauuuuaaaugcuaauuggaacauacugaccucccuuaucaguuuguugccuuaaguggagaguacauauaaaguggguacacuuguaauuaggcugccuagguuugauuaugcucaucccuucugaccugugugaaucaaggagaauugcauaaucucucaguaucucaauuucucauccgaaaaugaucaugacaacggugccuauaucagaucaaccucauaaucauuguauuguuuaggauaauaccuaauauaguaaguuacuaauuaaaguuagcucuaauuauuuucuauacuuucaaaagagaaagacacacagagccuuuauugguucauuuucacacugcuaauaaggacauacccgagacugaguaauuuaugcagaaaaagagguuuaaugacucaguuccacaugucuggggaggccucacaaucauggcaaaaggugaagaaagaaaaagacaugucuuacacaguggcaggcaagagaguuugugcaggggaacuccuauuuaugaaaacaucagaucuugugagacuuauucaccaccaugagaacaguauaggggaaacugcacccaugguucaauuauuuccaccuggcccugcccuugacacguggggauuauuacaauucaaggugagauuuggguggggacacagccaagcuauaucagagcccacugaaaucuggaugugagauagcauaaugugaaucaugagcauaacauuguauccaaauuauauuucuuccaaaaaguaggucaagggcuuuguccuuuuugugguccaccuuauccuuuuuggccgaagggucgaccccucacaugaacuccuggcaaguauuaucauaccacuuuuauaccuuauaaggcaacuacuccuuaacauccugcauuuuucuuaugucaugacuugauguuucaguuucaggcuuuucuccccaacuaaauaauggacuuuugagggcagaggccuugcccuuuguuuucuguuaacuuccauaguaccugucagaaugucuugcauagcguggaaguccaugaauacuucuucagauacagauucauaucacaaaagacauugugagaguuuccuccugaaucugccacauaaucuggcaaguuuauuguccuguaagucuuucuguuucuaagaaugagccugguuuuuggcaaaagguaugaacuuuauaaauuucaaucaaugaacaagaauuuggucagaagacuaaauucuccuggcuauacuuggaggagggcuugguugucaguauaaauauuguaaaagaauaagucagcaaaucagaauaagagaaaauauacaaaauuucgucaucugggaauuuaaacauuugaguuuuaaauugauacuggcuauauuuuugaagaaaauaugcucuucugucauuugaaaauacuauauuuggacuuccaauuuccugccccaaauguaagaacuuggaaaucaucacuccauugcaacaauaaguaaaaagcugaacacacagaaggccagcaacucuucuuagacccauaauagaagugagauugcaagguaaacaucuacucucaaaauuuuggagacaggagcagauauagccauaccucauuuuauuacacuucaucuuuguugcauuucccagauguuguguguuuuuuuuuuuuuuuuuuuuuuuuuuuuuuuuuuuuuuuacaaauugaauguuuauggcaacccuguaucaaacaagucuauuugcacaauuuuuccaacagcaagugcuuacuuuuuaugucucugugucacacuuugguaauucucaauauauuucaaacuuuuucauuguuguuauaucucuuauggugaucuauagucagugauuuuugauguuacuguuuggaggggacacaaaucaugcccauaaaagauggcaaaaugaaucgaucuuaaucaauaaacaccacauguguucugauugcuucauccccaauuccccccucccaguauucccugagaugcaacaauauugaaauuaagccaauuaauaacucugcaaauggucucuacaugcucaagugaaaggaagcgucccaccucucucacuuuaaaucaaaauuuagaaaauauuaggcuugaugaggaacacagguugaaagcaaagauaagcugaaagcuaggccucuugcaucgaggaguugagcaaguuguaaauguaaaagaaaaguucaugaaagaaauuaaauguacuauuauagugaacacacggauggugagaaaacaaagaagucuuuuuugcugauauggagaaaguuucaguggucugaauagaucaaaccagccacuaucuuucuuuaagccaaagcaaaaucuaaggaaaggcccuaagucuuuucaauucucugaagucugagagaggucagaaagcuucagaugaaaaaauagaagccagcagagguuuguucaugaggcuuaaggagaaaagucuucuccauaauguaaaaguacaagaggaagcagcaagugcugauguagaagcuacaacaaguuauucagaagaucuagcugaaagcauugacaaagggggcugcccuaaacaacagauuuuuauuuuuuaauuuacuuuaaguucugggauauauguguagaaggugcuguuuuguuacauagguauacaugugccauggugguuuguggcacccaucaaccugucaucuaggcuuuaacccccauguacauuuguucuaaugcucucccuccucuuguccccuaugccugacagggcccggugugugauguuccccucccuuguccauguguucucauuuaaacaacauauuuuuagugaagauaaagcagccuuauauuggaagaagaugcccccugggacuuucauagcuagagaggacaaaacaaggccuagcuuuaaagcuucaaaggacagacugacucucuuguuaggggcuaaugcagcugcugacuuuaaguugaagccaaugcucauuuacuuuuccaaaaauccuagagcucuuaagaauucuguuaaaucuauccucccuguguccuauuaauggaacaacaaagcuuggaugacagcacaucuguuuacagcaugguuuccugaauauuuuaaggccacugcugcgaacuggugcucagaaaacaauauuacuuugaaauuaugacugcuuauugacaaugcaccugguuacccaagagcucugaucgagauucacaaggaaauuaauauugauuuuaugccugugaacacaacauccauucugcagccuaugggucaaagaguaguuucaacucucaagucauauuaucuaagaaaugcauguuguaaggcuacagcugucauagauagcaauuuuuccaaugggucuggguaaaguaaauugaaaauauucuggaaaggauucaccaaucuagaugaaauuuagaacauuugugauucaugggaggugaucaacauaaucaacaugagcagaagucugaaagaauuuaaugccaacuuucaugaaugaccgugaggaguucaauacuucaguggaagaaguaacugcaguugugguaaaaauaacaagagaaauaguauuagaaguagagccugaagaugugaccaaauugcuacaaucugacaauaaaaugagaaugaaaauaaugaggaguugcuucuuauggaggaacaaagacagugguuucuugagauggaaucuccuuuugaagaugcuauggaccuuguugaaaugacaacaaaggauuucgaauauuacauaaaccuaguugauauaucagcagcagggauaagaggauuuacuccaauuuugaaagaaguucuaccauggguaaaauucuauuaaacagcauggcaugcuauagagaaaucuuuugugaaacaaagaggcaauugauaaggcaaacugcauuguuguuuuacuuuaagaaauugccucaguuagcaaccaccacccuaaucaggcaccaaccaucaauacccaggcaagacucuccaccagcaaaaggauuaugacacgcugaaggcccagaagauuguuagcauuuuuagaaaugaaguauuuuaaauuaagguauucauguuguuuuuuuagacauagugcuauugcauacuuaagagacuauagcacaguggaaacauaacuuugauauguacugggaaacaaaaaaauguguggcuugcuuuauugcaguauucacuuuguggcugugaucuggaacugaaccuucaaugucucuaaggcaagauacgccuguaaggagaauugcaacuuacuggaccagaaaccucugugggaacuauugcugggcuauaggaaaaccugaacuguauuugaugacuugcuggagacucaguguggaaaauucugagagucaaaaacucuagggggaucuagucauaggcgggugcccauacuuaugugaguuuugccuugaggaacuagauucccacagugaauauuagaggaaaaaaaaaucccuucaugcuuccagcaggggaagggagaaaguaaccauuuugaaauacacuauucuuuucuucuucacaaugucugucccuggggaaacuguuuaacuugaaccuaaccuacuggggguuaauucgagucuacaugaccugggaaagggaaaugcccaacuccagcaggcucuagccuuccaacugggagaaggaaaauacucaacgucagcccauucuagcuauccuauuaaagguaaaagagggugggagggggaacagagaagcacuugugaagguugcaguccagaggcacaggcucacuaaaagaccgagucucaaucauaggaccagaccuaugauuaaggaccacaccuuaccaccacauuacuaaaggucuauuuacaacaguucuacuuacccacuacaucauguucagauauauauuaaaaaaacaaggcauacuaaaaaaagaaacacacacacacaguuugaagagacacaguaagugucagaaccauacucagauaaggcagggauguuagaauuaucagacugggaauuuuuaaagcuacaguuuauaugcuaagaacuuuaauguauaaaggagacagcauguaagaacagaugggcaauguaggcagagagacggaaauucucagacagaaacaaaaagaaauucuagagcucaaaaacacuguaaaaguaauaaagaaugccuuucuugggcauauuaguagaucggucaugguugagagaagacuaccugagcuuaaggauauuucaauuguuauugccaaaaaagaaaaauaaaaaaagauuaaaaaaaccaucaacaacacagaauauccaagaauugugagaaaacugcaaauaguguaacauauauguaaugagacuaucagaagaagaauuaaaaaaaaagagaagaaauauuugaaucacccacgaccaagaauuucuucaaguuaugucugacaccaaaccaaagauucaggaaccucagagaacagcaagcaagauaaaugcuaagaaaaccuacaccuagacaaaucauauuuaaauugaagaaaaucaaaauaaagaaacaaaaauccugagagaaacuagagagaaagaaaaaaagcacucacuaagauaaaauuauaucugacuuaucagaaacuaugaaagcaagaaaagaauuaaaugaaauauuuaauauuaagaggaaaauaucaucaaccuaaaauucuguaaccugugaaauuauccuuaaaaugugaaagagaaauaagaauuuucuuagaccaaaaaaaaaaaaaaauuugaggggauguguugucagcagacccucccugcaagaaaccccaaaagaagaacuucagagaaaagaaaacugaaauagaucagaaacuuguaucaacauaaagaaagagcaucagaaaaugaguaagugaaaguaaaauaaauaccuuuuucuuaauuuaucaaauggacaauaauuuguucaaauuaauaacagaaacaauguuuuuauuaaaaaugcauauauauguguaugcuuacguauaugugaaaugaauaacagcaaugauacaaagaauggaggggguaauuauuauuuuuuaagaaguuagaaauauuaaguauuauuuuuagggaguuauuguaagguaccugcacuaccuaugaagcagcauaguguuacuugaagguggacuuggauuaguuguaaauuuauauugcaaacuucagagcaaccacuaaaaauaacuuauaagaaaccaaggaaaaauauauaacugauaugcuaagauaaaaagaagaugaaauggaauaauauaaagugaucaauuaaauucauaaaaugcggaaagaguagaagacaaaaaaaggaaccaggaucacaggcaacaaauagaagauagucauaaauaagauaaauauuaacccaacuauaucaauacuuauuuuaaacaucaugguauaaauauaucaauuaaaagauaagauugacagaguggaucaauaagcaagacuauauuuugucugcaagaaacuuacccuaaauauaaauacauauaaguuaacaguaaaugaauggggaaauauauauuaugcuaacaaucaucaaaacaaauuucagacagagccgacgucagagcaaggauaguaucagagauaaggaggagcauuacaugauaaagggaugaauccuuuaagaagacaugacaguccuuaauauguacauacuuaacagcauugcaucggaauacaucagggaacaacuaauauaacugaaagaagaaauagauaaaccugcuauuauauuuggaaacuucagcaccccucuaucagaaauggacagguccaacaggcaggaaauaaguaaggauauauuugaacucuacagcaccaucaaugaacugaauauaauugaccucuauuggguacuucauucaacaucagaaaagcaugccucucaagcuaacauggaaaauucaccaagguaaaccacauucugggccauaaaacauauuuuaacaaauuugaaagaauaggaaucaaacaauguuuguucucagaccacaauaaaauuaaaccagaaauccauaacagaaagauagcugaaaauuuucaaaauagauagaaauuaaacaaauacaccccuuuuuuucucuucucuccuuuuuuuuuaaauuauacuuuaaguucugggauacaugugcagaacaugcagguuuguuacauagguacacaugugccauggugguuugaugcacucaucaacccaucaucuacauuagguauuucuccuaaugcuaucucuacccuagcuacccuaucccccaauaggccccagugugagauguuccccucccuguguccauguguucucauuguucaucucccacuuaugaaugagaacaugugguguuugauuuucuguuccugcauaguuugcugagaaugauggcuuccagcuucauccaugucccugcaaaggacauggacuaauccuuuuuuauggcugcauuguauuccaugguguauauaugccagauuuuauuuauccagucuauaauugaugggcauuuggguugguuccaagucuuugcuauugugaauagugcugcaauaaacauaaaugugaaugugucuuuauaguagaaugguuuauaauccuuuggguuuauacccaacagugggauugcugaagguuacggggcauuacaaacacacuuuuaaauagcauacaggucaaagaagacaucuuaacagaaaauuaaaaaaaaaauugaacuacauaaaaaugaaaacacaacauaacaauuuguaagauguaaugaaagcagugcuuacagggauauuuauaacauugauuguauagagacgaagaaagaucuaacauuaauaaucuaaguuuucaucuuaggaaacuaggaaaaggagaggaaauuaaauaaaaaguaacuggaaguaauaauaguaguacuaaaaaccagaguagaaaucaauggaguagaaaacaggaagccaauagagaaauucagugaaaucaaaagucagucuuuugggaaaaaaaaaaaaaaucaauaaaaucuguaugccuuuagccaggcuaaggaaaaaaaaaaaaaaaaaagaagaguggacucaaauuacuaacaucagaaaugaaagaagacacaucacuacagaucuaauggacaugcaaaugauaauaaaggaauauuguaaacaacuccaugaccacaaauuugauaaccuaguugaaacagaccuacuccuugaaagacacaaucugcuaaaucucacccaagaagaaauggcaaucugaauaggugaauauuuaccaaacaaauugaaucaaaaaugaauaacuuuccaaacagaaaguacaaggcccagauggguucacucaugaauucuaccacacauucaaggaagaaauuauaccaauuuucuauaaugucuuucugaggguggaaacagagugaauacuuucuaacucauucuaugaagucagcauuaccugaauacuaaaaucagauaaagacauuauaagaaaaggaaacuacacaccaauauauguuguggacauagaugcaaauaucuucaacaaaauauuagcaaaucaaauccaacaauguauaaaaagaauuguaugccaugaccaagugggauuuaucccggauauacaaggcugguucaauauuccagaaucaauuaauaugguccaucauaucaacaagcuaaauaagaaagaucacaaaacuguaucaauagauguagaaaaagcaucugacaaaauccaaaaauucaucauaaaaucaucauaaaaucucucagucauucaucauaaaaucucucagucaacuaagaauagaacuugcucaaacugauaaagacaucuacaaaggaacugauggccaacaucaugcuugauuguggaaaacuggaagcuuucuaacuaagaucaggaaguaggcaagguuaacucucaccacucuuuuuucaagauuuuacugaaaguccuagcacaauuauacaaagagaaauaaagguauacuuacugguguagaagaauuaaaagugucuuuguacacaggugauaucauuauguaggaaauccaaaacaaucgacaacaacaacaaaaguuccugaaacuaacaagugauuauagcaguguggcagaaugcaaaguuaauauacacaaguuaaucacuuuccuauaugccaugaaugaacaagaggaaucugaaaccaagaacacacacuauuuacauuagcauccccaaaaggaaauauuuaaauauaaauguaacaaaauaugcacagaaucuauaugaggaaaacuacaaaucucuaaugaaagauauaaaaaggacugaauaaauggauaaauauuuuauguuuauggacaaaaagauucaauauuuucaauaugucaauucuucccaauuugaucuauaaauaauauacaaccccaaucaaaauuacaggaaguuauuuuguagauaucuacuaaaugauucggaaguuuuuaugaaguggcaaaauauucaguauagcuagcacaauguuaaaguugaagaaaaaaaaaauggaagacugauacuaccugacucaaaaguuuguuauaaagcuacaguggucaagagagugugguauugguaagagaacagacaaauagaucaauggaacagaaaagaguccagaaagagaccuacauaaguacaguauaccaaucuuugacaaaggcgaaaagacaauacaguggagaaaaggaaauuuuuucaaaaaacagugcuggaacaacuagacaaccaccuggagaaaaaugaaucuaaacauaaaccuuacaccuuuuacaaaaauuaacuugaagugaaucacaggccuaaaugcaaaaugcaaaaauauuaaacuccuacaacauaacauagaaaaaaaaaucauaugaccuuggguuugaugguaacguuucagauacuacaacaaaggcaugauucaugaaagaaaaauuugauaacuuggacuuaauuaaaauuaagaauuucugcucugugaaagauacugucaagagaaugauaaaacaagcaacagacugagagaaaauacgugcaaaagacauaucugauagagggcuauuauacaaaauuuacaaggaaugcuuaaaauucaacaaaaagaaaacaaacaaaaaaugagccaaauacauuaaaagauaccucaccaaagaagauauacagauggcaaacaagcacauaaaauaugcuccacaucauaugucauuagggaaaugcaaauuaaaauuaaaacaacaauuagauauuucuacaaaccuauuagaauagccaaauccagaacgcugauaauaccaaaugcuggggaggaugugaaccaacaagaacuuucauucauuaccacugggaaugcaaauuguuacagcugcuaugaaaaacaggcagcuucuuagaaaaugaaacauacucguaccguaggauccagccauacugcucauugcuauuuauccaaaggagaugaaaacuuauguucagacaaaaaccugaaaauugaugcuuauaguagcuuuauuuauaauugccaaaacuuggaagaaacagauguuggagaauugauaaauuauggcacaucuagagaguggaauauuauuuagcacuaaaaaaaugagcuaucaagccaugaaaagacauggaagaaacauaaaugaguauaucacauucuggaagaggugaaacuguggauacaguaaggcuagucguuucaaggguuagggauagggagggauacauaaggagaauccagaggauuuugaguggugaaacuauucugcauaauaccauaauugugcauauaugucauuaaaaauguguccaagcccauagacucaauaagaccaaaagugaguucuaacuuuaacugugaacccggguugguaaugaugugucaaguuaucuucaucaauuguagcaagugcacuguucucuaggaagauguuguuaaugacagaugguauauuaauaugggaacaggaaguauauaggaaaucucuguaacuucugcucaguuuugcugugaaccuacaacuguuccaaaaauuguuuuuguuuuuuguuuucuuucuaaauaaaguuuauuuuuuaagagcuccagaaaguccaggcgcaguggcucaugccugugaucccagcacuuugugaggccgaagugggcagaucacgaggucaggagauagagaacauccuggcuaacacggugaaauccuaucucuacugagaaaaacaagcaauggggaaaggauucccuauuuaauaaauggugcugggaaaacuggcuagccauauguagaaagcugaaacuggaucccuuccuuacaccuuauacaaaaaucaauucaaaauggauuaaagacuuaaacguuagaccuaaaaccauaaaaacccuagaagaaaaccuaggcauuaccauucaggacauaggcaugggcaaggacuucaugucuaaaacaccaaaagcaauggcaacaaaagccaaaauugacaaauggggucuaauuaaacuaaagagcuucugcacagcaaaagaaacuaccaucagagagaacaggcaaccuacaaaaugggagaaaauuuucacaaccuacucaucugacaaagggcuaauauccagaaucuacaaugaacucaaacaaauuuacaagaaaaaaacaaacaacgccaucaaaaagugggcaaaggacaugaacagacacuucucaaaagaagacauuuaugcagccaacagacacaugaaaaaaugcucaucaucacuggccaucagagaaaugcaaaucaaauccacaaugagauaccaucucccaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacauguauguuuauuguggcauuauucacaauagcaaagacuuggaaccaacccaaauguccaacaaugauagacuggauuaagaaaauguggcacauauacaccauggaauacuaugcagccauaaaaaaugaugaguucaucuccuuuguagggacauggaugaaauuggaaaucaucauucucaguaaacuaucgcaagaacaaaaaaccaaacaccgcauauucucacucauaggugggaauugaacaaugagaucacauggacacagaaaggggaacaucacacucuggggacucuugugggguggggggaggggggagggauagcauugggagauauaccuaaugcuagaugacgaguuagugggugcagcgcaccagcauggcacauguauacauauguaacuaaccugcacaaugugcacauguacccuaaaacuuaaaguauaauaauaauaaaaaaaaaagaaaauuaaaaaaaaaaauuagccgggcaugguggcuggcaccuguagucccagcuacuugggaggcugaggcaggagaauggcgcgaaccugggagguggagcuugcagugagucgagaucgcuccacugcacuccagucugggcgacagagugagacuccgucucaaaaaauaaaauaaaauaaaauaaaauaaaacugcagaaacaguguuauacuccuuaucccaagaucccccagucuaccuacuucauuucuaaggucaugacaguauaacuggggaaauuuggaguugaauuagaugucauauccaaaaaguugaugugugcauauuuguguuuguauauauauguguguauguguuuguauauauauauguguguguauauguuuguguguauacauauauacacacacacacauaguaugcuuuuuucauauuuauauauugauauaucuauauuugagaaaucuuuuaaugugcuuucgaccuugugcugugcauauaugugugugucugcacauggauucaugugcauguguauuugugcauacaugccacaguuaaaccaaugagaaaacuguuaaaauaucauauaauggaauguaaucuucuagugagauuaugaggacaaaauauuuaguaaauauuuugggaaacagacuuuauaaaauucuaauaauuauuccaauaugauauuugagauguggaaacuauuuuaaaauaauuuguagaagcaaaagugaaauacauaaacuuguuucaguuguuuaaaaaauugugaaauaugauauuaaaauaaagcacauuucugugauacuuuuuaguaguuaauuucgcuauugacauuugguucauaaaaaaauaugguaugaagucuucagcuuguugggacucucagugagagcucauugcuaaugaaucaucauauugauuccuguuggauucauuugcugugauuuguucccugucgagagacuugagcuguaauucugguuaguaauuucuauuaaaugcaauaaaaugaaucacauaaacuaaucaucacuugacuaugcccgucaugaacaaagagaaaauauaauauuaaaauauguuuauuucccaaauugauugugacacagaaauagugagaucacagaugaguucagcucaauuugaagaaaguuuuuagaauuuacugaauuuuucuaaagcuaagagcaucaacauuuauaguagacuaucaucuaaagauacauuauaugcauagagcuuucagugaauguaaucuuuauaaugaaaacaaacucuagaacacagagcuuacuuuucgacaucauuuuuauaagaucacuaaagcauugugguuaccugcuauuacucaauguuauagguugaauuggcuuccccaaacucaaaauauauugaagccuaacucccagucccucugaaugugaccuuauuuguaaagaaguucucuguauacgugaucaaauaaaggugagaucauuagagugggcccaaauccaauacgacuguugguguacuaagaagagggaaauguggacacacacacagggagaaugccuuaugaggacaguggcagagauuggaguaauguagcugaaaguaaaaaaaaaugccaguugaugaccaucaccagaagcuaggaaguggcaaagauuucucucuuacauguuucaguggcagcauaccucugcugacuccgugauuuuucacuucucgcucuaagagcugugagacaguacauuuuuguuguuuuaagccacuccauuugugauauuguguuauggcagucguaggaaacgaauacauucaauuacagguuuuacugaauuaggaaauaaaauacaaugacaaaagaagccugaaacaugggaauuccaaaugugcaggugagaaagauacuacuacuugacuuauucaaaaauuggauuaaacuuugaguuaggcaauucaguuauguuuagucacuaugcuaucacugauuucaucacccacaacuuucuucauauagcuaccaaauaccaccucuuaauauaauuguacuagacuaugaaccuuuuguguagaaacagaaaugagauuuaaaaaacaugaggagaagcacaaaauaugaaauauuucugcaaaaacaaucugaguuauuguaauaauuucaaaccauucauguuuugaucauaauuucugaauguguuuaagaaagcagaauaaagcaaucucauagagaucuauuauccucaaugaauaaaggucgucuacgauugauaaaaagaacacaaugaaauauuaugauaaaaauauguaaacaguucaaagaaaauaacauguauggaugcuacaaauuauuuaagagagaaaacauguuuaccuaucagaauaauaaagauuuacaaauuuguuagggcacuuaaugaguauguagaaaucaggugcucucaaauaucaccgggcuaaguccacauugguacaaauccuuuggagggcaauuuggcaaaauaugaaugcauuuacccuuugaucaaacaauuuaacuuuugagauuuuauuuuuuucuuauacuugcacauaugugaagggacauguacacaguguuucacugaaucauuguuuuuaauauaaaaauauuaggaaagccuuaucuaucaaucaauaagacuuaggugagauagcauauccauguaaugaaauaauacacagccauaaaaagaauauggaacucuuuaggaauaaaagauuaauaaaagauuguuauccaaaacauauuaaacacuugaagaaaggugcaauacaaugcauauauaauuucaauuuagaaaggauagaaaauuaguauuugcauaugaaucuauaccaauuuuggaagaggaauuggguguuugggucacacaguuuggugcaaaacuaauggcuuggcaugaauuuaugcuuuuuaauauuugaacuuauggugguauuaccuauguaaaaguaaaaauuuggaugggcacaguggcccauaacuuuagucacacacuuugggaggcuaagcagggugcaucgcuugagaccagccugggcaacauguugaaacccugucucagcaaaaaauacaaaaaaauuagccaguugugguggaguguaccuguaguccaagcuccucaggaggcugagaugagagaauugcuuaagguccaggcugcagcgaggugugacugcgccacugcacagccugggugaaaaagugagauccugucucaaaauaaauaaauaaauaaauaaauaaauaaauaaaaaauuuugcgaauuuuuggagaacaauuuuauauagaacaacauaaaaucuauuguuaaguuccuuuuauucaaaaaacaagauauuuaauaaguagaaaacuuaaggcucauuuaaaauggaugauucuguuguagugaugacaaccauggaaauaauaaacaguagugaaaacaucagaaaacauuaucucuacauacauagaauauauguacuucuaauagauagugugguucuaguccuuaauuucaaaaagaugucagaaaacuaagaauccuccagagaaaauugguuaaagaguuuccuuuagaagaacaaagcaauauuuagauuuuucuaacaggaaaggaaauuacugaaaguaaauaagaaccaaaccuuguaaaaaucauaaucaguauacauaaucugaaaauggauuugccaaguaauuuucaaagcuacagaauaugugggcacuccagaacugaaauacaauuagguacuacuauaaaaaagaaacaaacucuucuucucuuuuaccuggaaggcaauacuuuucuaguacacacuacacgaaaugacaucaagcuuauaaaacaaguacuuuucuuauagguuuauauaaauaauggaaaguaaagacaaaauuaaggaccaauuuucauggcugaugauuuggaggacaaaauguauugcauugccaugcuucguugguaccacugugagaagaagcaugcuaugaagaacuaucugugacuaacccaguuucuucugggacugaaguaggagauuccccaaguacuaauucugaaaugaaugaagcaucaggggaguaaagggauauaagcuaauaaucaaaguuggacuaaaaaaaucacguauaugucuaaagcaacaggccuugggauuuugauauuucuauucaaacaaaagcacuuguaggaacuuaauuuauuaccauaguacauaaauccuccauaauuuacacugucuuugccaguagaaacacacucuuuguuguuuauguccaagauuuacauugcucugucaguuagaggaucgauucaggucagggagaaaaucuccaaacacauauuuugagccaacaggcaaaaauuagaccaccugguguuugaaugcuggaggacaaaauacuuuuugcuuuuuuagaaaauucaguagaaggugugaugcaggaaacucugucaaaguaaaugauuaguuccccaaacguguguagcuggccagagaagcaaaacaggacggauccaaaagccaaacuuugcuacaucuuuauugacucaucuugauucuuuucucaaauaguuauauaaaaauagguauuucuuuugcccuaaauaaaugcacugucauucccucugugagaacagcuaaagacaaauggguuagcugagaggagauggccaauugcagguucagcaucaguuuguuuaucuguagcuggcugaucucauuagauccugaagaguaucagauagaaaaaucuuuaagagauagucccucuucaucucauacucauggacacagaaaaacaugccuuagugcacagcuacacuaacaucaguucaguuucaauuuguuggaugguagcagguuucuaaacaguuuacaccuuccuacacugagauauuugaccucauugagugcuccgaagaaugugccagccacugaaagccuaccaaauucuaccugaaagaauccaucacuuucauacuagaucauugcuaaagcaauuacuuuuucuauuuucuucccauuucuuaucacaguggaggcacauuuagcucccuuucugaacuaugucaauucuaccgcuagaagacagucaaucauaaacuaaaauucagucacuucuuaaaauguaaagguuauuuuagcuuuccauuuuggagauaugccuaauguuaaacgaugaguuacugggugcagcacaccaacauggcacauguauacauauguaacuaaccugcacguugugcacauguacccuaaaacuugaaguauaauaaaaaaagacuaugcccuauuuuuauuuuaaauuuuaucuuuaauaauuacauagauauuuaguaauuauaaauucaacauuuagcuccauuuaaucuaucccaucucaaaauuuuagaagcuacucguuaaauacucccuccuucucucucucucucacacacacacacagacacacacacacacacacauuuucuuugucuaauuguauaacaaggaugccuccagaucuuuuuugguugucuucuuguaucauuacaugcuuauaggacugauacuguuauucaacuaagagaaaagcacaucaagcccacacaaacccacacgagcccacacacacucacacaaauauuuaguaaugaguugacuggaggaaguuucuuccugaaaaaaaaacugauauuauuccuagauuuaaaaagugaagagucacucacuuuacaaaugauauauauacaccuagaauaagugaaagaauaaaucugaaaguuaaaugcuguagauuucauucucaugugauaucucuguguucucagagauuguacuaauucauuauacuucaauuugcaaaagaaacgauucugguaugguaaacugucaaacagguaaacauguuuguauguuucauaaugaguuccauucccuaaaaaauuaagaacguuuauucuaggcaauauaacauucauauauugcauuuuggaucacauauaaaacagaguuuuucuuauccauagaacuauuuaugcacuaauucugauuuugacaaaugaguuuaaauaagucauucuuaagggcauacaaaguagaagagaaaaaaggaaagagaaagagaaaugucuguaaaucuaaaauacuaaaaguaacuauaacaauaaugcauguauuuaccccauaucuuuagauuuaaaauaggaaaauaguauaaaaauaaccuuuacaaaauuuuaguaauuauuuuucugcuuugacaggauagauuauacccacuaaagccauaaaugcuuuauucuucacuuucaaauacaaguagcaaaaaaggauguuaaaaacuucuauuccaaacaaaguuacaaaaaugccgauuaaaacuauauaacauauuauaauuuuaccuaccaaauugguaaaaauauaaauaaccauagacuauuuauguaacaagcauacuuuaaaauguaaaaugaaaccucagguaggaguauaauggcuuuauaaaaaaauuauuaggagccauaaauauauuuauacacuuuaacuuggcaauuucccucuuagaaaacaaauuuuuuuaaauucccauuaauugagggacaagcuaaauuugugccaccuucauaugacacaauaaaaauaauuuuucagaagcauauuugauggcauaaaaaugcugauaguauaauguaaaaugauauuuuacaaaagguaauuaacaaacaacauaggauucauuuuauuaucacacuggacauaauaaaaauacugauuaucagauauuaaaagcuugugauauauaugaugcagaugccauccauucuaaugcacccuuuuauuguuucuaauacuuuaaaaaguguucuguauucacuacaucauuacaaacacacacauauacacgcacacacacaacccauauacaccucugaagacuauuugaaggcuauauauggucaagaaacaguuuucauuaauucaaacuuucaggaaguagacauuugucaaugcuaucuaacauuucuuaaaaguuaaagcauaagauauagucaguuuuugaaaaaaaaauauaaaucugaaacuuugcaaguuuauucuuuacuaauaaaaaucccuuuauaauuuaucuuuauucuuccauaaguagcacauaugucacuacuauacaaaauggaaaauugacaaaucugauuguauuucagccaaugauacauacuuugugauugcuuagggaagaacugcauuauuuuguuaaacauagcacauuuaauaaauauuucuuucauauuagcacauaauaacucauaaauauugggcauacagguagacaauacacacgcaugcugacaaagaggaugagauucauaaucauuucauuguuuuucucuuuagaaucuauaguauuugcaaaaauuagaguuagaacuuaugugugcuuugaucaguuuacccaagacugugagauauugguaaagccaacagacauauaaauaaacccaguuuucuguuauauccuccucaaacaucuuucuuuuauguugacuaccuacaaaauuauuagcaugucauaauuauacaagguagugcuuucagaaacuauugacuuguuuggacuuucuauaaaucuuuccaucuuucagaguaaggacaugugaguuacccuuuuaccaauggaauagugguucuccaggcaaugguucuaauacuacagcucucagaucagcaguaucagaauuaccuaggaacuuaauaggaauggaaauucuuggcuuucaugcaggccuauugaaucagaaauuacaagauuggaccuaaaaaccagugcuuuaccaaguucuucaggugacuuugaacgaugcugcauuuggagaaccauaacuguaagguacagaaaguugugagacuuucuguccaucugauguaaggccuuucugcagaaaacaguuuaugucuuagaggugaagaagcauucauugcuggauauaaucagcuaaagccaauauugcugaguaauaugcaguagaguuugcauaguaguacaaacaaagccuuggaauuuuuaauggaacagguuuaaaacaaacaacuuaaauaaaaguuauuaauauaauuuugggggggaagaaaagguauuuaggaaauaugugaauaagcuacuucagaagaaagugaaauucugaagaaauacucuggaaaagacaggaaaaaagauuuagaugaaaaaucugcauaaacauauuucugaaauaggcuaugagauaggcaagagaagaguggguaaagaaaaaguaggcuaaggaauagaauagucaaauaagcacaaaauauauaaacaaaguagucaaauaacuuuugggaauagguauauauuguaagaaaaaauaaauuguuugccagaccucccauuuugaaggcuuugauggaauccauucgcauauccaaaugccauuuuuugugucaaugaaucauuuuaaggaaacagcgguugaagaauauggacuagaaaauauaauuuuuuaaauuuucuccucauaugagaccuaaacggugagauuaaaggcaguuuuaagagcuauaagcuauuaaaauuaaaagaacaauugguagucauuagcagacuagagauuccaacauauuucuggaaggcauguaaaaaggcaugcgcuaauaaaacacagugcaaguaguugcagccagaaauauuuaugaagaggacugaaguuaagggggcauagaucuuuccuaaaauacacuuagaggguugggaggcagaccugaaaaaucaaaaauuacagacaguaaaaaggcugaaaauaagaugaucaaaugaaaauauucucaucaacugcacucuuccaucauccucaauaaaaucacuaacauccaauuuaaacuucccacuuucaaaacaaaacaaaaguuauuuuucaaguaaucauuugggaaaaacugaagcagcuaccaugaaccuuagugcuguugauuaaaacucccuccccagugaccaucacugguacuucguucacuggaauagagaaaacgaaggauaacaauuaucacaauuguaagaaucaaacauaauuuccuagagaugaagacuuacaguauuaauugucuugguaucucaaugaauaguauguuguaaaaaaccuagccacauuuuucuagacuuucuagagcagcaaaaacauugaguugauccuaaguuucucccauugggaaaaaaaaacagcuuauuuacaaagacacauugaaaugguugguauuauucucauaaguaauguuggauuccauaaaauaauagaacaaugacuuuaaaacucugagagaaaauuacuuucaaccaaucaaauuuauucuacaguaaacuaucaaucaagagaguagaauaaagugagguucacauauucaaagauucaagauuaaaucuuacaugcaugauuacauaagaaauaggauguauagaagcaauaaaauagcauuacacaauaagucacugaaugagggacuuacaggaacaguuaaaaucuaauuucaaacuuaguuaucagaaauauuuucaaguaguuaccaccacugaauguaacugaagaaucaauauacacaaaagcaauuauucacagguuucauauaauccaugaaaacaguggcaaauaugacauauuuggaagacaaauuguugcuuauaucccaugcauaacuguucuauaaucagaacauuagaagcuauacauuuaaaauauauaagguuugcccuuuggacaguaaacuccaaaggguaagacuuacauauucaaaauauugauaaguccaacauacuauaggaaaaaaaaguguuuuacaaauaaaauaacuguuaguacacgaguuuauguagauuuaaaaaaucaaauagauucuaauauguuagaaauauugaagauggccaaauaggaacagcuccagucuacagcucccagugagcaaugcacaagagaggugauuucuacuuuuccaacugagauaccagguucaucucccuggggagugucagacagugggugcagcgcacugagcaugagcugaagcaaggcgaggcaucgccucaaccgggaaguguaaggggucagggaauucccuuuccuagucaaagaaaggggugacagacggcaccuggaaaaucgggucacucccacccuaauacugugcuuuuccaacugucuuagcaaacaggacaccaggagauuauauccagcaccuggcucagaggguccuaugcccacggagccucacucauugcuagcacagcagucugagaucaaacugcaagguggcagcaaggcugggggaggggcacccacaauugcccaggcuugaguagguaaacaaagcggccaaaauuggguggagcccaccacagcucaaggaggccugccugccucuguagacuccacaucugggggcagggcauagccauacaaaaggcagcagaaaacucugcagacuuaaauguaccugucugacagcuuugaagagaguagugguucccagcaugcaguuggagaucugagaauggacagauugccuccucaagugggucccugaccccugaguagccuaacugggaggcaccccccaguaggggcagacugauaccucacauggccugguaccccucugagacaaaacuuccagaggaacaaucaggcagcaacauuugcuguucaccaguagccgcuguucugcucugcagccuccgcugcugauacucaggcaaacagggccuggaguggaccuccagcaaacuccaacagaccugcagcugaggguccugacuguuagaaggaacacuaacaaacaaaaaugacauccacaccaaaaccccaucuguacgucaccaucaucaaagaccaaaaguagacaaaaccacaaagauggggaaaaaacagagcagaaaaacuggaaacucugaaagucagagcaccucuccuccuccaaaggaaugcagcuccucaccagcaauggaacaaagcuggauggagaaugacuuugacgaguugagagaagaaggcuucagacgaucaaacuacuccgagcuaaaggaggaaguucgaacccauggcaaagaaguuaaaaaccuugaaaaaaaauuagaugaauggcuaaauaaaauaaccaaugcagagaagucuuuaaacgaccugauggagcugaaaaccauggcaugagaacuaugugaugaaugcacaagccucaguagccgacgcgaucaacuggaagaaaggguaucagugauggaagaugaaaugaaugaaaugaaugaaaugaagugagaagagaaguucagagaaaaaagaauaaaaagaaaagaacaaagcccccaagaaauaugggccuaugugaaaagaccaaaucuaugucugauugguguaccugaaagugacagggagaauggaacccagcuggaaaacacccugcaggauauuauccaggagaacuuccucaaucuagcaaggcaggccaacauucaaauucaggaaguacagagaacaccacaaagauacuccucgagaagagcaacuccaagacacauaauugucagauucaccaaagcugaaaugaaggaaauaaaguuaagggcagccagagagaaaggucggguuacccacaacgggaagcccaucagaauaacagcagaucucucggcagaaacucuacaagccagaagagagugggggccaauauucaacauucuuaaagaaaagaauuuucaacccagaauuucauauccagccaaacuaagcuucauaagcgaaggagaaauaaaauccuuuacagacaagcaaaugcugagagauuuugucaacaccaggccugcccuaaaagagcuccugaaggaagcacuaaacguggaaaggaacaaccgguaccagccacugcaaaaacauacacaauuguaaagaccgucaaggcuaggaagcaacugcaucaacuaaugagcaaaauaaccagcuaacaucauaaugacaggaucaaauucacacauaacaauaggaaccuuaaauguaaaugggauaaaugcuccaauuaaaagacacagucuggcaaauuggauaaagagucaagacccaucagugugcuguauucaggaaacccaccucacaugcagagacacacacaggcucaaaauaaagggauggaggaagaucugccaagcaaauggaaaacaaaaaaaggcaggaguugcaauccuagucucugauaaaacagacuuuaaaccaacaaauaucagaagagacaaagaaggccauuacauaaugguaaagggaucaauucaacaagaagagcuaacuauccuaaauauauaugcacccaauacaggagcacccagauucauaaagcaaguccuuagugaccuacaaagagacuuagacuccaacacaauaauaaugggagacuuuaacaccccacugucaacauuagacagaucaacaagacagaaaguuaacaaggauauccaggaauugaacucagcucugcaccaaguagaccuaauauacaucuacagaacgcuccaccccaaauuaacagaauagacauucuucucaggaccacaccacaccuauuccaaaauugaccacauacuuggaaguaaagcauuccucagcaaauguaaaagaacagaaauuauaacaaacugucucucagaccacagugcaaucaaacuagaacucaggaugaagaaagucacucaaaaccacucaacuacauggaaauugagcaaccugcuccugaaugacuacuggguacacaaaaaaaugaacgcagaaauaaagauguucuuugaaaccaaugagaacaaagacacaacauacgagaaucucugggacacauucaaagcaguguguagagggaaauuugcagcacucaaugcccacaagagaaagcaggaaagaucuaaaauugacaccccaacaucacaauuaaaagaacuggagaagcaagagcaaacacauucaaaagcuagcagaagacaagaaauaauuaagaucagagcagaacugaaggaaauagagacacaaauaacccuucaaaaaaucaaugaauccaggagcugguuuuuugaaaagaucaacaaaauugauagaacacuagcaagacuaauaaagaagagaagacagaagaaucaaauagacacaauaaaaaaugauaaaggggauaucaccaccaaucccaaagaaauacagacuaccaucagagaauacuauaaacaccucuaugcaaauaaacuagaaaaucuacaagaaauggauaaauuccuugacacauacacccucccaagacuaaaccaggaagaaguugaaucucugaauagaccaguuacaggaucugaaauugaggcaauaauuaauagcuuaccaaccaaaaaaaguccaggaccagagggauucacagccgaauucuaccagagguacaaggaggagcugguaccauuccuucugaaacuauuccaaucauuagaaaaagauggaauccucccuaacucauuuuaugaggccagcaucauccugauaccaaagucuggcacagacacaacaauaaaagagaauuuuaaaccaauaucccucaugaacaucaaugcaaaaauccucaauaaaauacuggcaaaccgaauccagcagcacaucaaaaaucuuauccaccaugaucaagagggcuucauccgugggaugcaaggcugguucaacauaugcaaaucaauaaauguaauccagcauauaaacagaaccaaagacaaaaaccacaugauuaucucaauagaugcacaaaaggccuuugacaaaauucaacaacccuucaugcuaaaaacucucaauaaauuagguauugaugggauguaucucaaaauaauaagagcuaucuaugacaaacccacagccaauaucauacugaaugggcaaaaccuggaagcauucccuuugaaaacuggcacaagacagggaugcccucucucaccacuccuauucaaaauaguguuggaaguucuggccagggcaauuaggcaggggaaggaaauaaagggcauucaauuaggaaaugaggaagucagauugucccuguuugcagaugacaggauuguauaucuagaaaaccccaucgucucagcccaaaaucuccuuaagcugauaagcaacuucagcaaagucucaggauacaaacucaauguacaaaaaaucacaagcauucuuacacaccaauaacagacaaacagagagccaaauuaugagugaacucccauucacaauugcuucaaagagaauaaaauaccuaggaauccaauuuacaagggaugugaaggaccucuucaagaaaaacuacaaaucacugcucaaugaaauaaaagaggauacaaacaaauggaagaacauuccaugcucauggguaggaagaaucaauauugugaaaauggccaaacugcucaagguaauuuauaguuucaaugccauccccauuaagcuaccaaugacuuucuucacagaauuggaaaaaacuacuuuaaauuucauauggaaccaaaaaagagccugcaucgccaagucaauucuaagccaaaagaacaaagcuagaggcaucacgcuaccugacuucaaacuauacuacaaggcuacaguaaccaaaacagcaugguacugguaccaaaacagagauauacaccaauggaacagaagagagcccucagaaauaaugcugcauaucuacaacuaucugaucuuugacaaaccugacaaaaacaagaaaugaggaaaggauucccuauuuaauuaauggugcugggaaaacuggcuagccauauguagaaagcugaaacuggaucccuuccuuacaccuuauaccaaaauuaauucaugauggauuaaagacuuaaauguuagaccuaaaaccauaaaaacccuagacaaaaaccuaggcaauaccauucaggacauaggcaugggcaaggacuucaugucuaaaacaccaaaagcaauggcaacaaaagccaaaauugacaaaugggaucucauuaaacuaaagagcuucugcacagcaacagaaacuacuaucagagugaacagggaaccuacagaaugggagaaaauuuuugcaaucuacucaucugacaaagggcuaauauccagaaucuacaaugaacucaaacaaauuuacaagaaaaaaacaaacaaccccaucaaaaagugggugaaggacauaaacagacaauucucaaaggaagacauuuaugcagccaacagacacaugaaaaaauguucaucaucgcuggccaucagagaaaugcaaaucaaaaccacaaugagauaucaucucccaccaguuagaauggcaaucauuaaaaugucaggaaacaacaggugcuggagaggauguggagaaauaggaacacuuuuacacuguuggugggacuguaaacuaguucaaccauuguggaagucaguguagcaguuccucauggaucuagaacuagaaauaccauuugacccagccaucccauuacuggguauauccccaaaagauuauaaaucaugcugcuauaaagacacccacacauguauguuuauugcggcacuauucacaauagcaaagacuuggaacccacccaaauguccaacaaugauagacuggauuaagacaauguggcacauauacaccauggaauacuaugcagccauaaaaaaugaugaguucauguccuuuguagggacaugguugaagcuggaaaccaucauucuuagcaaacuaucgcaaggacaaaaaaccaaacacugcauggucucacucauaggugggaauugaauaaugagaacacauggacacaggaaggggaacaucacacucuggggacuguuguggggugggggcuggggggagggauagcauuaagagauauaccuaaggcuaaaugaggaguuaauggauucagcacgccaacaugguacauguauacauauguaacaaaccugcacauugugcacauguacccuaaaacuuaaaguauaauaaaaaaaaagaaauauugacauuaauccucccacuaaucuuaauauuacauagcuaggguuguuacuauacuguacuuuaaccaucucaauuuaaagagauuuagaaauagaaguaguaggccauacuuggaaaauaguuauuucucuuaugaaaaauaauuaucagggaauuucaauugacugcauggaaaagaaagaugguuuauaauaguuuuuuugaaauucuugugaaacaaaaccagaaagaugggccauaaagaagauuuaugcuauugauaagaaaagaaucccaacuaaaaauaagaacugauaauuuaucacaaauuacuaacagaccaaauccagcagcauauuaaaaggauccuauaucaugauuuugugugauuuauuucagcaauaccagggugguucaacauacaaaacucaaucaauguacuauaccauauugauaaaacaaagagaaauaaacagaaauucuucucaguucaugcauaaagagcauuuaaaaaaaucuaacauuauuucaucuuaaaaacaaugggaagucugaaaauuaaaagaagcuuccucaacauaauaaagggcauuuguggaaaacccacagcuaccaucauauuuaaaggugaaagauugaaaccuaucuacuuagauaaggaagaagacaagcauuuccacauuugcccuugugcuuuaacauugguacugaaaguucuagucagaguaaucagccaaaauaaacuacacuggaagaauuaauacuauuaagaugaaaauacuaccaaaagcaaucuacaggcucaaugcaauccguauagaaaucccaaugauuuuuuucuuuuuuugcuaaaauguaaauguuaaagaaagcugauccuaaaauccaguggaaggcaaggagccccaaagcuaaaacaauuaugaaaaauaauauaacaggguaauuugcccuucaaaucuuauugcaaagcaccaguaauccagauaauuugauacugacauaaauauaaauauauggaucauuggcauaaggauaaacauacugaucaauuggaaguucagaaguaaacccaggggccuauggucaacugguuguugacaugggugccaagaccauuuuuugaaggcaagagcagucucuucaacaaauguugcuggaacaacuggaaauccacacacagaagaaugaaguuggacuccuaccucacaucauauaaauaauuaacuuauaauggaucaaagacuuaaauauaagugcuaaaacuauaaaauucuuagaagaaagaaugcggaaaaucucuaugaccuuggauuugguaauaauaucucagaucugacaccgaaaguaugagcaaugaaagaaaaauaaauuggacucuagcaaaguuaaaauauuuuguguaucuaaggacacuaucaagacagcgagagaaagggaaagagaaagacaagccacauaaugggagauauuugcaaaucuuauaucugauaaccgccuaguaugcagaaaguauaaagaacuuucacaagucaacaacagagaaaaacaguuauuuuaaaaaguggaccaaggacuugaagagacauuucuccaaaaaagaaauacaaauuauuuacaagcacaugaaaagaugcucaacauaauuagucauuagggaaaugcaaauuaaaagaacauaucacuucauaccaacuaugggggcuauaauaaaaaacaaaauucaaacaaacaaaacauacauauauuuggcuaaguuucuuugaggacugaggauucucagaaguaaguaauuaaaaauauuauauccucacaauuuuauguauuaucauggccagaggcagaaaaauugaugaggcaaacuuccaaaaaucucuuaauugaaguuacagcaauacuaugaaauuaagacagaauugugaccuugauugaacagaccuuauaaaugacaacaggccuacaaauuugauguugaaguuuucugguaaaaggaaguaauuaucucaaagcaacuggaaaccacaaucuacuaauauuacaugauuaaauacuagauaauaauuucaugaaaaaauuuucacaaugggaaauguguugaucuuuuucaggaauauuuuuauuaaaucauguugaaaaccacagaaaauuauuuaaauaaaacagaccccuuaacucuauuaucaugaauuaggcaguauaauuaauggcgugauuuauauuuacaaacgaaucucagauaaugccuuaguguaauuuuuuucuauuuuuaaacuaugcaaacauuuaaucaauuugaaaggaaacaaagccuauuuagcuauuaauuaauugaacuauuagucaacagaucaaauuggugucaaaaguguuucauaaugauucguuugugaagaucacaauauaaauguaacaauugaaagaaaauuaaagagauaacaaaauauacuuuauaauuuuaaaagugcauuucuuuuguuuaacauuucaauauaaacauuuucuucaaguagacagcauuuaaauuucuuuuuuuuauuuuauuauuauuauacuuuaaguuuuaggguacaugugcacaaugugcagguuaguuacauauguauacacgugccaugcuggugugcugcacccauuaacuccucauuuagcauuagguauaucucuuaaugcuaucccuccccccagcccccaccccacaacaguccccagagugugauguuccccuuccuguguccauguguucucauuauucaauucccaccuaugagugagaacaugcaguguuugguuuuuuguccuugcgauaguuuacucagaaugauaauuuccaauuucauccaugucccuacaaaggacaugaacucaucauuuuuuauggcugcauaguauuccaugguguauaugugccacauuuucuuaauccagucuaucauuguuggacauuuggguggguuccaagucuuugcuguugugaauagugccgcaauaaacauacguguguguguguuuuuauagcagcaugauuuauaguccuuuggguauauacccaguaaugggauggcugggucaaaugguauuucuaguucuagaucccugaggaagcgccacacugacuuccacaaugguugaacuaguuuacagucccaccaacaguguaaaaguguuccuauuucuccacauccucuccagcaccuguuguuuccugacauuuuaaugauugccauucuaacuggugugagaugguaucucauugugguuuugauuugcauuucucugauggccagugauagugagccuuuuuucauguguuuuuuggcugcauaaaugucuucuuuugagaagugucuguucauguccuuugcccacuuuuugaugggguuguuuuuuucuuguaaauuuguuugaguucauuguagauucuggauauuagcccuuugucagaugaguagguugugaaaauuuucucccauuuuguagguugccuguucacucugaugcuaguuucuucugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucgaacguuuaagucuuuaauccaucuugaauuaauuuugguauaagguguaaggaagggauccaguuucagcuuucuacauauggcuagucaguuuucccagcaccauuuauuaaauagggaauccuuuccccacugcuuguuuuucucagguuugucaaagaucagauaguuguagacaugcaguguuauuucugagggcucuguucuguucuguugaucuauaucucuguuuugguaccaguaccaugcuguuuugguuacuguagccuuguaguauaguuugaagucagguagcaugaugccuccagcuuuguucuuuuggcuuaggauugacuuggcgaugcaggcucuuuuuugguuccauaugaacuuuaaaguaguuuuuuccaauucugugaagaaagucauugguagcuugauggggauggcauugaaucuauaaauuaccuugggauuguauaucuagaaaaccccauugucucagcccaaaaucuccuuaagcugauaagcagcuucagcaaagucucaggauacaaaaucaauguacaaaaaccacaagcauucuuauacaccaauaacagacagagagccaaaccaugagugaacucccauucccaauugcuucaaagagaauaaaauaccuaggaauccaacuuacaagggacgugaaggaucucuucaaggagaacuagaaaccacugcucaaugaaauaaaagaggauacaaagaaauggaagaacauuccacgcucauggguaggaagaaucaauauuaugaaaauggcauuuaaauuucuaaaguaggaaaaaagcauuucaggccucaauaauuuuuaucaaauacaaaauuacaaucuacucauucuuuagagauauuaaaauaaaaauuuacaaacuugcuguguauacuugcaaucuuuuauagaguguuuaaguauuauauuugcaggaaguuucauagagaguaaaaaacacugcuucuaauguaaauaauuaccuucuacuuucagauauuccucccuuuuacaaacaaagugaaucuaagaagauauacaacauuccauuuccgagaaaauagggggcuuuugaagcauaaucaaagauaaaauaauuagaaaacagcaaggaaaagaaagaaaaauuuuucauuuuauuuauuuuggugggaggguugccauaguauucaguggaccaaauuauucucaauuuuacucagaaguucaguagaauuuuaaagagaccgaguggagggaaaaguuauggaacuacuaugaaacuuugugauaaacagaaaauauguuuggaaaauugcagucauucagccucaaauuuauguuccagucuccuggcauggcuuaucauuucuuaggcauccacaucacuuauucuugaccacaagacugaaucuuugaagucuuaaaucuuauuagccccuuggaaauagacacaguguagccuucaguauucaaauacauuucucucuguuuuguuugugaagcauagaauuuaaaauuuuuucaguagaacugauuuaaccaauaagaaauauggauuggaacauauuacuuuuuguaauauaaauuagugaucaagguacauuagauaacaaacuucuccuaauaucuuacaccacuuaaaauaauguaagucagauuugcaacugauacauacaaauaauacuuuuaagaauauauuuccacaguaauccgauuaagagguaaaauuuaagggaaacauuacauauauauauguguauauauauauaauguauaaaauuguacauauuguccacauuuucuauaauucuuaucaguuguauuugaauuauaauguauauaaaauaaaauggagagguuuuuaaguauaguauuugauagguuuugcuaauuguauuauaagccuauguaaccacuacucaaaucaagauacugacuuuucccauuauuucccaaauuucccauacacuccuuuucaaucauucccacuucuacccaaaagcaacaacagucuaauuucaauuaucacaauaguuugccuacuuuacaaauuccguauaaaucagaucacauacauacagaauauaccauauauaugauauauacuuuuuauaucugacuuuuuuagcucaauaaagacuuuuuuagauucauccacauuuugccugcauucguuuuuguugcuuugccuuucaguguaguauuucauuguaugaauauaagauaauguauuuauccauucuauuuugggccacuugagcuguugcagguacuggcuaauaugaauuaaaugugcuauaugaauaguuuuguguaaguauuuugguggacauaugauuucauuucucuugggcaaauaucugggaaugggguugcuugauuuuaggauugacagauauuaaauacacuucucuaaaauuguuguacuauuucacauacauuuuuccuaccacaaaacgugguguaugggagcuauaguuuacaauuguuucacauccuugccaaauuuugguauuguuaaugugugugcaugugugcauguaugugugugugucuaaaagccauuguaguugugcaaaaccuuaucuugugguuuuaauuugcauuugucuaaugauauuagcauugagcauauuuuucauacucacauuaaggugacgacccaagucuuuugaccauuuuuuaauguguuguuuuuuucauauuuacucauaaaaguuguuuaaauauuuuggauaaaaauucuuugacaguuauuaaauaucgauuacuuuucccgacucuuuuucuuaucuauucauaugcuuaauugcaauuuuauugagaagaaaugucaucaauuuuuucaugcuugaugcuucuuauuuuuugccaaugaaaucguugccuacuuccaaauugagaagauuuacaguuccaguuuuuagguuagguuggugauuuaucccaaauuaauuuuaugugugaaauaaaaugaaagcauaugguuuacauauuuuaugcaaauaucuaguaauuugagaauuuucuauuaaaaaggccuucuuuuuuccauugaguugccugaguguuuuugucaaaaaacaauugacugcacguguguggauaaauaucucuacucauuauguuuugcugaaauauucuuacggcaauaacacaugacuuuauuacuagaagcaguagcauuauaaaaaauaaucaaaucauauuaaguauucaaacuuuuuuuuuuuuauccagguuauuuugguuacucuagaucuauuccgaaugcuguguguguguguguguguguaucuucuaucuuguagccuuggguaguuguuuuguaauuucuuagugauuuuaaaaacacacuuacguaaucugcaaaugauuaucauucuacuucauguaucccaauauuuauguaucauauuuauuuuuuuucugcuaaauuacacuaccauaagaauucuaaugcaauguugaguacaggaguaggaagagaucuugccuguucccaacugcugggaauaaguauucagugauucaucuguaacaauaaauuagcuagcuguaagguuuucauaaaugcccuucagaaaaguguggaaguucucuuccagucuuaccuuuuuaaaacauaaaugagugucaugucaggcuuuuuuuuaaugccuauuaaguuauuucuccuuuauucuauuaauauggugaauuagugaguugauuuucaaauguuaaaccaacuuuucaauccuauagcaaacucugcuccauuaugauuuauuauuauguauuucugaauacaacuuuggaauuuuuuuaaggauuuuaacuauguuuguagugguaaaaaaccugcaauuucuucuuuguuaugucuuuaucagguuuauguaucagagauaugcugccucaugaaacacauuggaaaguguuuccuuccuuaauuucugaguguguaauguugcuuuuacuuuuucguuuuuuccccaaaugcuugauagaauuaaccugccaaucuuuccgugccuggaguuuucuuuguggaauguuuuuguuuaaauuuacauuccuuaauagaauauagauauucaauuauuuuauuuuuucuuguuaguuuugcuaaguuaaauuuuauuucaaaugaaaguuaacaauuaugcauguguauguguguguccauuuucauucuaauccaaaacaucugcaagacaggacuuuucuuucaacacauauauuuauuuuaauuugcuaauuucagacaagacucaagauuuuauaagucuuuugaugcuucacauguuguaaauuuauucacauugagaauuggcaaaaaaaaaaaaaaaaaaaaaugccgaaaguguaacaagauaaagaaucuuuccaauugccuaaaucuucuuauauccugucuucauagugcaguuugcuuauuaaauuugaaauaucaccaauuaaaagguaguauagcaaguauauucaaauuuaagccuucuuuaauauuuuuuauggcaaggcaaaaauauaaauuaaaauaaauugaacaagcaaauguuuugacuuuuauuaaauguuuuauauuuaauaauaaaccuuaguugaagaugaaaacguugaauuaggaagcagaugccuaaucacacagauauugcuaaauaauguuccaugcuagaaaaaucucuaagcuaugauaaaaagcauaauaugaugaaacauaauucaccuuuggauucagacagauccgggugugaauccuaccuuuguccuuccugucuaugugaucuugaguaagucauuuacuuugugugacuuccgguauccucauuuacgaaaaaguuaugaaaauuaaaugcuacuguucuucaauacauauuuucuucuucuguggugggcaaggccaagauggagggagggagaaggaguuucccauauuuucaccagaaauauugaauuaggccagaacucaaaaaguguuuuacauaccuaagauauuaugauuuuguacaacccaaguaaaaaagaauguauguuuaauauauuuauuaagcaaacaguauguaucaagcacuuuuacauauuaaccuuuuuuaaaaacuaaaaucuacaaauuagacauuaauaauaucauuuuacacauggaaaaaguaagguuaagagacugaaauaauuucaugcagaauauggcaaaggagagauuuuaauauccaaguucagaucuucaguaaauaagaaaaccaucucaguuuuaaauugugcauuugauuuguacuaucaaugcccucaaaaucuuuaagaagacuuuaucaaauaaaugaauguuagcaugacuuuuacaugcucauuuaguucacaaguuacaauauuaucagacagccaacucuuaugucagucuguuauuuugaucaacucuguggugcgaaaaaugcauccauacuuacuauacaaaaacuaaaguuaaaacauuauaaccuaacaacuagaaaaauuacuuacacuuguuauaaguuagguuuuuuaauguaucuuuuaaagaagaaauaauuuuuuuaaucaaaauauagguguuauauaaaaugagaaaaaaagaaacaaaauuaugaauguauuaaaaaaucaaggaaaucuguauccacauauguuuaccuucauucaaaucagucuuuuuuagauaaagagcuaugaagagacaguuuuauucaugcaacaauaauauuaacaggugcuucauuuaacaauaaaaaaaaagauguucuuuuaaagcugaugcugauguggcuccuuuaaagauugaggauuuacagaguuugccuuuuuaaaguauuucuaauaggcaaaaagaaaaugaaauaaacauaaaaagaagauauacugaucacauuaauuuaauauucuaaauuaauccuaagcaaaaugaauauguugaauucaaugccuacuuagaacaguuuaauuugggcuucauuugggggugggguggaagguggacuucuuuagcucauugcuuuuacuagauggggaaaucaaaaacugcuauauguugccaaagaugguucucaaaaaauaacuacuuugaauauuuugcucugugaaugacuauacaaaccucaacugaauucuguaaaccacaaaaucacuagaaauuuugccacuugaaaugggaaacaucucuuaccuauguuuuguucaguguuugcacuuuaaugugaaaguggauaaaugaucagaccuuuaguucagugguuaauuaccuauguacuaaagcgaaauaucacuuuccaauuuuuggccacaaauaucauuucuuuaaauaaaucacaagaaugcaucucaaguaaauguuaggagaaauuauguaaguucaauaaaggcaagaaaauuuauggauauauuaugcugcagaacuacauuggcacagcauauucacuguauacuuuauagucauuuuuuauuacuuuguauuuaauucuccguguaugagaaccuaaauaugcaugggaaacucuauuaguguauuuuguauuucuaugagauuauugcugaguugacuacauucucuacauaucuacuucuaaauaucaugaaaugacuuaaaucuuucuaaauaaaaauuauaugaaaauuauauuacuggaugcacacaauuccagcccucuacuuuuuacucuguaaauaaguuuccauuuucaguuccuguugcugaagcaauuggucuaaacagcuguaguuagugggaauuuauaaggauaauaaaauagacuggugguuuuucuauugcaccuguaucugguucuguugagagacaauucucuguugguuucucaaguuuccuuagucuuggaaacaaagcacugguagcccuuuuggucuggauuaaguuuucaaagaugcuuauacagguugagcaaccugaauccaaaaacccaaaucugaaaugcuguaaaauuugaaacauuuugagcaccaacauggcauccaaagaauauuagcacugaagcauuuuggauuuuggauuuucagauuugagauccucaacugguaaguauaaugcaaacauucuaacauccaaaaaaaugcaaaaaucugaaaucguucagauuuuucaauuaauccucaucauugagaaguguuguauaaauauuacuucacaaaaaggcuuguaaauaucuccauaagaaucugcaacauuaaaaccuuauuuuccguguucaaaauuaaaugcacacucucagacaacucuugauggcucugucuuuuggauaaaggaucucaaaucuguauagcaaaaaacacugaagauauagauagugauucucacuagagcaaaggucaggcaugguuacuguccaguaaacuaaguccagacaugcuuacuacccauuauaaaugauuuuuuguaccuaggaucagguuucucuuuuuuuguuauugcaacccaacuguguacagguagcaucuagcucucuuugugcuacccugugggaauuggaacuugggcacaaacacaagaaaaugcugacacacuggcuaugauuccugugaaaaauaaaauauuuucucuuugucccaagaaguucugccagcauccauagaacuggcaggcuaaccuguaagcuauuauagcaaguaagauaaaacaucagauucacaguucuuuacaggaucccucaacaacuaagauagggguauuacucuuuggauuucucuuaugaaauaaaacuucucuuuaacuguagaaaauaauugcuuuagugcugggaacauguugauacuggaauaugagcuauaaucaacuuggacuauauugguuuaucuccaaguucauaauacuagaaagauguuuuaaagauguugucucauuuuauuauuuuaaauacucuuaucaaucagguaaguaucagauuuggggguuuuaaaggagagcugguugggauauaaucuuccauguuuuaaaugugucuccuaaaguucauguguugaacuuaguccccagugcaacaguugagaguggaacuuuuaagaagugauuagguuaugaggacucugcccuuaugaauggauuaaugccauuaucaugggaaugaguuaguuauugcuccuuaacucauguuaugccuucugccaugauaugaugcugcaagaacacccucaccagguguggucucucaaucucggacuucccagcuuccagaacuguucucuauaaauuacccagucucagauguucucuuuuagcagcacaaaacagaauaagacacaguuacaaugccaaaacaaugaaauucauuguguaaauaacgcuauuuuaccaaaaggcuugcaaauaaauaaucauuuauuuacuaacucauucaauagacucuuuuucagcaguuauacuugaaaggaugucuuugguaauaugauguauauagcauauuuauaugccuuguuuagaaaucauuaaaaaucaaagaauaugugaaauuuauuauagcaacagauaauuucuauggugaacuaccaccacuuucuauuguauguaaugggucacucuucauuguacauacugauucacacaacaaauugucaccacuacaaaauaguagcuuucauagauauaaaacaugugacuuaacaucuuagcugauugcagaaugucuacauaaccguaaauuaaccaucuucaaaauauucauuaacaagaagaaaagaaauuccugcauuuuccuuguaguuauuuuguuuagugggaccaucagucgcuucuuauuuacuuggaccaaaauaccugaggggcaaaauuaaucuccaccauuagaaguguuuuauaaauguuacuucauaaaggcuuuuaauaacaaucagaacuauuaaaaccuuauuuuccuuguucaagauaaaacauacagucucagacaacuguugauguugcaacuuuaauucuguaguaaacagaauuggaaugugcagacuacuuacauuaguaaguagugacuacaaaaacacacaaaugaugggaacuuuuuaauuacauuauauauuacaucuaaaacuaacucuugucccuuugaaccugugcuagugaaauuaaugaaauaaaagcaaugucauaauucuaaauaaaaaggcuuaaugauguccauggagugguguagaagcaaaucaguuaaaacagaaagcagaagcuuuuaaaacuauguuacuaucaaauauaacuuuggguaccuuucaagugaaugccuggguaggaauuucaaguuaauacauguugcuucccuaauuccacaccuagaagccagccacagaaaauuucuacauuuauuuugaaagaguuuaccaauauaaauguuauuuuaaaaaucauuugaucuaguuugggugacacaaccaacauguaaauaucauaaagaagaucauauauuguuacacacccaguuuuugccuuguauuuguuuguggauaaaggaaauauacucuucuuaaaauaguaguugcuuugaaaauguagucagcuuucauuacuucagggcuuuucuuuuucaauuuauuuuuccauguaguaauuuaauauguugguacaugccuccagagaucucuuauaauguuucuugacaugagugacaccucuaaucucugaaaugauucucuucacucuuuaaccuugacacagaaaucucagcauuacaacuuacuuuuuuaaagucccauggugggggugaaaggagagacagagaaggaauacccagauuacacaauaaaaugaauuuuauccaaaguaacuuuuuaauuuugaggucguugcuuuaugugugaaugacuucugcugauaauguuacaggaagguguggaaaacuaaccuaguugagcaaagacaccacguguuauuuuauucuggacccuugcuuagauuaauucauauguuaaaauguggcaagacucuuaaagagggcugcuuaccuuuggggaaaggcuguuuuaagugauggaucucagguaaagaagauaggaacuaagaaaagcaggucagaaacagaagaguuuguaauauuaucucacauuaacagcuuccacauuaauaugaugaagcuacaacaaaggaucuuauugcugagcugugauaaaucaggcaaaaaugugcaauaauuaaucauuugaaguauuuuaaucaguguuaaaugaaaggcuaacaaggaagguaaaugaaugaaaggcugaauaucagacucuuaaagaugcaugguuuagagacauggcauauguugucaugcuguguuuuuguucuccaggcuaugaugcagugaauguaacuagaaaaauauaaccucaugcaacagcauggcauggaccgaucuaucuacaagauuuagugcucuaugguuuguccaugcagcaguguuuuggaagauaauuuuuaaaacuaucuaaaaaguuaggcuguuucuucuuaacaaacaaaacuuaauuucagaaauggugacgauuucuuacacauccauggaaaaaucagcagacccucacuuuagaggaccgaauaauuucuuuuuuuuuuuuaauuauacuuuaaguuuuaggguacaugugcacaaugugcagguuaguuacauauguauacaugugccaugcuggugugcugaacccauuaacucgucauuuaacauuagcuauuucuccuaaugcuaucccuccccacuccucccaacacacaacaguccccagagugugauguuccccuuccuguguccauguguugucauuguucaauucccaccugugagugagaacaugugguguuugguuuuuuguccuugugauaguuugcugagaaugaugguuuccagcuucauccaugucccuacaaaggacacgaacuuauccuuuuuuauggcugcauaguauuccaugguguauaugugccacauuuucuuaauccagucuaucauuguuggacauauggguugguuccaagucuuugcuauugugaauagugccgcaauaaacauacgugugcaugugucuuuauagcagcaugauuuauaauccuuuggguauauacccaguaaucagauugcugggucaaaugguauuucuaguucuagaucccugaggaauugccucacugacuuccacaaugguugaacuaguuuacaggaggacugaauaauuucaaugucgcagucucuguauugcuacuguggaaaugaucauuaugugcuucacuggugaauauucauggagcuaucuguaauaacagauuauuuccuccuuuuauauugccaaaguaguauguguauaauguaucuacuccccaguuacgucgcaguuuaucuuuccugguauauuuuugucauuuuugguuggcuuuuauaacagaaaauaaaacaaagaaaauggcagaauagaaauaaguauucuaaaguauuuauaaagaauaaagugauuuuuuuauugauuucuaauuaaauaugguauuaguacuauucacuugaauuuguaucuuuaugaaaaaucugauguuaauuguuuugcaucuuuuuaaaagauuacaacaauaaagcaauauuuuaauucugaaaagcuuuaaaggaaacauucauuccauaucaaguuuucugaaaguagauuucacauuguaauauaaaacaguauauucaauuaucagcauaaacauguuaguucuucacuaacaaaaaugauaaaaaacuuacaaacaucacugauaguauauacuucaauuuccugacaguuauccuuucaaaacuuaaaauaugcaaauuuaaaccaauaugcauuaagauuacuacauagugauuauauaacacuauugcauuucaugaaaauuauguuuaaaugaugcaugguagaaaauggugauauauuccaguuuuaaaacaacuuuuuuauugagguauaaugcacaugcaaaaaagaacaaaauucauauguaaaguuuaaugguauuuucacaaaauaauuacaacagcauagcaagugcacagaacaaacagcagaauauuucagcguccuagagccuccguugugucuccuuccaguccauuauucuucccccaaguaagcccuauucuaacgucuaacagcauagauuaguucugccauuucugauguuuugaaugaaaucaaaaaauaagcaucgcuuuguuucuggcuucuuucauucagcaugacguuugugagauucauccaucuuuuguauaguggugauucauuuucauugauuugcaguauuucacuaagugguuauuauauaauuuauauauuuauccuccugcugauguauacuugaguuguuuuuagauuuuggacuauuacauagugaguuucuucuuagaaauauucuuauguuuuuguaauuucauauuaaaaccauauuugaauugacaaccaguucagagcaguucauuuuuacauuaaaugagccuaaaaguuaagugucaguuucuggggggguggagagauggcugaauaggaacagcaccagucuacagcucccagcaugagcgacacagaggaugggugauuucugcauuuccaacugagguacuggguucaucucacuggggauugucggacagugggugcaggacagagggugcagugcaccaaacaugagccgaagcagggugagucauugccucaccagggaagcgcaaggggucagggaauucccuuuccuagucaaagaaaggggugacgauggcaccuggaaaauugggucacucccaucguaauacugugcuuuuccaacugucuuagcaagcggcacaccacgagauuauaucccgcaccuggcucagaggguccuacacccacggagccucacucauugcuagcacagcagucugagaucaaacugcaaggcagcagcaaggcugagggaggggcucccacaauugcccaggcuugaguagguaaacaaaguggccaggaagcuugaacuggguggagcccaccaaagcucaaggaggccggccugccucuguagacuccaccucugggggcagggcauagccauacaaaaggcagcagaaaacucugcagacuuaaauguacccguaugacagcuuugaagagaguagcgguucucccagcaugcaguuggagaucugagaacagacagacugccuccucaagugggucccugaccccugaguagccuaacuggguggcauuccccaguaggggcagacugacaccucacacggccagguacuccucugagacaaaacuuccagaggaacaaucaggcagcaacauuugcuguucaccaauagccgcuguucugcagccuccauugcugauacucagguaaacagggucuggaguggaccuccagcaaacuccaacagaccugcagcugaggguccugacuguuagaaggaacacuaacaaacagaaaggacuuccacaccaaaaucccaucuguaugucaccaugaucaaagaccaaagguagauaaaaccacaaagaugaggaaaaaacagcagaaaaacuggaaacucuaaaaaucagagcgccucuccuccuucaaaggaacacagcuccucaacagcaauggaacaaagcuggauggagaaugacuuugacgaguugagagaagaaagcuucagacgaucaaacuacucugcacuaaaggaggaaguucgaacccacgguaaagaaguuaaaaaccuuaaaaaaaacuuaaacaaauggcuaacuagaauaaccaaugcagagaaguccuuaaaggaccugaugaagcugaaaaccauggcaugagaacuacaugaugaauguacaagccucaguagccgacgcgaucaacuggaagaaaggguaucagugaugaaagaugaaaugaaugaaaugaagcuaaaagagaaguuuagagaaaaaaagaauaaaaagaaaugaacaaagccuccaagaaauaugggacuaugugaaaagaccaaaucuacgucugauugguguaccugaaagugacugggagaauggaaccaaguuggaaaacacucugcaggauauuauccaggagaacuuccccaaucuagcaaggcagaccaacauucaaauuuaggaaauacagagaacaccacaaagauaauccuugagaagagcaacuccaagacacauaauugucagauucaccaaaauuaaaaugaaggaaaaaauguuaaggguagccagagagaaaggucgaguuacccacaaagggaaguccaucagaauaacagcugaucucuccgcagaaacucuacaagccagaagagagugggggccaauauucaacauucuuaaagaaaagaauuuucaacccagaauuucauauccagccaaacuaagccucauaagugaagaagaaauaaaauccuuuacagacaagcaaaugcugagagauuuugucaacaccaggccugcccuaaaagagcuccugaaggaagcacuaaacauagaaagggacaacugguaccagccacugcaaaaacaugccaaauuguaaagaccauugaggcuaggaagaaacugcaucaacuaaugagcaaaauaaccagcuaacaucauaaugacaggaucaaauucacacauaacaauaugaauuuuaaauguaaaugggauaaaugcuccaauuaaaacacacagucuggcaaauuggauaaagagucaagacccaucagugugcuguauucaggaaaccuaucucacgugcagagauacacacaggcucaaaauaaagggauggaggaagaucuaccaagcaaauggaaaacaaaaaaaggcaaggguugcaguccuagucucugauaaaacagacuuuaaaccaacaaagaucaaaagagacaaagaaggccauuauauaaugguaaagagaucaauucaacaagaagagcuaacuauccuaaauacauaugcacccaauacaggagcacccagauucauaaagcaaguccuuggaccuacaaagagacuuacacucccacacaauaauaacggaagacuuuaacaccccacugucaacauuagacagaucaaugagacagaaaguuaacaaggacaucgaauugaacucagcucugcaccaagcggaccuaauacacaucuacagaacucuccaccccaaaucaacagaauauacauucuucucagcaccacaccacaccuauuccaaaauugaccacauacuuggaaguaaagcacuccucagcaaauguaacagaacagaaauuauaacaaacugucucucagaccacagugcaaucaaacuagaacucaggauuaagaaacucacucaaaaccgcucaacuacauggaaauugaacaaccugcuccugaaugacuacuggguacauaacaaaaugaaggcagaaauaaagauguucuuugaaaccaaugagaacaaagacacaacauaccagaaucucugggacacauucaaagcaguguguagagggaaacuuauagcacuaaaugcccacuagagaaagcaggaaagaucuaaaauugacacccuaacaucacaauuaaaagaacuagagaagcaaggcaaacacauucaaaaguuagcagaaggcaagaaauaacuaagaucagagcagaacugaaggaaauagagacacaaaaaacccuuuaaaaaaaucaaugaauccaggagcugguuuuuugaaaugauaaacaaaauugauagacagcuaccaagacuaauaaagaagaaaugagagaagaaucaaauagaugcaauaaaaaaugauaaaggggauaucaccacugaucccaaagaaauacaaaccaccaucagagaauaguauaaacaccucuacacaaauaaacuagaaaaucuagaaaaaauggauaaauuccucaacacauacacucuuccaagacuaaaccaggaagaaguugaaucucugaaugggccaauaacaggaucugaaauugaggcaauaauuaauagcuuacuaaccaaaaaaaguccaggaccagagggauucacagcugaauucuaccagagguacaaggaggaacugguaccauuccuucugaaaguauuacaaucaauagaaaaagagggaaucuucccuaacucauuuuaugaggccagcaucauccugauaccaaagucuggcacagacacaacaauaaaagagaauuuuagaccaauaucccucaugaacaucaaugcaaaaauccucaauaaaauacuggcaaaccaaauccagcagcacaucaaaaagcuuauccaccaugauccagugggcuucaucccugggaugcaaggcugguucaauauacacaaaucaguaaauguaauccagcauauaagcagaaccaacgacaaaaaccacaugauuaucucaauagaugcagaaaggccuuugacaaaauucaacaacccuucaugcuaaaaacucuccauaaauucgguauugaugggacauaucucaaaauaauaagagcuaucuaugacaaacccacagccaauaucauacugagugggcaaaaacuggaagcauucccuuugaaaacugguacaagacagggaugcccucucucaccacuccuauucaacauaguguuggaaguucuggccagggcaaucagguaggagaaggaaauaaagggcauucaauuaggaaaagaggaagucaaauugucccuguuugcagaugacaugauuguauaucuagaaaaucccaucgucucagcccaauauauccuuaagcugauaggcaaccucaucaaagucucaggauacaaaaucaaugugcaaaaauaacaaucauucuuauacaccaauaacagacaaacagagagccaaaucaugagugaacucccacucacaauugcuucaaagagaauaaaauaccuaggaaaccaacuuacaagggaugugaaggaccucuucaaggagaacuacaaaccagugcucaaugaaauaaaagaggauacaaacaaauggaagaacauuccaugcucauggguaggaagaaucaauauugugaaaauggccauacugcccaagguaauuuauaguuucaaugccauccccauuaagcuaccaaugacuuucuucacagaacuggaaaaaaacuacuuuaaagcucacauggaaccaaaaaagagccugaauugccaugucaauccuaagccaaaagaacaaagcuggaggcaucacgcuaccugacuucaaacuauacuacaaggguacaguaaccaaaacagcaugguacugguaccaaaacagagauaaacaccaaugguacagaagagaguccucagaaauaaugccacauaucuacaacuaucugaucuuugacaaaaacaagaaagaggaaaggauucccuauuuauaaaugaugcugggaaaacuggcuagccauauguagaaagcucaaaauggaucccuuccuuacaucuuauacaaaaauuaauucaagaucgauuaaagacuuaaacguuagaccuaaaaccauaaaaacccuagacgaaaaccuaugcaauaccauucaggacacagacaugggcaaggacuucaugucuagaacaccaaaagcaauggcaacaaaagccaaaauugacaaaugggaucuaauuaaacuaaagggcuucugcacagcaaaagaaacuaccaucagagugaacaggcaaccuacagaaugggagaaaauuuuugcaaucuacucaucugacaaagggcuaauauccagaaucuacaaugaacucaaaaaaauuuacaagaaaaaaacaaacaaccccaucaccacgugggcgaaggauaugaacagacacuucucaaaagaagacauuuauuccgccaaaagacacaugaaaaaaugcucaucaucacuggucagagaaaugcaaaucaaaaccacaaugagauaccaucucacaccaguuagaauggugaucauuaaaaugucaggaaacaacaggugcuggagaggauguggagaaauaggaacacuuuuacacuguuggugggacuguuaacuaguucaaccauuguggaagucaguguggcgauucuucagggaucuaagaacuagaauuaccauuugacccagccaucccauuacuggguauauacccaaaggauuauaaaucaugcugcuauaaagacacacacacacagcuauguuuauugcggcacuauucacaacagcaaaacuuggaaccaacccaaauguccaacaaugauagacuggauuaagaaaauguggcacauauacaccauggaauacuaugcagcuauaaaaaaugacgaguucauauccuuuguagggacauggaugaagcuggaaaccagcauucucagcaaacuaucacaaggacaaaaaaccaaacaccacauguucucacucauaggugggaauugaauaaugagaacacauggacacaggaaggggaacaucacacacgagggccuguuguggggugggggcuggggggaggcauagcauuaggagauauaccuaauguuaaaugacgaguuaauggguucagcacaccaacauggcacguguauacauauguaacuaaccuuuaaguugugcacauauacccuaaaucuuaaaguauaauuuaaaaacagugucgguuucucuaaaauuacagagacaaugaucguuuucuagcuucaaaauaauaaauugggauaacuggcuagccauaugcagaauauugaaacuggaacccuuccuuauaccauguauaaaaauuaacucauuauguauuaaagucuuaaauguaaaacacaacacuauaaacacucuuaaagacagcuuaggcaauaccauuuaggacauaggcacaggaaaaauuucacgacaaagacaccaaaagcaguugcaacaaaagcuaaaauugacaaaugggaucuaauuacacuaaagaguuuacgcaucgcaaagaaaacuauuaagagagugagcaaauaaguuauagaaugggagaaaauauuugcaaaguaugcaucugauaaaggucuaauauccagcaucuauaagaaacuuaaacaaaguuaccaaaaauaaaaacaaauaaccccauuaaaaauugggcaaaggacauaaacagauacguuucauaagaagacauacauguggccaacaaucauaugaaaaaacgcugaacaucacugaucauuagagaaaugcaaaucaaaaccagaaugagauaccaucucacaccagacagaauggcuacuauuaaaaagucagaaauaacagaugcuggccacgcuaugcaguaaaggaacacuuauacauuguaggugggaguguaaauuaguuccacuguuauggaaaagaguaguggguugaucccucaaaaaucuaaaagcagaaauaacauuuggcccagcaaucccauuucuggguacuacccugauaugguuaggcuuuguguucucacccaaaaccucaucuugaauugcaauucccauaauccccaaaguacaauuuuaaaauucauauuguaaagcuaauaguauuuucacaaaauaaguacacuagcauagccagcacccagaugaaaaaccagaacauuugaccauccuugaggcucuuugugccuuccagucauuauacuugccccaaguaagcccuauucuaaugucuaacagcauagacaucuagauguuuugaaacaacaaaaaugguagaacuaaucuaugcuguuaggcauuagaauaaggcuaauaggacauaauccccaugugucaagggagagaccaagugaagauaacugaauaaugggggcgguuucccccuugcuguucucauuauucugaguaaguucucaugagaucugaugguuuaauaagggacucuucccccuucgcucagcacuacuccuuccugccaccuugcgaagaggugccuugcuuccccuucaacuucggccaugauuguaaguuucauggggacucuucagccaugcuggacugugagucaauugaaucuguuuccuuuauauuacccagucuggggaaguucuuuauagcaacaugaagauagacuaauacauaugcaaaggaauauaaaucauucuauuuuaaagacucauguacacauauucauagcagcacuacuuauaauagcaaagacauagaaucaacacaaacacccaucaaugauagacuggauuuaaaaaaauguaguucagauauaccauagaauacuaugcagccauaaaaaaagaaugagaccgugucuuuugcaagaacauggauaagcuggaggcaauuauccuuagcaaacuaauauaggaacagaaaaucaaauacugcauguucacacuuacaagugggaacuaaaugauaagaacacacaaacacauacaggggaacaacauacacuagggccuaucagaaugcggugggugggagaagggagaggaucaggaaaaguaacuaaugauuacuaggcuuaauaccggggugaugaaauaaucuguacaacagucccccaugacacaaguuuaccuauguaacaaaccugcacuuacacuccaaaccagaaauaaaaguaaaaaaauuauauuuccaaagauuagagaaauaauauuugaagaacauagauauauguuucuuuuaaaguguuaaaaacauaguauaagagggaaauuuacacuuuuauaaagucugcauauagcuaaggaaauaauuaccaagcauuuuacccaauagacuauugaguaaaaauguccaugcacaaucuaaugcaugacuguuuaacauuggggaaaauauguuuacauuuuaucucuuuauacauuauuaaauauguacaauuguuuaaugcaaaguggauagaaaauacaacacauauuuggaugcuaaaauaaaccaaagaucgauuugcaaauguuaauucauuguuguuuuaauaaaacuaauguaauucacauguauauuaacuacaauauauuuuggaccaaaccauuucugcuuuucaaacacuguucaaaugcaguaugcuaugaaugacuagcagacuugcuaauuauaauuuuuaaaauaauucuguacuuacaaguagaacguacuauccacuucuaaugaauguuugaaaaaauaguagucauuuuuugugagggaagaggaauuuccuuuuauagaauuugagucguuucacuuuauuuauugucucugguauacugagugacuuagugaaacguuucuucguuuuauacuucuuuuuuguuaacauacagacaauuuucucucucaaccaguaaguuauucauuauccaauaaaaaucuacuauauuuucuaaagcuagucaaaugcuacaguauaaucuugguuuucaagugcugcaguuuugcuagugauuagaugcccguauacagucuaauuacaaaagaaaauaacauuuaugaaaaugagcuucaucuaggacaaguucaugcaggaaauuggucucuugaagaaugaaagugaaauauaaaacagagggaguucagauaaaaguuauauuuaggauaaucuugaaagacaugugugccuugugaaugcauagauggagaucuggaaaaaauguagguuguuaucagacaaaaacguaacaauaauaauaauaguuagugcccagaauagcaauaaaacacaaguuuucuaauugucguauuucacuauuccccuccuuauacuaggaagguaaacuuuccaaguuauuuuccagaugauucuuucacagaaccaaggugaggagacaaaguagcaaaugucuguaauauauuucaaacuugauauucacaaaacuuuuaucaugaaaaaccaaacauuuuuucauacauacucagaaguuuuaugagaaguacagaaauuuuaaagucaagauucauauuuucauuuauuuuauuaauauugaugauuauucaccaucaaaauauaaucuuaaaccacaaaguuauccucuuuaauaaaucaaaauuaggaucaauacucuacuuguauauaaggaaguaaaacaaaucuucuauacuuuuauagaaguuucuauucuagguuccaaauuggugucauggauaagauacaauguauuuauugaugucauggguaaauuacaacucaucugugauucccaccaaguuauguguaaacauacguguaaauguguauuuaugcacuuuuuuuggaaccacugcuuuuauaaagucucaaacuuuaagaaaucauaguuguauauucacaauucuuaaagaguuuguuuucgacaucucuauaacucauugccucuacaauuaaauaauaucacaaaauuuaaauaccacucaacaaauguaucaauuuuuaaaaaucagaauaauguuaaaacauuucauauuaaaguacuucuugaaacucuauugacauaaguguuuuuugcugauuuguaccugguaaugacuauaauaacaacuuucuuuauauauauuauggaauaagguaucuuuuaaaugauaaacauuuuuuuucuguacauaucaaaacacuaucuguguaacuaaaaugcauaacaauuaccaucaggacguaugggaaauacauuuuacaaauaguguguugcagcuaagguuccaaaaugcuaccuaucucuaauguaauaccuuagugucucucuugcuuacaagaucuauuuuucacuuucagacuugagggcauauuuguuuagcuucuugaccuuuuugcugcugaacagaugaacaucauguguaguauacccuucucuuuuacgaaguuaaaagcucauauauccuuguagaaauguaaaaauuguuucauuuuacuuuggaaaaccuaagaagacugaaauauaauauccuguauagauuaaauaaaacuucuucaagaaaguguuuugucuucagcaauaauauaguaaaguacaugacagacaugauaacauaaaaauauuaucuucuauuauuuaugaaaaaauucuuaucauuccccaaauauaaaauaugggccaauaacaugcugauaaaguaggcaucuuuauguccaaauuauuauuaagccauaaacaggaaaaacuggaagcuuguguugacuauauuuuguuaucucuaauacuauuugugauaaaccuuaagaauuaauaccacaagggauuuauuguugcugcauguuuuuauccuaaauucacaugaacaacuaggaaaaaauuguucuuguaaaaaaaaaaaaggcauuuauuugccaauacuugaaagcaagucucuauuuauugcuuaagguuauuugauuuagagaugcaguucuguauuaaggugguacauuuaaaaaagaaaaccacagauggaacauauuauuuccacaauauauuuucuucaugacacaccagcaauuguuuugugguccuaaaaucccuguauaaauuuguuuuguuaaaaaaaaaagauaugcacaaaugacauaguauuuguuuuaucauggcaguccaacaauacagcauacacgugguaagaauacuacuucagcaacuguuauaccuaacuaccugcagaaauaaauauccacuauguguugcacacuuuaaguguuuuuguuacacagguaaguuguccuucagaaaagugguaacaauuuauauuauaaaugccccucuaaauucuucgcaaagaaaagguaaguagaacacuuuaaugucaauaccuguaugaaauguaugguccuuuugaaaauauaccauuuuuauuauaaaugaauacuaaauacaauaauuuguauuuuaauuaaaguugcuuucaauccuuuccaaaaaacaauaaaugaauacuucaucuaguuagcacuguucggcacauggugggcaguuaaaaauuacuuacuauguggaugaaucaauccaauaaugaaaaaagaaauaaacagauacaguggaaaacaugagaaaaauagucucauuauuuguccuauuauauacugauauucaacgugcaguauuuguacucuauucaaacuauaucaacuguaucagaaacuaguauaacaaauauucguaaaacauauggaguugguccuccauauccaugaauucauagauggaaaauauuuuuuuaauuguguuuguacugaacauguacagacuuuuucuugucauuauucccuaaauaauacauuaugacaacuauucacaugacaccaacauuguauuaaguauuauaagugagcuagagaugauuuaaaguauacaggaguauaugcauagguuauaugcaagugccacaccauuuuauaucagggacucaagcaucuguaaauuuugguguaugaaaagagguccuaaaaccagucccccaaggauaccaaauggcagccacacucugaaaaaauagauuguacucaacuuuugaaaauucucauuguauuuagcacuaccuucuccucccuugacaaagccucaguacaguuccuuaucucucaacugcaucauucaaagaaaucuuaguggccuacugucucuacaaaaauguucuagaauuauuuuuuaaaucaaauaaaaucauguaaaucaaaugcuuaauuaccacuauuggcucucuaugggaaaucuggagguucuaaaucuccacagacaucguaauccuaugaagaucauuacaaauauaugaacugaaguaauuggcaccucagaucugcucagcagguucucugggggauugggcuggaaguggugcagcagucuguaauuguaaaaucuucccaggugauucugauuaaguccugagcauuuacuuuuuuuuuuuauuuuuauuuuuuucaaaccacuccuauaggguaaauccuauugcucaauucuggucaucaaugcucuuccaaaugauuauguccacaucauccauccuauauuauaauggcuuuaaauuucucaccaaacacugaguacagccuucauuuucauaccaccaagccuggaaauccuuuccuccuuuccucucuuuugguuaacuccuguuucuccuaaaauaccacaacuucuuuaauuaggacuaauggaggacuuccuuaauuucuccuagguaaaguaagugucuaagucuucuguguuuagaagaaauuugcuuucuuuuaacaauuccaaccucauauuuauaauuuauuauuuuguaugccuugcucuuugguuaagcuaugaguuccuuaaggacauagagcaugaucuauugaaauuuuuaacauaaaaaaugcuuuaaaaauaggugcuuaauuaauggguuuuaaaauaacagaaggcauuagcaaauaauguuaaaguuaucacuauagacaucccaaggagcucugaauuccuguauaagacacauuuuuacacuuugaauauuaaaauauuaaggcaauaaaaugguacaugauggugaccaaucauccaaguaucccugcaacugaggaguuuccuagaauguggaaauuucaauccuggaaucaggacagcguuaggcaaaugggagugguuuaaaauuaaagccauaaucagagguuuugcuacuauguaaaaaauauuuuagaagauauauauuagauuugccuuuucuccaguauuuaaaauauuaauugauuucaaauugagggaagguguuuauaauggaauagcuacuuaaaaauaugugaaaaagugcucuuuuauuagagauauauaggagagauggcuaucgcaaaacaaguuuugguuugcuaaagcauuucuugaaaaaaaaaaagaaaaaaacuaacuuuauugcauguuuucacaguucuaugauaguguagauuaauucaaccaguaaacuuuuuaucugaauucuuguauauauggcuagauuaggacacuaauuacuuaaaauaaaaaauaauucuuuuaaagauaugauaagguauaucacucuuaccaagcucuauuuugaaaaacaaguauauaauuuaaaaucugccaaacauauuaaaaucagaauaaucaucaguuuucaagaaaauugaacaaucaauuaaugugaauuuauaaucuuuuacucagcaaauuuauuucucauaucacuuucaugacaaugagcuucuauucauagucucauccauuuuguugaagacaauugaugaagauauaaggacagccucaaaggugccugacgaauugaagggaaagugcagguagccagugaaggauuaagacaaccuaacaacucuguugacgugcuaaaagaaaaguaugucuguucauaaauauuacagguuuugacagaaauuuaauuuuccaaaauaaauuagaauuuuuuauauaacuauucucuuuaagaauucaucuauaacaugcuguuuagaaucagauacuauaaaauuuauuuugaaucuagcaaagugugcuaccuguuaguacuuuuuuuucauauuuuuuguuuaguaauggcugcuuuuuuuuuuuuuuuuuuugagauggagucuugcucugucguccggacuggagugcaguggcacgaugucgacucacugcaagcuccgccucccagguucacgacaaguaauggucacauuuuuaacgcuaauauuuuucuaagaaagcucuaucuugcuuuucagugucuuugugcuacuacaaaauaagaacucuaauuuuuacuucuauauuucagcaguuaccauaauguuacucauaauguguacucaguggauguguagaguaggaauaauuuauuguuaaaauaguugaugcuauaauucaaucaauacaauuauacugaauauuuuacauguaaaaggaaacuaguacuuaucucugaugaauuacugucaauaaaaaaacuauuaacaaaaucagauuaggaaugcaucugauagacauuagucccuacauuaagaucugcaugagaauagcuagugaaucucacaaugcuuagcacugagauuuucaugaaaaacuuacuguguuuuuagauaauaaggaaaaucaaguuuuuguuuuguuuuguuugagauggaguuucccucuuguugcccaggcuggaguacagugccauagucucggcucacugcaaccucugccucccggauucaagcgauucuccugccucagccuccugaguagcugggauuguaagcgcacccuaacacauccagcuaauuuuuguguuuuuguagagacagggauucaccauguuggucaggcuggucucgaacuccuaaccucaggugaucugcccaugucggccucccaaagugcuuggauuacagguaugagccaccgugcccagcugaaaauuuaaguuuuuaaagaaaacauuuuaaggccaggugugggggcucaugccuguauucccaacacuuugggaggcugaagcaggcggaucaacugaggucaggaguucaagaccagccugacaagcauggagaaacccaucucuacuaaaaauacaaaauuagccaggugugguggcacaugccuguaaucccagcuacucgggggacugaggcaggagaauugcuugaaccuggaagguggagguugaagugagccaagaucgcgccauugcacuacagccugggaaacaagagcgaauaucugucucaaaaaaaaauuuaaaacuggaauggacuauaugguuucuaggacagguagauaauauucuaagagguaccaaauaccuaccuauagaaacaaaugauccuuguccucuacagaguugcugcuaaagugagaggagugcaggacagaugagacaaugaauaugcacacuuauacuuuacauuaagacaagggaagaaugaaugucuggcucuuucuuguacuugucuuaauuuuuuuaaaaaaguuaauaaauaaaauguaaagaaugaucuggaauggaaaaacggggcauauacugguugaugaucaugaaguuuggcucauuuaaggaaguacuauaaaaacaaauuccauuaauaaaauaccuuuguauucuuauggagcaaacaagaagaagugugcuacauacaguacuuaaacuuuuauguaccuaugaaacaccuggggaucauaagauguugauucucguugaguacgucugguguggggccucauauucugcacuccuaacaagcuccagagugaagcuaugcugcuaguccaaggccaacacuuugaguaguaaacuguaaaauugagauuaaucuaagucaaggaaaaauaaaacaccagaggauuuuguucuaggggaaaaggcuuaaaguccuaguaguuauuaauggaggugccuguagucccagcuacucguguggcugaggcaggagaaucgcuugaacccaggagguggagguugcagugagccaagaucacaccacugcacuccagccugggugacagagugagacucugccucuaaaaaaauaaauaaauaaaugauaaguaaaguccuaaaagugucuuuuuuaaggaugaaagggcuggguucccuuguaguuuagaaacuaaaggggcacagaggccaagagagcucuaugaaguuuccuagaguaaagacagauuuaaguauaagccugaggggcaugaaagcugcuuccaccaaagugcuaaaauucagcucuccuuuggcucugagcucagcucagaaguggcaaaauucuugaaaggcuuaaaaaucugcguagagauguguaagcuaguaaaagcucugccuagagcacauacauaaaagcacagcaagaacaccaguuauacugucugguguuaauuggcaauauugucuuuaauuaauccugguucaagggaagcuucaggucuacagauuucuaaaauccaaauugucaaauaaucaaauuuucaaauaaucaauuugaauaaucaaauugucacuaaaaauacuuacauauucaaaagaggcacuauguuuauuuuucuacaauauuugcuuugacuaaauguagcuaaucuguaccaaacauaaacuauucaccucucaguguaagacuaguauauaaauuaacucuccaauauuuuuauucacauuuucuacccccuacacccauuugugauugauaaaaccaagaauuaguauuuauaauuaacuuuaaguaauaugcauauuaagacuuaauuauagagcgaacucaguacugaaauuaauaaauuaauuagaaauucaucacuaaaagugucuugcucacaguuuaccuuaaaucucuauugcaaacuuugaguccucugauugucugauuguagcaauaccucccagcagcuacauuaauuacaaacuugauguauucaacaaucaaaucaaauuuaagaugugaguucuagacuuucauugcccaauauuggagcuucuagccccauaugaguauuuaaauuuaaauuaauugaaaguaaauacaauuaaaaaauuaauuuccucaucaaaugagcuacauuugaagugcucaguagccaucaauagcugguaaauaccauauuggacagcauacuccucuauaugaacacuuccagaacauuucaaacaucagaacaauuaucuauugaaaaauucaaucauauuuuaauguuuacagaucuccuaugcauuuguaaauuuuuaaacaauguaguuauuuaguuuauuaccuaacucuauccucacaaucauaugaaaauuuuaacguuauuauauuuuauaaauuagagucauguugauuuuuuuagagccacagcugaaguuaaagacuuuaggaacuuaaaacuuguguguggaauuaauuuauucaaugggauauaaaauucaguccccauuucugucuugggugggaugaaucaaauuuuuaauuagaguggcacuaacuuucaguaauccacuuuaccaucuaauauaugaucgucaguaccauugaaaauuuuuguccuuaggggaaauaaauaucauuucuuaauuaaguagggaaauuaguaaaaucucuauauagcauuuguuuugaaaaaggaucacugucacuuaacuaaucaguagcucaguauuccuaaaaggucacaagagacugcuuauauugauguagcaaauugccaccuugaauuguucagcuaacaauuuuaaaagccauuacauuuaaggauaguaaaauuagauuaacaugaucuacuauaauauuucuuuccaccagaauucaugcuaaagucauaaagcuuuauggaccacucaucucaauugcucuguugauaugauaaaaucuccucuucauuaaucuaaaguucuuucucuguaauucauaaauguauucuuucuuugguuccauccauugucauugcuccccugagcugauuccauuucacaucauucauuucuuaauuuguuuggcccuugaaguuuuauuaccuaucacuuuaucacaucuaauuuauauaagcauuauuuuugaggucuggccuaauuauuuuucuuauuuuucuucuauuucucuccugcauacuuuuacaucgacuuuauauuagaaacucuguugccacagucacccuaugggcuucaugcucuggcugcuaaaugcuuauguacucuuuuguggcaauaaaaagcagcaauauccaaacucacaguacacuucugaaaacaaggauguuucauaucaaguuauuaaaucaguaauaacugugagugcaaaauaaauaucaagauaauauuuacauuuauugaaaauaaauauauuuuauuuauuuuauuauuuauuuauauaagguauuaaaauuaucuucauauuuggguauguauguguaaaaaauuacaagcuaaugcuuugaaacuuaaacuuuuaugaguauacaggagucauuaaaaugauaugaagaaaaaauuuugaaaaaaggccauacauuaauauuauauucaauuuaauugaauaugcuuuuauuaaauuccaaggaauuauucuagaaccaaauuuaaaguugaaagugaggaaaagagagagguuagugacaauuccaggugaaagagccugugugacagacagaauauaguacuauucuuagaaauaagaaaagaaacugcauugaguugaaucguagugaugauuaaacagaaucaaagaugagaaugauguuuagauaaacggucauaagcauagauacuucccucuaugauagaucucucuccaacacccucccauuguuuacuuaccuauugccuccaauuuauacuaugagcacauugaggagagagaagugcgguauguaaaucagauuuuaucucuaaugccuugauucuugccuggcaacuacuuguuucuguguaauaauucgaugacauuuuuagagaaauuaguagacuuaucaacucgccucaaacaaaaauacugugccuuuuaaaauuuuuuaauuuucugauggagagaaacauuuauaauaaauuauucccauuaaaaaucccaagagccagaaauuacugggguucaccacggaucuaaauuuuauuccuagccaaaaauaauuauucaugguuuuuaaggcuugacauuuaaccauuugaaauuuauuccuguggguuccuccagguuaaaaugcagguaacucauuaaaaagucaaagaaauauucuuaauguguggguauugaauccuuugcuaagauuaagucugacaaagagaaaugugcacaggagaaguaagaaaaaagguuauggaaaaucuaggagcauuggauauuaauuuacuuacuuugcaauuuuauaaaaaccuaagaacccacauaguaucugccugaguucacauuguuauuucagccuucauuuuauucauuuaaaauguuguggguuuuuuuuuucccuucaagauggcagauuagaugacaugaacaaaugggaaaaauaucccaugcucaugaaucagaagaaucaguaucguuaaaaugaccacacugacuaaagcagucuucugauucaaugcaauucccauuaaaauuacaauguaauguuucacagaauuaggaaaaaaaauccuaaaauuaauauggaaccagaaaggagccugaauaaccgaagcgauccuaagcaaaaagaaaaaaucuagaggcaucacauuaccugacuucaaaugaugcuaugagguauaguaaccaaaauagcaugguacugguauaaaaaucaacacauagauccauguguuaaccacuaaauaaaaucaacacauagauuuuugucacuagauaaaaaucaaaauauagaucacuagaacagagaauccagaaaugaagccauagaccuacagucaacugcucuuugacaaagucgacaaaaacauauguugggagaauuacacccuauucaauaaacgguacugggaauauuggacugccaugucuagaaggauaaaacuggaccccuacaucucacauauacaaagauaacucaagauggauuaaagacuuaaauguaagaccuguaacuauaaaaauacuagaaaagaaucuaggaaaaacuguucuggucauuggccuaggcaaagaauuuaugacugagaccuggaaagcaaauguaacacaaacaaaacaagacaaauggaacuuaaacuaaaaagugucuucauagcuaguagaagacaaauagcaaagaucagagcaggacuaaaugaaaaagaaaccaaaaaaauuacaaagaaucaacaacacaagaaauuauuugaaaggaugaacaaaacugauagaccacuagcuacauuaagcgagaaacaaugagagaagauucaaauagacacaaucagaaaugaaaaagaagacauuacaacugauacuagagaaaugcuaaaaauccucagagacuacuaugaauaucucuacacucauaaacuaaaaaacuuagaggaaauuaaugaauuuccagaaauauguaacuuuucaagcauguagaaggaagaaauagaaaucccaaauagaauauuagguuagugcaaauguaauugugguuucugcuguuucuuucaauggcaaaaccacaauuacuuuugcaccaaaauaguaaguagugagguuaaaucuguacuaacaaauauauaaacaaacaaacaaagcccaggaacagauggauucauacuugaguccuaccaaacauacaaagaacugauaccaggccuauuaaaaccguucuugaaaauugagcaguaaagaauccucuccagcacauuauaccaagccaauaucacccugauacaaagcaagacaaggacacacacacacacacacacaaaaagauaauauagaucaguauuucuaguaaacauacaugcaaauauccucaacaaaacacuguauccaacagcacaucauaaaauaaaauaaaauacaccaugaucaaguggguuuuacuccaggaaugcaaggaugguucaacauauacaaaucaauaaaugugauucacugcauaaacguaauuaaaaacaaaaaucaaaugaaacuauaaauauucuagaagaaaaccuaggaaaaacucuuuuggacauuggccuagguaaauaauuuaugacuaggaccucaaaagcauaugaaaccaaaacaaaacuagacaaauaugacugaauuaaacuaaaaagccucugcacagcaaaaguuauaaucauagaguaaauagacaaccuacagauugggugaacauaucuuuaaacuaugcaacugaaaaauacuaacauccagaaucuacaagcaacucagugcaacaacaagcauaugaaaaauugcucagcaccacuuaccaucugagaaaugaaaauuaaaaccacaagauagccaucuuacauaagucagaauggcuauuacuaaaaaguuagaaaauaacagauuuuggcaaggauguggagaaaagugaaugcuuauacacauuuggugugaauguaaauuaauacaacaucuauggaaaacaguauggagauuuaucaaauaacuagagauagaacuaccauucaauccagcaucccacuaugggguaucuaauccccccgcuaaaaaaaauuauuguauaaaauauaccugcauucacguuugcagcaggacucuucacaauagcaaagauauggcaucaaccuaagugucuaaaacagaugacuggauaaagaaaaugggaaauacacacacacacagacgaauacuacucagucauaaaacaugaaaucaugucuuuugcagcagcaauauggaugaaacuguaaggcauuaucuuuuuuuuuuuuuuuuuuuuuuuuugagacgaagucucacucugucgcccaggcuggaguguagugccgugaucuugucucacugcaagcuccgccucccagguucaugccauucuccugccucagccuccggcguagcugggacuacaggcacaugccaccacgccuggauaauuuguuuuuuguauuuuuaguagagauaggguuucaccguguuagccaggauggucucgaucuccugaccucaugauucacccgccucggccucccaaagugcugggauuacaggcgugagccgccgugccuggccuggaagccauuaucuuaagugaaauaacucagaaacagaaauugaaauacuucauguaaucacuuauaagaggaagcuaaaucauugcacacauggacauauaguaugaaauagcaaacacugggugggaaggugagaggaggguaggagaugagaaauuacuuauggauacaauguauacaguucugaugaagguaaauuaaaagccuagauuccgcugugacacaauaugcccauguaacaaaacugcacucguacccccuaaauuuauacaaaaaaguagauaaaacguuaaaugauugucucugccccuagcuuccugcaaugugcuguaaacugagaaaccagaaugaucuuguuaaaagccacuuugugucacucagagucuguuagaguuuucacaccuaaauaagaauuaaaguugacaaugaccuuucauauuguauuccuacccaucuuucucuaaccucaccuuucccugcuauuuucacuauuuacccuucagcugguccugaaagucaucaggcacauuuucaaauuuacauccuuuccccuccaucucuagaacacuccucucccaucuaauuucuugaccauucccucaccuccuugacgagggcuaggacuaauuacaagcaacucuccuccauaaaccugaucuuugugacccuguucuuuaucuauaggaauuaccaucuucaucuuccaucaggcuauaaaauguguuuauucauuauguuuauugcuauuauuguucucucucuuccacaaaaguagagauauccuuuguuucaucaacuuagguacaagcaaaaacccacagcaaauauuguuuauugauggcuuucauuuugcacaauagcauucaacauuguuuuugcuuauuuuuuggucugaagaucugaagaucauaguguucuucuuguuuguaaaaaauguaaaugaauaaaacaaaauaacaaacaauuaaagaacucugacuauuaaaucaguuaaugcaucuugauacaggcuuaggaaauaccaaguccuguugaauaacuagaaugcacaggguuuauccuagguuauauaauggaaguagcucaagacugauauuacuucucagaaauucaaccacuugugaaaaugacuuaggaugcuuccucagaauaugccuuguuggaagccuguauccuggugaauacuuuccaagacaaugaaccagaaaaauaaaaacauaauauagcuaaauuuuuucggaaaacugaaaaagaaauaugcaaacaagcaaauaaagggaaaacaaaagacagauuuacaaacauacaagaaaaauauaaacuaaaaacaauuauaaaagaauaauguuuauagauuauauaaaguauaaauuacuccuauuauuaaaauuaacguguuugaccauuuaacagaauugaauucaaaauuuuauucuuuucaaaaugcuacucugucaaacauaaaucuaaacaaucaucuuuuaucagauauacugauguuaaauuuugauauugaagaugcuuuaauaugauuuuauauacacaaacuuauuucacuauacagcuauaauguuauguuguguaaaacucuuuguaauuggaaaagucuauacaaaauuaaaguuauuguuacuauuaauuuuuuaacauguuucuucuaauugccuuauuuuguaucagauuuagaguagaaaaauaaugggaaaacugcuuucgaguaaccaugcacauuucccauugaaaccuguuaaagguuacacaugaguauaaaaggaugguauuuggcccauaaugugcucaagaucuaauuuacaguaucuguaagcgcuacauuaguaauaauaaucaaagcucagaggauuggcaauuuugcugaagcauccagauuuuuaaaaucugaacuacccaaacuuuugaaggcucucuccuuuuucucuccucuucugcaaucauccaauuaaaagacccuuuuccccugaugcaaagcaguguaauuucacagaaguuuuaugcuacauuuaacagcucaggguuuuaagcuaauaaaaaauagacuuugaagagacaagaauauacaguauauguuugguagcaacaugaaauaucuucuauuaccauuagaggaaaaugaaauuguauuucaugguuugcugcuuuuagaaaucauugggaaaaauaguguuauuuguuucaagucuaucagagcuagguucuauauaugguuaaaaauggauguguaacuauauuucuuuguuuuucuggcaacugaaaacuuuuagggacuaaauguuuauguucucauuuugcuggguacggggaagaaaggauggauaugcgucuuuucuuuuagggauguucacugaaauucuuuuucaugcagucaggacauugauauaucccauguauuuucaacaaaaugaucagugagaaauaacuagaauauaugaaaaauaauuguguggguuugaacuuguuuuguauuuucuuauauauuaucuacaacuuuuuuuuaacuuacaauuuuucagaugaaguaaaaauuaaaauguaaagaagauguaguguuggauacgugaaucucuuccuaagcuggaaaaguguauauguuugcuuagccaaaauuuagcauccuaaaucaucuuagcuuaugcucauaacuguuguacuucauuccuaugugaucuuaggagaauaaucauauaauuucuuuguggccuuuuucccaguuuuccauuucaagggaacugcuaucugcuuacaaaagaauuagggacagaguuaaugagguuucauuucauuuccuuuuuucguuguguuccagcaauauuuccaagccucuccaaacuuauaaaguaauacauuuccuauauaguuacacacuugaaugacuuucucaaauuagggaagacccccuacuccaaguucaaauuuggcagugaaagauuuucuguuuacaauaacuauucugcaaugcaacuaaggaagccagggcacccacguguaaguccugcuggaaguggcauggaaagauucugaaagaaaguagagugacaaaaaagggaaauagauguugacuuaaaaaugaacucccauucauucuaacuuacuuuuuuuuuaaaacaaacaaaauaggaacuuugcccuuucucuaaaaguacacuguuuuguaugauugagaauaguuuauacacaaaaucacaggcuuaaaaucugaauaguauuaaagagauggauaguuguuuuucauuaacuuugaaauuagugcagagaacuuagagagacauggggagaauuuguuuggggaaaacagagaaggcagcuacuguugauucagcaccauugcaggcagacagagacauuuaaaauaauauaauuuaauaccaguaauaaucucugaagaagguaagcauuaggauccucauuaccagauuagaaaacagagacaugcagagucuuaaggaguucacccagcaaacaggagggucauaauuaaaaccuggguuugggcugggcgcggugguucacaccuauaaucccagcacuuugggagaccgaggaagguggaucacuugaggucaggaguucgagaucagccuggcaaacaugaugaaaccccgucucuacuaaaaauacaaaauuagccgggcgucgucgcacauaccuguaaucccagcuacucaggaggcugaggcagaagaauugcuugaaccugggaggcagaggugucagugagcaaagaucgcgccacugcacuccagccugggcgacagagcgagacuccgucucacacacacaaaagaaacaaaaccuggguuugucugaccacagaauucaaucuaaugaaccacauaaugaaucugcuuuuaaacuucuguuuuaaagaacugagaaauuguuaugauguaaaugaauucaauguagcaguuauauuaggcaagguguguucucgacuacaucaguuuuucaauugacuauauauauauauauauaauauuauaaaauaugguaacuuuaaacaacugaagaucucauaauaaagauagauauauaugaucagguuaccagaauuccugcacuagugaaaauuauuugaauaagggccaaacaauguuuuauuuuucgagauaaagugagaggcaauaaauuagcgaaacaauuaucaaccaaaauucccugguaugcuuuuucuaucaggauuuuauuuacagcagaaauuuuuucuucuguguuuccucacuacugucuuaauucucaagaaaucacguugaauacaaccccagaggggaacaccuggcuacauagcccuugaauacauauugccugggggcucuucuaggcuuucucagaaaucagaacauauuuguuuugcauuuuuaugacuuuuuaaaaaacuucucuuuuuaguacuuauggaauuguauaaaccucagcacaauuauacuuacauaggcauggcaccuuuuagucaugauggaauuuacguacuaaagugcuuuuagugcauuuuuagaaauuccuuacugucccuaaaucaaaaauaauucauuuugaacuaaacuguuucauuuuucuguuauguaaaucauggcuaaaauacugacaacaggggaguuguauaauuacuuugaauucauaaaaaauccagguauugcuagaauguuaguggaaagaaaagucagacacauaggguuuguuguucauugauugauacuuacuagauuucuuuaccuugggcaaguuauucaacauuguuacucccugguuucuucaguucauaaugguacugacuuuacaggaaauuuauauaaagugccugguauaaugucuggcacaguaguuaguuaacacauucuaaggauuugaguaacagauaguagaacuuucaacucaauaugagagucuuuauaaacuacacucuauuuuaauauuuuuuaagcacagaagacagcuuguuuuauuacugguaacucaaauugugaagauguacauccuuuuucauugaucccaauucggucuaccugaaaauucuaccuuccuacaucagauagagccuuugauucucucuaaauaaugaggagaagucugauaagcuuauauaacuuguuuucccucaccucuuguaagcuaaacaucuuucaguuuauauauauauauauauauauguuuucuacaugaugugucaauucaagcucuuuggguuuuggcuuaagcaaaacauucuuucuuuaacccauguacuggaguagaucuaccagcuacagguuugguaugaccagaggcucagauuacaucuuuagaaccuuguuuugccaucuucaaaacuugucuuacauucuaccccauguuggccucacagauuuauccauuuuaauguuaagauagucccagcuuugugacuucauaacucugaguuuaguggaaaagacagaaaauguccccagccaauucucauuaaccacaguauuaaucccuguggcaugacaaauauaauauauugauuaacuuaaauaugggagacagguuuaacauaacauauauaaacuaacuggguucaggccaguuagaauggacacuggccauaaauagcaauuauggccguacagugcaucuuuacugaucuuaauucuauuucaagaacuccccuugaccugcccaagaagcagacuguagagucaacuuuacccuaaauacaaggauuaauaguggaagaagucuugauucucaggagggaaacaggcuuauggccaccauaaaauaaagacugguugaauaaucuggauaguaaaucaagcacgguucacugaacaagauuuugagaacuuucaacaaucuuauuauuuugcugaauuuauuucaguuagacaauuguucuuuuaaacguguuccccauaauuaaguacucaucaugaagucugagcaauauaguacauaguaggaauauuaccuguuuuugccuaaaaucuauccuucuauuaauuaagcuccagauuacugcaaucaccaauauucuccauuugaaauauugucaagcugggacccucaggauucuguacuuguaguuuauuuauuuauuuuuuaacauuaaacuucaaauguaaaaccccugucuuauaaaauguagaccuacuugguuuauagucuauccuccuggccauucaagauaacacuaaacauucauacaaaugcaagcacuaaaucaucaucuagaaccuuaaaaauaucauauucagucacugaaaaauaauaagcaaauaaacauccaaucauggaaaagcuaauaaaagaagaccaccauaacacgguaaaggagaccuucucucuagauuuauaugaacacuauuuggguagguuugaucaaccuuaugaauguacuuugguccauauuucucuaccauguggacaaaaauauaauguauguuuuuguuaaaugccuaguaaaaauuaaagaccauuauuuucacacagcuccuugagcugaccuagcuguaaccaaaagacuugcuagcuuguaguuauuuauuuucuuaguacccacacucuagguaauuaauuaucaaauuuaaaaguuuacuggguccacaucaaacucacuggccuagacacugaaggauccauuuuccacuuggauuuaugauaccaucauccuuuacuuaugcagaacuuggaaauuuaagauuccaaaauaacacaucaucaacucuacauuaucccgaaacauauuaucugcauuucaacuuauccucauaaaucucauuuucaaguucugacuucuauaauuaagcagagugggugaugaugucuugugcuacugcauucuuacuuaauuucuuucaccugugccagcuguggcacaguaggaaaucuuuuaaacagaaauaauuaauuaucucuuuacacccaagaaaagcauggagcagagauuugacaaacuguaaagauuaagaggaaaaaaaaaguuacacaugggcuacuauguuauaauauagaagcauacuuuugggaucaugcuauucuaacccuuucaucuugcaggugagaacacaggcucagagaaguucagugauuugccuaaugucugauaacuagaaagggucagagccaggacaagggcucaggauuuaugucaauccagauaccuuccuauuuccccaccaugccccuggguugaaaagugauaaucuaaccaauauggaauaaagaguucugaaggaacgaacaagaaggagcagaugguuaacuuuauuuauucauccauucaggcauauauucauuuuaauuuccaucagugagcacucacuucugcuagucacggguuuaaacucuaugggguauaaagauaaguaggguaagcacuaggguaggcacuauacucagaaaaaaaaucuacauucugaguuuuacuguuacagaggauauauacuguagcuuuauguuaccuugacaaaaguaaauacaaguccaagaaaaagaaaaccagaaacauucacauucaacauugauuuucaaaguauuuugguuauuuugauuaauauugucuuuucaggcuauaaaaagaaugcauuucuuucauauuuuauuucuuuagaauucauauuucauguuugcuguaaugaaaugcugcaugcuguuuuauuuuaugcuaaacaguuuaauguuaguaaauuguuuccuuuaacaaauaaaauuaauuuuaaagugucaacaacuuuacaaaucuguaauaaucuaugguuuucacaguagaagaguagaucauuuggcaagaccacauacuauuuuaucauuaaaugauuuuagauuuuaaaaauuauguguucccaaguggauuuucuaucaguuauuuuuaaaauuauguuuauauuuuucuuauuaauuucuccaaucucagggucaugaacuggcaguuugagugcauuaacaaugugauggcuaauauuuguggccuaaucucuuuaaccagcacugugaacaaagaaugagcugccacauuuucagagaaaauacauucuuuauucucacacauaauaauauagcuuacauaauauauuuccacaacaaugaagaaaauauaucucucagaacaaauuuuucaaaaaacaauguauuugaaaucauuuacccuagaaaaaguucccucaauuuuuuuuaacaaugaagaaaauauaucucucagaacaaauuuuucaaaaaacaauguauuugaaaacaucauuuaccccagaauaaguucccucaauuuuuuuuuaacagaauaguuuaaaccaagaccagccaggccaacauggugaaacuccaucucuacuaaaaauacaaaaauuagcugggugugguggcaggugccuguaaucccagcuacuagggaggcuuaggcaagagaauugcuugaacccuggaggcggagguugcagugagccaagaucgugccacugcacacaagccugggcaacaagagcaaaacuccaucucaaaacaaaaacaaaaacaaaaaaaaaaaccagcuauuacauuuucauaaucaaauauaauuaaauaugugucuguuuagagauacuuuugggugcaaaauacauuauaagaggcauacuuucaaagguaaaauaaugggaaucucucaauauguuaaugcaauauuuaagaaaacaggaaagaauauuugacacagaacugcccuugaaaaaucugacuuuaauggccauuuaugcauuacauauaucagagacugaaaaucauuauaugugcaagugugacucaauaagugggcucuguacucugcacccccaguacuuaugacucuuaugaugccgauguaacaauuuauucucagauaggcaagucugucccagauucuggcugcaaaacauuacagccuauacugauucuacuuuaggaaaauuuuacgucuuccuuucuauguaccuagcucauuaaaauagaaaauaggcuguuuucacccaguacaugugcuaauuuucuuaaaaaaaaaugcugcucagcucuaggugacaaccugaugacuagugaaaaggaaggcaaccucucccuuucuuuuccaaaacacuucacacuucuuauuuagagaacagauaaacaaccuugugguucauccaggacuucucuuucuacuuugcuuagucugcuauuuguaucuggagaucaugucuaaauucuuauuucuuuuguaucuuuaguguguaauacaaugccuggcacauaacagguacuuauacauuuuuaaaacugaaaauuaauugcaacacuauuaauugcuucugcuuuuuuuucuuauaguuugaguucugggauauaugugcagaacgugcaaguuuguuacauagguauacacgugccauuaugguuugcugcacccaucaacccaucaucuacauuagguauuucuccuaaugcuaucccuccccuagcccccgcgacuccccaacaggccccuggugugugauguuccccucccuguguccauguguucuuaucguucaacuuccacuuaugagugagaacaugaggaauuuaguuuucuguuccuguguuaguuugcugagaaugaugguuuccagcuucauccaugucccugcaaaggacaugaacucauccuauuuuauggcugcauaguauuccaugguguauaugugccacauuuucuuuauccagucuaucauugaugggcauuuugguugguuccaaguuuuugcuauugugaauagugcugcaguaaacauacgugugcaugugucuuuauaguagaaugacuuaaaagccuuuggguauauacccaguaaugggauugcugggucaaaagguauuucugguucuauauccuugaggaaucacugcacuaucuuccacaacgguugaacuaauuuacacucccaccaacaguguaaaagcauuccuauuucuccucauccucuccagcaucuguuguuuccugacuuuugaaugauugccauucuaacuggcgugugauggcaucucauugugguuugauuugcauuucucuaaugaccaaugaugaugagcuuuuuuuuucauauguuuuuuggccacauaaauaucuucuuuugaaaagugucuguucauauccuucacccacuuuucaaugggguuguuuuuucuuguaaauuuguuuaaguuccuuguagauucuggauacuagacuuuugucagauggauagauugcaaaaauuuugucccagucuguagguugccuguucacucugaugauagucuauuuugcugugcagaugcucuuuaguuuaauuagauccuauuugucaauuuuggcuuuuguugcaacugcuucagauguuuuugucaugaaaucuuugcccacaccuacguccugaaugauauugcccagguuuucuucuaggguuuuuauggguuuaggccuuucguuuaagucuuuaauucaucuugaguuaauuuuuguauaagguguaaggaugggguccaguuucagcuuucugcauauggcuagccaguuuuaccaacaccauuuauuaaauagggaauccuuucuccauugccuauuuuugucagguuugucaaagaucagacgguuguaaauguguggcuuuauuucugaggccucuguucuguuccauuggucuauaugucuguuuugguaccaguaccaugcuguuugguuacuguagccuuguaguauaguuugaaguuagauagugcaaugccuccagcuuugcucuuuuugcuuaggauugucuuggcuauaugggcucuuuuuugguuccauaugaaauuuaaaguaguuuuuucuaauucugugaagaaagucagugguagcuugaugggaauaguauugaaucuauaaauuacuuugggcaguauggccauuuucaggauauuaauucuucuuauccaugagcaugcgauauauuuccauuuguuugcguccucucauuuccuugagcagugguuuguaguucuugaaaaggacugucacauccuguguaaguuguauuccuagauauuuuauucucuuuguagcaauuaugaaugggaguugacucaugauuugacuuucuguuugucuauuauugguguacaggaaugccugugauuuuugcacauugauuuuggauccugagacuuugcugaaguugcuuaucagcuuaaggaguuucugggcugagacgauggaugggguuuucuaaauauacaaucaugucaucugcaaacagagacaauuugacuuccucucuuccuauuugaauacccuuuauuucuuucucuugccugauugcccuggccagaacuucugcuucuuuauaauggugaacguaucuacugagauucacguaauagaaguuuagguaaaauuuaauacuuaaacgguaaaaauuacuuucucuuaaauacuuuucuauauauaaagguuuauuuccaugagaugaacaacguauuuuuccuaagggagugacaaagaaucuauucaggccauguaaaacauacugucuugguuugcacugcauuagcauucaguacaacaacaacaguuucaauuuuaaaucuaaagacuaaauaagagaagauaaaggaaagacaauuaccaaaauacaauaaaauugaccuguaaaauguguauaucugcucauauacagauaauauguagcaugaaacauugauuuuaguuuuuuuuucuuuccaagugaucuaauagguaaaaaauguccgcuuuauuugcauuaaaaagaacugauaaguggaucacuauaugguugucagcuacuagauaaagggugcaagagaaacauauuauaaaaauguuugaagcuaaaaaaugcaaaugauuaaaauuucaugagaacaugaaauaggaauauuaauaaaguuauuucuaauauguuaaauauaugcauucuauuuuucuacauaccugcugugcacuugcaauaauacaacugauuauaugguguguaaaauuaaacauuuacuuacugaaagacguuaguuucauccccccagcgccacaauaauaucaccacauaccacuggcaguauuacauucucauccuuaauaauacuuuuaagcaaaucaagguuuaacaugugugacugucagcagaaagguguugaaaauucauuuaaaccccaggcuugguugacugggcaaauucgaaagauuacaggcuucuagaauagccaaauaauuauauaaauaauuacuuucuuacuaaauauuuaaaucauuaaauacuaccccccaaaaaccucuucugagcccuuuauucuacccuaagauguuguauuucuaauaaguacauuuauuauguguucuggaguuaauaauuagaauaaaugacaguuuuaaacaauagauacaauauaaucguuugaguaccagaaaguugagaaagaugaaauaacaauucuuuucauaaacuucucucuuugaacaaguuaagcuagaugguucaucauacaccauauaggcugcaucauaauccuucgaacucuagguuucauagauacuaucacacucauuuauuuauuaauucaguuaacauauauaaaugguuuacucugcauuauucuuuguguuaagcacuaggaaacagauguauagaaacagugugugcaugaaaugagaagcuauuauuagcgagagaacaugguauaaaagaggacagaaagaaauaaagacaaugaguuagaaaauuugaaaaugcacaguucagccagaacuuaaggacagaaucagauuuuaagaaagcaagagagaaaaagguaaagaaaacaggaggcacuuugaacauauuuugccaauauucucuuuucaucaauagugaaagcauccaaaauacacaggcgaaaucugauuaagaaaagaucuuugucaaaacugugcuuccucuacucuacuuugcaguagaccugguccuagcaccauuaucuaaugaugacaccaugauaugaaaaccaucaugcaauuagaggcagagaucagaaucaagauccauugauucuaacuagggagaagacauuuuaaagcacuugagaggggugcacaaugagugacacaaugaacaugacacaaaugauuucugcacauaaguacuggggccagaaccuuaaaaggaacuucucugaccugcugcuacuucuaccaacuuucuucaauccagagcugauaaaaaacaaaacaaaacaaaaacaaagauaugcaaauuucuaaugucugcuuuucuagucaccaggcaccaagcucugcaaaaauaaacccaguaaucagguacgcugaguuggggcacccucuggguguccuauguaaggauacugagccauccagacauuauguugcugggcuuucucucuuuaccaucucucaggagaguguagaccuccaggaugggaaauagcacaaggaaccagcaauaaugauaacaauaugaacaaaaaaacaaaacaccauauuaacaguacuguggguuuauguggccuuuuacagaaaucauauguagaguuauuuauguuaaacacagcaaggaaauugaagacaggagauaauuguaaaagggaagcaauaauauuuagauuagugauuucaacaguuuuuuuuuucccccaaaaaauaauagcaagguaagggccagucgugguggcucacgccuauaaucccagcacuuugggaggccgaggcggguggaucacgaggucagguuuucaaggccauccuggcuaacacggugaaaccccgucucuacuaaaaauacaaaaaauuagccggacgugguggcgggcaccuguagucccagcuacucgggaggcugaggcaggagaauggcaugaaccugggaggcagagcuugcagugagccuaaaucgcuccgcugcgcuccagccugggcgaaagagcgagacuccgucucaaaaaauaaauacaaauaaauaaaauuaaauuaaauaaaauuaaauuuaaaauaauaauaauagcaagguaagauauuucaaauuuaaagauucucuggucaaauauaaaggucuuucuuggauauuuuucuuggagacagggagaggcauaccucauuucauuauauuucauuuuauggcacuucaaggcuauuguguuuuuuacuaacugaaaguuuuuggcaacccugcaucuaaaaaucuauugugcccauuuuuccagcaucuccucucuugcuguuuuugugucacauuuggugauucucgcaauauuucaaauauuuucaugauuauaucuauuguggugaucuauacuaagugaucuuugauauuacuauuguaauaucaaaccaugcuuauauaaaccaugcuuauauaagauggcaaaauugacuaauaaauguugugcugguucuggcugcuccacccacuggcuguuccccaauauuguuuugccucaggaaauaggccucuugaggcuuauuauuauuauauuauuuuguacuagaaagggcugaaaguuguaauugcaauugcaaguccacauuuauuaaaaauaaaccaaaauuuauaaaagaaaaccaugagaaucaagauauugaucuugcauuaagaacauuuagcuuaaaauucaguugaauuuucuuaaaaaacaaagaaauaguauauuaccauguggaaguuaacauuuuaacacaguugguuccuacuugagaguuacuauacccauaacagguucacaaagagcaauacagccaccacuugggcuauuuccaaacagucuaauauaaacggcauguuagccaagugcacaaauuaaguaaaucaaaguuccuuugcuuuuggccagaauuacaacugaaaguggugaagaagacaacuucauucugaucagaaguuuuaacugacuaucaaucaaaaaguaauuucugagagucaucuuacaacaaagaauccccaaacaauaaaaacggggguaagaacauguucuuuaaacaacagaaucaucacagacaaaagcaaggaauauguuugauuuugaaaugaaaaguaccaucagggcagcccacuuuucauucuuggcacuuuagauauuccucacaaaaaaugcuaagcauauuuauagcaaugugaacaagugagagcugaguuaauuucaaauccagacacaaaaaaucugaggcuuagcuuuaauucacaacaaguuuuacaauucccuccacguaucaauaacaugggaguucucaaaaucaaacaacaauaaggaaaggcuguugcaaccagaacacccccaggcuuagcucugucagcaguggcaaaggaagaucaaaccuacaaagacaguagaaacauuaccaucaaaccucagaucauuaauucauaaaaguacagccuuacaacacguuguacuccauuaguucuauccugacaaggacugaagaugucguauuagugauuacacaagaggcaaaaccaucaaguuuaacuuacuuaaauuuuaacaguuuuuuuauuucaauaaauuuauuuugaugguugaauuguuuaagaggaaagaagaaucuguuccuguuuuucagcuuguuucuguaacacugugcagcaguaauuaauccuauacaccuuuauuuaaaacacuuugccuuuuagaugcgauuuuuuuuuuuuggggagaccaaaugucaccagcuuaucaucuacauugauaguaccauucucagaacauuucucaacugacacuguauggacauacuuaguaauucuuuucacauaaagcauuacauucugauucaacaugaaauuuuuaaauagcauuauuauuaauugagaagagcuuccacucaauuccauuaguccuucaagugaacauuaaaggaggcuucagguagcuagaguuaacuuguuguacucuggaaagaggcagaguuucaauguucaauaggccucccuauucccugaggcaaaacaauauugaaauuaggccagugaaaaguccugccguggccucuaagaauucaagugaaaggaagaacugcacaucccuuauuuuaaaaucaaaacuagacacaauuaagccucaagaggaaggcaugcugaaugccaagacagggcaaaagcuaggccucuugcaccgaauaguuagccaaguuguguuguagaggaaagguucuugaagguuauuaaauguguuacuccagugaacaccacagauaauaagaaaaccaaacauucuuguugaugauauagagaaggcuugagugaucuggauagaagaucaaacgagccacaacauucccuuaaaucaaaaccuaaugcagagcaagaccccaacucucuucaacucuaugaaggcugagagagguaagaaagcugcaaaagaaaagucagaagauaacaaaaaugguuucauggguuuuaaggaaagaagccaucuccaugacacaaaaguauaaagugaagcagcaggugcugauguagaagcugcaguaaauuauccagaggucuagcuaggaucauagaugaaguggcuaaaccgauuuuuaguguagauauaacagccuuauacuggacaagcacgccaucuaggacuuucauagcuaaagaggagaagucaaugccuggcuucaaacuugcaaagaagagguugacucucuuauuagggacuaaugaaacugacaacccuaagcugaagucaaugcuuauuuaccauucugaaaauccuggauccaguaaauuuauacuaaccuauucuucauguguucuauaaauggaacaacaaagccuggauggcagcacauccauuuauagcaugguuuacugaauauuuuaaacccacuguucaaaaccaaguguucagaaaacaguauaacuuacaaauuaugacugcucauugacaaugcgccuggucacccaagacauccgcuaaagauauucaagaagacucacauuguuuucaugccugcuaacacaacguccauucuacgagcuaugaaucaaggaguaauuucaacuuucagucucauuauuuaagaaauguauuucuuaaggcucuagcuaccauagacagugauuccucugaugaaucugggaaaauaaauugaaaaccuuguggaaaggauucaccauucuagaugacacucagaacauucaugguucaugaaaggaggucaaaauaucaacauuaaaaggaguuugggagaaguuuauuccaacccucauggaugacuuugagaaguucaagacuucaguggagaaaauaacuguggaugugauaaaaacagcaagagcauuagaagcagagccugaagaugugacuaaguugugguaauacuaugguaaaacuugaacagauaaggaguuacuuguuauggaugagcaaagaaaaugauuucuugagguggaaucuacuccuagugaagaugcuauaaaucuuguugaaaugacaauagaggauuucaaauauuacauaaauugaguugauaaggcagugauggaguuugagaggacugacuguaauuacggaaguucaacugugguuaaaugcuaucaaacaguaugacaugcuaaagagaaaucuuuugugaaaggaagagucaaucaauguggcaaacuucacuguugucuuauuauaagaaauugccacagccaccccgaccuucagcaaccacuacugugaccacucagcagccuucaacauggaggcaagacucuccaccaguaaaaagauuuguacuuguugaaggcucaaauuauuuguuagcauuuuuuaaccaccaaagguuuuacuuuaaauuaaaauauguacauuuuuuagacauaugcuauugaauaauuaacagauugcaguauacuuuaaacacaacuuuuauaugcacaugcacugggacaccaaacaucuuugugacuuguuuuauugcaauauucacuuauuguggaggucuggaacugaagccacaguaucucugagguaugcauguauauuaaugugaugaagggucuaaaauauuucacaguaaauaaaaugucucauuuuuaauuaacagaguguuuuucuaacugaaaaccccuaauauaguucuaggcauuugaaauuaaaaaaaaaaugagagagccacugacuauccaguauugccucaguaauguuucuuuaaucaaaaauauuuuacuaaaauuauuuacagucuuacauuauuuaaaagucuugcuuccuaagaucuguaaaauaugcuuucuguacaaaacaaauuaucuuaaguucugaggaaaauauuuuuuauucaaauauguguaaaccacaccuggcuaaaugguauucuugucucuguugcuugauauuuagcacuauaaucaaaccauauugcagcguucacagcuucugaugagcccuaaaugaggcuccaucaaucuggcagacuauuucaagaguagaacuaaagacaaaaaauaucaccuuucuucuaaaauaaaacucuacuccaccaaaugcauccaaacuaaaucauuuaaguaggaauaauugaaucugggcauuccuuaaggauuauuccugagccauaaucugccccagcuggcucuaauccuuacuaaaugauauguguccuaagaauauuaccagcacauaaugaaaauugaaagguauagaaaauuaauuccuaacauacuauuuaguaacaguauuuaaaucacuuaucuaauuuuauuuuuaaaacaauauguuuaaaaguauaauacuuuuuaaaaaguguauugcuuaugauccuacaccuauuaggauaucacaucaaaacauauauuucauaaaacauuucaacaucacauuaauucugucauuccccucauuauuugaaagacaauauuuuucucaacauucauuuccuauuuaauaaaaacaauaccuaaaaaguaauguuuucuaccuaauaacuauaacaaaaguuuuuagcagccauuaugguuguuuuauuaagcacugcaaccuuccauuucucuaaucacaauacugucauaugaucuauugacaacuauaaaaucauaaauauagaauuuuuaccuugacuuguguuguaaugcaaaucaauuauugggucaggaaaaaaaaggaagcagacgaaauauuuuuucuuuugucuuuauauugcacuaauucucacauggccaccuugagaacccucuaguauucagugaaggauuugauuggccaaguacuuagcuucuguauuggaaagugacagguaaauguuauauauguaaaaucaagaggugaagauggcaucaugaaagaaaagaagccaggaaaaugacaauuugguuaggguugaguaacucagguggcgagcucugagaacuauaacauugaauuggugaaugagugaguguauuuuuauuguuaaagaaaaaaagaggccgagcuggguggcucacgccuguaauccccgcacugugggaggccgaugugggcggaucaccugaggucaggcuuuggauuccagccuggccaacuuggcgaaacccuuccucuacuaaaaauacaaaaauuagcggggcaugguggcucaugucuauaaucucagcuacucgggaggcugaggcaggagaaucgcuugaacucgggaggcagagguuucagugagccgagauagugccacugcacuccagccuggggcgacagagugagacucagucucaagcuaaaacaaaacaaaacaaaacaaaaaacuacccgggagugguggcaggcgccuguaauccacgcuacuugggaggcugaggcaguagaaucacuugaacccgggaggcagagguuguagccagccaagauagcgucauugcacuccagccugggcagaaaagagcaaaauuauguccaaaauaaaaaaggaagaaagaucucuguggccaaauuguuguguuuuuuucuuauuuguuuuuguuuuuuugaaaaggccauauuuauuaucccucuagaauauauagauacuaauugguauccuuaaauaugaauuagaaauauguugaaacgaaacaaacacuuucuaugauauacaguuauaugacaaaauuucaaaauucaguugccuucagcugcagcaguagcuaaaaucagauaauuauaaucauucauuauuuuuccuuugugacaagaaaagucgaaacuaagcuuuaguauuugauaucuagucagaagguggaaaaaaauuuguucacugagaaaaaaaauauuauggacuagaauguuuaugauuuaaauucugucucuugaagacaucuaagauaaagaggaaaaacuuuugcaucaucuuuacaggaaaauaaagccccucaaagaccaguuguuaauagguaaucaagugcaagcaguucuuaauacuccuccaaaugcuccaccaaaaauauuucauuuucaucccuaccugucuacuuaaucuugaguugcuuugggaaggucacauuaucacagaacgggaauaaacacaguuugcagaguuagccugacuugagauccugauuuccuguuugcauccuagaaucaugaguucuguaaaaaauucugaauccaaaacuggacaaaaaauuccuuggauuuuuauacauacaaaacuguguugaacuuucuguuugguaaaaaaaauuauaaauacacaauuuucuuuuauucuuauauuuaagcuaaguuaccuacuggauuccaauuggauucauuaauucggagcacuaugagauucaaaagcucuuggccaaagaacaguugcauacuugacuuuccguaaugaggaguuucaccacuaauccagguagaacaaauuaacauagaaacauugcaugauguuuacuuaacuucuccugcacauuguguugaaacauuugaaugugauuaaagcuuauuuuuccuuuugugacugagauuuuuaaauuaauaaaugauugauuaguugguuuaaauauaauugaaagucucuuuguuuuaaauaguaaguuaggcccugggaauaaagcuaugaauaaaaaugacaaugguucccuugccuuacaggcaaguguauaugggaucucuggcagaagauaacacuuccagaacaaaggugcuuugaaauucucugaagucagcuguauggguauacacugcuacuaguccaccuggcuauacauugagaagacugcuuagcacuuauuagggcuaauguuuauugugggcuuagaugugccagauguaguacuauuuacuuuauuucauuuuuuccuuucucagucugaugccuaugaagaaguacuauuuugggugucauuuuauuggugucagucaaccuucacaagggucagucacaucaguauuuacucugucuucccugauugggagaggcaaaguaucaauacccucauaccuccuacuuuuaaaaauauauauacuuagaaagauaguaucauuaacaguuuugaaaauaaaaucaccauauuuuauaucuuuuuucuagucuuugucuauauacauuugcauuaaacgaaauugaaaauagaauauacauacaauucuauaugcuuuuaacaguuugaugucaaaauaagauaaagcucuagaaagccagauaauuaugcuaaucaagaguaauuaauuuaaaaugaugccauuucccucaaagcuuggugagcagcaaaacgugaaauaacauuuuguauaccaacagaauuuagauagccucacggguuuguauaaaugggauuuugucuuacaugauuucauccucauuugaacucuugcuagagauuuuccuauucauuuaugacauucaauaaaggcuaucuucucuaauuccuuguauggaugucaucucucuaaaugauaaacuuugagcucagggaauauuauuucuaucacuauauaucaugcaaauaaagaauucaauaaauauuugcuaaaagaauacaugaauauaaaaagaaaaaagugugauucaguauaagaaauuuacaaauaugcaucauaaaacagaugucacuguuuugcuuuugaaaagagccacgaaaucuuaaacaagcgguauauccuacagaaguaaaaucaucuugaacuucuuaauaauagagacuuuuaaaguucaaacuaccauccagguacucucucuuuucuccccauccucuagccagacuuaucaacaaauaacagacaccaauauuacucuaaacaaacaauaagaucaaauuuauugaagucgaugaaauguacugcugggcuacauaaaaaugauuucaaauauuuguuuuuuaaaaauacuuuuucuaaacuacuaucaccaucaguuggaacagaugagugaagcagauauuugaaagaugacugaguaaaaccgccuccuacacugaauaauaaacauuuuuaauggagaauuaauguaaugcagacaauguagggaaggaauuuuucuuuguucaagugacauccugguuaaaucaaccugugaaaguagauaucuaacugcuucuugaaaaacucuucucuguagaagaauuuaacccaguuauaucaaucacaacugccauguugccuuuauuuuuauccuccgauuucugaauuuauguccuaauuuugaaugguacaaauugaguauuuguagcaaagcuauugaaauguuuagaaauaccuggggagcaagaaacaccagacgguuuuucuuuucuggucuccaacucuauaaaacuuaucugagaagaaguaaauauacugagcagaggauuuaaaagcuuaaggagaguaaaauauaaaaagccuccccaaucuugaaaucuuaagucauucuccaaauuauaaaguagcuaaggaugcuugaucuuugucccuaaagguguggcauaaauccaucaacauggacuuacaaaccacuuugcaggacuauaugguuuucagagugacaggacacacuaaugaacuucuuugugaaauucugauaaggaugggagguauccugauuguagccugguuaugcugacuguagaagaacaaaagaacaaacuguauauuugggcugaugcugaccuggauaacuuaauucucuuuaucuuguacauaagaaugugugugaaguaaggcaagauuuugaagauuauuuugauaaaugaugccucgcucauccucauuacucaacuaguguaccuccuucacggacucagcacaguuacaaaguuacuucagagcuucauauugcuccacacauacaaucaaggagguuaaaauuacugagaguuuucugucuuuagagaaaaaacaaugaggaauauuuugcuccuggcuaaacuuaucccuuuuaaauagaaaauccuugccugaaggcagaaugaaccuuugaaaacugcuuaagcaauuuccuaccuuagaugcaguguacuaaccuuggacucugccuugauucaacaaggaauaagaaggcaaaauuuuucucauuuccuugucauuuaaguuuccuguugagacucuauacauagauugaggucccagaguuagcaugaaguucuuuuaauggagaguuuuuuaaaaaaauuuguuuuguuucuuauaaauguacacagccaagauauuuuaaaacacaaauaaaaaccauaauucacucuugauagauguugaaguaacauguucuccuuuacuuuaaaaaauacaauuaaaauagcacugaauaaaguucaauauguuuucagggauuaauucaauucaaccauguuuacuucucacuucuauauuuuauaacuuaugauuaaauuuuucucaaagcauggcuuacaguccaccaacauuggaauuagcuugcuacuugcuaaaacuauaaauucuuagucucuacccuguccucccuguguguucugcugcucccuguggguuuuguaaaaauaaaaacuaaugaaucagaaucucuggugauaaagaucucagaugaugcauuuuacccauuuuccugguagauaagaugugcacugauauagcugaacuguaguaauaaucaagaaaauuggguuuuuggccgggugcgguggcucacgccuguaauccuagcacuuugggaggccgaggugggcgucuccacaagguuaggagaucuagaucauccugguuaacacggugaaaccccgucuuuacuaaaaauacaaaaaauuagccaggugugguggcaggcaccuguagucccagcuacucuggaggcugaggcaggagaauggugugaacucuggaggcuggggcggagcuugcagugagccgagauggugccacugcacuccagccugggcgacagagcgagacuccaucucaaaaauaaauaaauaaauaaauaaauaaauaaaauaauaaaaaaaaaagauaauuggguuuuuuuaauuucauaauuuauaaauuugcuguucgaaacagagaauccacacugucaaaauacauaauuuuaaauauauaaggugacauuucuaaacauuacaaagggaucacucuggaaauugaggauuaaaugacuucagagcaaaaagccaaaaauauuagaauuuuaauauuauaguauuugguauauaggagauugaauugagagcguauuaagaagagaacacuguaugaccgugaaugcuauuuuagugucccacauguuuccaggccccaguaaaggcgcucucugcuaguucaaauauccuuaaagcaagaacuuuccucaauugaacuaauagaguugggaagcauuuuuuaauccaucauaacaccuuacacauguuguaagucuucaguaaaugcuuaaugauuauugacaaaaaaaagucauuuuuauuuauucuagguagauaugguauuugcuuucaaauuuaauuaacuauccuaaaacugcaugauuuagaauaauucauuuuauuucucuggaucucaguucccucaucuauacaauaaaugugauauuaaaucaguguuucccaaaauucagcccacccccauguauugugccauaucugcacaccauguauauuauuauuuucuucaaaauaauauucuaaaagaauuagcuauauuuuucuaacaugcaguaaaauuauauuuauuaaacauuuccagauguucacuccuacacaaccaaauguguuguauugaaccuuaacuuuacaaccuugcuuaugaaaaaauacuuuuggccgggcgacguggcucacgccuguaaucccaccacuuuggaaggcugaggcagguggauuacgaagucaggauuucgagaccagucuggccaacauaaugaaaccccgucucuacuaaaaauagaaaaaaauuagccgggugugguggugugugccuguaauaccaacuacucaggaggcugaggcaaggagaaucgcguguacccgggaggcagagguugcaguaggcugagauugcgccauugcgcuccaaacccgggcaacagugugagacuccgucucgggaaaaaaaaaaaaaaaaaaaaaaaaaaaccuuuugaguuaauauuuaguuucaugaauuauccuucaguugcuaccucuaguuccuuggcacacgaaauuucaccguaaauuuaaacaauauuuacaucuaauaaaguccaguuguuuucuaauuacaaaacaaaauguuacugauuuuauggauacacacuugaauucugccuaaaacaaauguuuaaaaaauuaugugaaugauuguaaacacuaauuaccaacaacaaaacaccaggucugcaucagaaaguuuuugaaaaaagaaaauaaaaugguuugaaauacuuaaaauuaauguuuggaagacaaaucuuugaagagugaugcaauuaucugaguaccacuguaacuuaauugacaacaauuuuaauuagauuuuuuacaucuacaagucagcuugucaaaguccccaaacgcucauggcgugcauuaaaugggucuggugucuuuucauauagaaaagaugaaaaauauuauuuguagcuucugucuuuaaauucuaaccuuuacucauacauacaaauguuguaauuuuuuaaaagcuaucuaauacuucgcuuucaaaaguaauggaaaguaggaaaauaauugaguacucuuuggauguuuaaaauaguguuguaaaagucauauugaacccaauuuuuauuuuuucuuaacugcuuaucacuauuaauuagauggagguaugacauuuauuugaaagcauagacgauaauauuauauuuguuuuaaaaugaacuaaaggcuaaugaguaggaugcuauccgaaucauuucauuuuaauaaaguuaauuuaaucuuucauuuuauuuugaaugaaugucuuaugcaaaauacucaguccuaucuucaugaagaggcuacuaauuggaagacgcuacaacauuugaaguuacaguaaauaaaguaaaacaagacgaaaucagucacagacugcuacaaaagagcccaaauguugugacaauaucaauuauaugugcagcagaaaaucuggauauucaaagguugaggguuuccaagugagaagggucccuuuaucaguuccugcuccuuucucuuccugaguguaagaagaauagggggaaguagaaguuucaggacagggcucuuuaauaagaauuagaggaggccgggcgcaguggcugacaccuguaaucccagcacuuugggaggccgaggcagguggaucaccugaggucagguguucgagaccagccugaccagcauggugaaaccccgucucuacuacaaauacaaaauuagccgggugugguggcacaugccuguaaucucagcuacucggguagcugaggcaggagaauugcuugaacccaggagguggaaguugcggugagccgagaucaugccauugcacuccagccugggcaacaaaagcgaaauuccaucucaaaacaaaacaaaacaaacaaacaaaaaaaccucaauuagaggauguuuaaacuaguaucaaauucagcaagauuucccucccucuaccucucuuuuauggauaggaaaucagaaguaauuuuagcuuuagauauacaaggcuuuugacaauagaagcguaucuaaauuuuuaucuuuuauuuaucuaauguaaaccuagacauaaaaaucaagauuugaauguagaauuuauacuggagcaaggugaguucaaguccaauuuuaauaauauaacauuuaaaugauuuuuuugaaaauacauauaaucgugguuauauuaaaaaaaaaguugaaguuagaaugaaaaugcugggacuggauccuggcauuucaauuugcugcuuccuuaagacacuugauuuagcuaaaucucuguuuccucauuccuaaaauaaaaguaauaagaucuauucuaccucaguaaaugagucugugaaaacuauacuacauaauagaauugaagagcuuaauaaacuaaacaucuaaaugauuacagacugauauuauaaguacaauaauaaauauauuucaugauauaugauccaaagaagcacaaucaaaccaaacaaaaaaauuuucauuuuaugaaauuugagcucuaucauaguccaauuucuuuauucuuauacucaauacuauuauaauacuauauuuucuguugguaucuguggaagcuaaagcaauuccaucuuggguacuaauccaccauguugacuucuaguuaacuccaguucuagaaaggccucuaagaucuccaguuuaucuuuuguuucuugaguaagagcauguacuuaccaaaaauuaccgcauuauuucaaaacagcuuugaccauaaauccugcccuuaggcauauucacagagcaccuuugccuuucccugcaauuguccuacacauucuuucccuaugguauauaagcccuggguccaagggguaaggucacugagcugugccagcaugucucauugcuggaggcacaggcauggcuucuguucaaauuuccuauaaaauguuucuuucugagaacaauauguucaccucuuccuuaagccucuuggcuuccucugacuuugaagauauacuugcauggauuugcccccugcagaagaguauuaacauuuuuuuuucaaauuaaaauaaugauuuucuuauuuuuaaucauccaaauaauuaauuuucaauuuccaucauuuaauucuacaauucuagaaaaauuuuagguagaauaaaaacauuucuccuuaccaaaaauaugcaguauauaauuaaggauuuuucuucauggagaauuccauaaauuaagcuugauuuuuguuauuuucauauugcuaguuuccuuuuucuaagaugaaauuggaaaguuuucaguuuaacuaauugccauuuauaugucuucuugguuauuacauuugaacagcuuucuucauauauucuuucuucauaaauguguucauaaauugauauuaauaaagaguaauguugauguuuggcauacauuuucauuuuauccuaauaaauuguuaacauaauuaugauaugaaacaagcuguaauuucucuacuaaaaauaaguuaauaaacauaaaaauuauucuaaaucaauuucagaaacuuucuucucaaaugcaaaguuuaaccuauauguacacaaauaagcacaaacacacacacagacacacacucacacauacaccugaccacagauuuauuggagaguuuauuucuuuuuauacgcaaauuucacuauacauuuaauugaauaggacuuacucucucugaaacaccaaagaaacucacaggaaaaagagccccucaagguaguaaaaaacauuuucauuuaaauuaagcaaccauuuuauccauagaaaacauuagacaauauucuuuccccugucuuucacaguauggagccaagaagacuuuuguacauuuuguugcaaugugucucuaagucacugaacucugaaaacuuaaaauuauuaccuuggaaaguugaguuaaaaaaaauucuaauauuugccgguuucgaaaguggaguguaagucauuaaguuucuaaauuauuggcuuccuauacccucuucccugcuccuugacucaugagugucaguacucugcccugaugucauagccaaagagaacccugaauguacagcuggcauaaauaccaggacaugguuuuuaaacuucugguaacuaacuuaaaacaaauuguaaucaauuaacucaacuguauuuaauagaauaauaauugcaucauguuagggaccuucuagguuaaguuauaauuuucauaugcaaaacaaaccaaaacaaaauaaaaaaucugaggccuaaagauuuacuuaaccuuuuaacuuguuacauuaacagaaaaaaaaagaaucagagaaucccaguggcuaaaugaccauugaaguuauuuaguucuuuuaaaaaaaaaaaguaaauaaaacauaguuaacaauuauaaaacaaaaaaauaaaaaagcaaaacaaguuagugaccaagucagaauguuaaaccaggcaucgcaacuccaggagagaagacuuuuuguuucuaucuaucuguauauuucuaucuaccaacauucuguuuaccuaauacauguuuuaaaaaaugaaaaagggagagaaaugggguguagggggagagaaggagaaaauacauauccauccaucuuaaugaaaaaaauguuuagaagaauuuuuuauuuagcacuuuugaauaguacaauaaaacaccagauaagaaagggaucauuaugugcugauguuaucacaaguuauucauaugauuuuauauuguuuccugucacuaaaguuauaaacacaauauauaagcacaauuacacacacacaccuuugccauauacauuucagcaaccuaauuuuaaacuguaaaaucuaguaaagauuauuuuccccugccccuugguagugcuauuuuuuucuuuuaucacauguaaugcauacaacaauuuccaagcauugaacaacuucauauuucucuacuaugaaagaugaacuauaauuuaauaauugaaugccaucuguuaaugcuuuuuaaaauaauuccuguuguucacuauguauuucuuuuuuauuuaaaauaaacuaaaauaaauauauaucugaaacauauaucucaccuauucacauuauaauguuuaauucuuuucaauaggagugaucaaugugauacacuugagaacaaauuuuggaaacacuuccaaaguauucauuuauucacuacguucuuaugaaacaccuaaauacuguaagccaagcccuguucugcauucaacgugaauaaaauaacaaaagugcuguccuuauggagcuuaaacuccuguggaagaggaagaugaacauucuaaaugagagagagagagaaaguguguguguguguguguguguguguccguauaauguacuuaauauauuauauauauaguuuauagacauuaugguuuuuuuguucuuuuuuagagacagagucucacucugucacccaugcuggaguagaguggcacgaucacagcucaccacaaacuugagcuccugggcucaagcaauccuccugccucagucuuccaaguagcuaggaauacaggcaugaaccaccaagccuggcuauuuuuuuuuuuuaauuuuuuuguggagacggggucucacuauauugguugcucaggcuggucuugaauuccuggccucauguaguucugccuuggucucccaaaaugcugagaucaugggcaugggccacugcacccaacuuauaguuaauauucaaguauauaaugcacaaacauuucagaaaaugauaguugaaguuaagguggucuggaaggcuucuuugaauaggagagacuugaaugaugagaaagacacaaccaugcucugacuacuuuuaggggaagaggauuauagggagagaaauugcugugauaggugggaaagagauuggcaugaucaaggaaaggaaagcugaacacucuggcugaaugugguugagguggugaauaaugcaaaagaaagucaauaguuuucagcugggauaaugucgggcuuuauaagccaggguaacucaguuguuauuuauucauucccccauuaauuaauuuuaaaaaagaauguuagaucuaccauguuuuggacaccaaggacacaaagaugggcuaagaucucugccuguuucaaauagaagguauacaugagccauccgaacuaccaguugcuuugguuauuuuugacagaaaacuucgaucagcucauuauauccauguggaccucaucugcuggauuuuugaaauuuaaacuauuuaaauguuuuuuggguacugccucacauaugacugcuaaaagcuucuguauugaguaccuauccauuucaucgugauuacacuuuaugauaaauuucaucuugaauuaaucacucguuauauugcuauaaauuagacauuaaaauugcucagcuaaugacaguaucaccaguaagcuguaauuacuguaagcgggauguaaucuaauguuuuuaaucugucagaugaaaaauuuaccccuauaaauacaaaaagaaagagagaaagaggcagagauggacacacagaaggaaacacauauuguucucacauuuauacaaaauuaaaaguaauuuccuuuagaggccacagaaaauuguauauacuuaucauccuaauauguaauuuagaugucauagacagggaccuagaagaaaaucaaacaauuugaaaucccuuauuuacauuuccauguuugaaaaaaguagauuuuuuucaugcaucuuuuaagcaauauaaauagaaacauauucuggcaauauuacucuugauaaaugcuaagauguaccugccaacuuauuuuugacauauucuuuagaaguuaguucaugaaauuaauaggguguuucuacagauuucauuguaaaacauuauccuacacacacacacacacacacacacuacauaaaauguaguuuuccucugcucuuucaucuacaugucaaacacaauuuaucaaaagacauaauacaaacuacuauaaagauggcacaauuuagaaacuagucacaaauaaugucaacauacugauugccuuuguuguuuuaaaggagaaagaauagccuacuuguuucuauuuuaaucuuccacuaaucuguuuuaauaaaacuuugaauuggcagaagaaugaaaucuuuagagaacaaauauuuuguaauagauaaauucguauguaugggagcaaaauaaccaaaaucucugguagcugcgucugguagggaaccaaaucuccuaaggcuuaauaugcuucagguuuguuaugagguuggugugaaaggguggguacggguauuuuguuuuucaaauaauucugcccaugaaaauucuguguagcuaagccccaugauucaaaaccaacccuguuguagaauauaucuauucaaagaaguaguagaacuagcacauuguggauugucuuaauauauucaaaguuuauggaguaauagcaauacauuagacuaugaaauaguuaacuugucaacugcacauuaaaaaaagaaagaaagagaaagaaagaaagacagacagacagacagacagaaagaaagaaagaaagaaagaaagaaagaaagaaagaaagaaagaaagaaaaccuuucaguaucauuugccuaucaccuacaccaaaaucucuucugagccaaaguacaaccaacugugaaaaugggacccaggaagcuuauguaaccuggauuugggaaucacuacccugugaguugcaguuugcugaucuguuaaaugauucuaaugacuaacauuuuauguauauuuuugcaugaugguauuccaaacacauuugaauagcuguacauacccaacaauauaucuaacugguuucauauagacgaagcuucaacaaacaggacaauagcaaaucuaguacgacagauacccuggaaugcagaucauaggaauuuuuaagguuccauugagcaaccaaguguuaaaaauccauuuuacugauagccuuuuaccaacacauuaacuacuguucucuaaagcuugacaugcaaaaaaaaaaaaaaauaauaguacagcuaaacuucucucugcauucagggguuccauaaucacuugcucaauuaccauuuuugacugacuggaguacucaagcuaaauuagcauuagcauucuuaguuuuguauguguggaacugcacugucuucucugauuagaauugugguaucgccauuagauguggcagcagagcacacugcucuuggugguguuugacauauuucacucuagcuuucuuccuugauucuagugaauaaaggguuuccuuaauugcaguaaggagaaucaauagcacuuuuuuucagugacuuugugcuaauaaacugcucaacuaccacuuaggauagcuguuacuuugaauaauuauaaaagacaaugggauaaauuauugcagcgcaauaaccaauauguuauuaauaaaaaauuuaacaaccauuuuuaaugauaaauggaaucauuuacaugauguauuuacuauguaaaagaagaaauacaguaucgguauucuuaaauuucuuaaaauguaauaaaaaucauuuaaacuacuaagccaucaaaaagauccacaggaagacugaaggaagacaugauaauaugauggacauaaaagcuucauugaaugagccauuaacuacagguuuaauuuguuucaaaaaacagaaugccagggguuagcauucuaugguaauguuaaauaugccagagaauaugugaguuagcuaucaaaaagaggauaacaucggccgggagcgguggcucacgccuacaauccccgcacuuggggaggccgaggugggaggaucacgaggucaggagaucgagaccauccuggcuaacacggugaaaaccgucucuauuaaaaaguacaaaaaaaaaaaaaauuagccgggcaugguggcgggugccuguagucccagcuacucgggaggcugaggcaggagaauggcgugaacccgggaggcggaccuugcagugagcugagaucgugccacugcacuccagccugggugacagagugagccuccaucucagaagaaaaaaaaaaaaggauaacaucaaugauuucuaacaacaccauuugguucuuaaaauuaucuuuauuaaaaauuguuuacucagucugcugacaccaauuggacacuuauuuccuaggcaugggacaaggcaaagaaggcacaaaagugaauacuuaccucugaauagaaucugauggagagggagaggcuguuagguaagcagaauaccaaaagcaguauggaagcuucuaaagauuuguaugaagugauacggaugacagagaaggaagcaacugauaaguggguaagaguguaucagagaggcaacaaguaaggccaucuaugucuguaucaacaauuugagugaugauggacuguaaaauccuacugaaguucugacaacacuuccucacaauauuccucucacuaucccaaauauccucaacaugugugcaguaucauucacagggugccggaccaagagaguuuuucagguaggccaugauuugaaaaccaaagaaaucuaucuugccuuugguucuguaaaugaauaauaacugcuuacaugucuucuccauuuuuuaucaauuuacuauuagugauagcugaaauuaauuuuucauuuuaauuuacucacuuuuacaaaaauaauucaucacuaguauaugauaacgauguuuguauuuuugcaagcugucauguuagugucauuguuuguauugcauauuuucaaacaagaguauuuuugcuuugccguuucuugauaaucaaacuguaaaacacauaugcuuuauggccgaaauauuauucagucagucgucccauuuauucaguggcacaaauauucauucagucauucaacuuauuugaaaaacacacgggaucuuauuuuuguacucuauaucaaauuggccaaagagugaaacugugagugaauugagucacaacauacuucaucuagagaaaauuuuacacaccacuuuagccugaagggaauaugauagcaaggaucagauauguaugucuaaugacaaaauuuuacacauauauuuauagauuaggcaaguuauagacaaaggugcuuguugacaacuggcagaagaauacaauuaauuuucacauuuuuccuucaggaauguuuccuucauccuucugaauauuuccuuuuguccaacuauuugugccauuuuaauagaucacaaauaguaaaaaagaccuuguauuuuauuacuucaauaaccuauuccaaaacauccauuuguuagacaucaucucugaacaucaucugaugaauucacguuuauaacaggguuucuuucaaacuagagaaagagaagugacuguguaaauauuaugacaguaaaggcaggaguuuuugaaaauaaacaauuggugcucuaggguucuguagaaauaauuccagggauuauauacaaaggggaccaaucuauccugucagggaaccucaaaccucacucgaguuaagacaacaaucuccuacagauuuuauaccuuuagcuucuauauugauuuaauacaaagacaaguuuuguagguuuaguagaauguuugaaaaucacuggauaaugaagucauuaauaaagacagcaagaacaaaaaaaucuauuggcuguaucaaauaaauuuuggggauccaggaggggagguagacggguuaguuaggcaauaaagcaaugcuauuuucaaucagaauauuuccauaaacugcugaauuuauguuccgugauacagguugagauaagaugucuuuguuuauccagguacuaccauuaucuucacaguagucuauggugucccugucacuggugaacuuguaucuuuucccaugacaaacaauaauguaaccucuucacaucagauggaaaggccuaguaguaguaucuauguaucaauggaugcuauacccuuccuaauaucuggaaggcuacaaaaggcaauagggugugguuuauguaguucauaucugcaguaguauuuuguugcuauaaaugugcuuuugcuugugacugcaaaguccaguggggaaaugucaaaagaaaucaaggccuugaugcaugaccugcaugaguuauccuuccauaaaggaugucuguuuugaagaaauuuuguuauuauuccagauggcaguacugucaucuuggccacaccacauguagcacauucaggaaucauucacugugucugguggccuggaaaugauucugcuauugaaaagacuguaacgaagugucagcauaugccaagcuauucaguacuguccuccaaaagaacuucuuuucccaugggaagugacuaagaaguuuuggucaacaauccaaauuucuuuugccagacuuuugaaaaggacagucuucaauguguugaucuuguucuuggcucagagugaacccagguuuaugucaaauggcagcuaugccuguuauuguaaaacacugcuagucagguacuuuaguugaauuuaaaugauuuauggauagacacguuauguaacuguuuaauuuuauucaucuuauuaaugggaagcaccuugaggcgugucuauucuguuacuaaauggaaauaaaacaguauuuacuagucuuaauuguaaccaucuaacauggguuauuuaauccuuugaacugaauggcugagacuuuugcuaagccuguggagcugagagaugaauccuuuucacucuaauugaggucauagaucuuaguuaaauaacaucgagagugcgaugaucucagggcaccauaacuacacugacugacuucaaugauguuccuuccauggugaccuaacaauagcaaaacuauuagaaaccuccacucuaaaauccuguggcacggaauuuucagcuauacuucccgacauguucucaaaaccauaaaaugaagacauauuuuucauaguacaguaaaaaugaugaaagugaagauacacacuaauacuacauagagaaagcuucacaaauauguacuuacccuacugguuaaaagcugauguggaauuuggaaugagggcugcagaguauuugaagaguagaugagcaggcugcuguaauuuaaucuugauugggacauuuuccguugucauuuauugauauccacuuuugucauucuaguugccugaauuuauaaacuaggggaacagguuaaguauuuucacaggcugcuggaggagucgguggugugaauaagugauuauuucaaaacuucauagggacuguaaugaaaggugguagguacaguacagagaggagcacaaagaggacagugcaaaauuauauuuaagaggauggaguuuaaaaggcaauuaacucacuauggacaaacgauauguguguaggaaaaauguagaaauguacauguuggcaaaguuaaguguaaaaaauaaaagccuaaaucaaaagauaaaugaaaauucagucuuuuuucaucagacagaaaaacucuaaaguucugcacaacgcauaacuccaagacaguuucuaagauuuacuauuuuaagcucaaagacuuagaaaguuauuuagcauuaaucaguugauagacuaaauggguaagugccgagagaagagcuagugggagauaauuacugguaaauaaugaauggaguuuucuaaaaguuguugugcauuuaucaauccgucucaagugccaggagucugcagcugucaaugauuuucuaccaaagcaguauuuagagcacugagcuuucaggauuuaaaagaaaaugaaugaaggacuuauuuacuugcaguuacuaucuaaauaauuacauuuuaggauaccuaaaacugcauuagaacauuuaguuauaaaaaauguaugcacaacaacugaaauuuaugcugauuaagguauuuucuaagagacauuuuaucaagcugcaaaguaccagaaaacuuuuacuuuccauuugacaaagugaauaggaugacaugcuuggaguuauaguuggugauggcacaggaagcucuaggaagauuaaagugcuuuacaaauagugauacauuucauauuguuuuuacuuugaguuuccaaagggaaacacagggagcagcacagaaacaugccgacuaauagaaguuuaaaaaucagaacacaagcaauuauuaaagccaaauacaaaaaacaauuuucacuuuguagaaaauaaaaaaaagauuacacccaagugaauguuagagaaauaaauuuauaucaugaaauuagaauuuucacguuauaguaaacccuuaaugaauuucauucauaauugccuuaaguuugucaauuaauuugcauaaaacauccuugauuuggggguagcaaaauaugagguaaauguacuaugaaauuagagugaaaauuacagauagcuuuguuaagauugaaacaauugucccaaaauguuagaaagguccugaaaugcuugucgagagguuuuaaauauccagaguacccuuugggacaugaaauuuuauccaugcccuguaagacaauucugccaggccuucauauuuucagcauuuauugagcacccauuauagacaagguguuagguaaaaccguggagauacuuggguaaaugagacagaaaaauucuggggucuuauaauauagugggcgucagacaauaaggaaguacucacauaagcaacagagauaauuauauaaagugauaagagauaggaaguaaauaaaaagaaugaugauccauggaguagccaggguggacauuugcaauauuucaaugaggugggaagguaaaauuggagcuaaaaugugaacaauaggaacaaggauuaacuuaaagaguagucugauuaguuacuucuuauuuaauaagaauuugcuuucauuucuuccuucaucacauauuuauugaacaucuauuuuguguaguccagggaaggguuaggugucagaaauguaguaguaaccaagccagaccagucccugacauuaccaugccuaucgcuuaaaaaggaagacaaaauuuaaaaaagcaaugacaauaaagauggugauuauuaagaucaagaucauaguagguacugugacagcuaugguuaaccuagucucguggucaaugaggaccauaugagaaaaaacagcaugagaaaaagaugauugcuuugguagauagaauucucagauagccccaagauuuccuucgcacuagugugcguguccccugcguaauucacagaacuggguguuugauagauuuuacuccuaugauuagguuauauaauauggugcaggugacuuuucgauagggagauuaaggaugagccugacauaauauuaccauccuuuaaaagucccuucuuuuucugaguuaugacccacagaacugugagcugauaaaugguuauucuuuuaaguuguuaaguuugugauaauuuguuaccagcaauagaaaacuaauauagauguagacaguaaugauaaauccugcucaauuaaaguugguagagccauaauuuaauaaucuagacuuuggcuuaaaauggguaggauuaauaaguaaggaaggauugauuuacuuagacuuaaaaugcuugguacugucauauauuuauaacuuuauuuaaacuuaacauauuauauuaucucauuaagugucuuuaugcacaucuacucccugccccacacaccuuccuaaacuauuagcucuuuaaaguuaguguacuuagcacauuuucucacauacguaaaggauaagaaacauguucuuaugcuuucacacugguuuucauuugauaaauauuuaauauugauaacugccuuucagguacuguauaggguucaggcgaaauggcagucauaacaggaaugaaaucaaguccuuacccucauggaaauuacauacuuguugaccgaaugaauaaaugaauaggauaaauaaacuaaucacuuuuccucucauuuucaacuucuaccuuagucuucaacugcaauuuucagaaguuaacauuucauagauaaguuucaagagaaaaggugaaaaaugcugacaguuuauagcugaucucccagguuuuguauacucuuacucucuuuauaggcaauauuuacuuugaaaugccaucaaaucuaucauuguaauagcaaaacucugccuuuuuccuggcuuccaagcacuuucacaaaucauagucuaacaacuacaauccaagcucugaguacaaaguagaaaauaaaauuaaaucgcuuuuaaaauucuauacauagaccaacaucucgaguaagcaaagccuuguaaaauugauguuaacaaaaagaaagcugaccggugcuggcccucagcaaaauuguuagguggacacaauguuuauuugucaccucuuacguucuauucaacucuguagaauuuuccaguauaaauuauaauguugaguucugagguuugccacuuguuaagucuguaaucuucaauuuaaaaauuaacuucucugggccuuaguccagaaaaaaaaagacaauucuuugguuuguuguaaguauugcauaaaaugauauuugugaaguacuaaauaugauuauuacuccauucuucuucuugucagugguucucagcuagaggcagcuuugcccuccuauauuugccaaaauagaaaaauauuuuugauggugaugacuagaggggugcuaauggcaucuacuggacagaagccagaaaugcugcuaaagauucuacaaugcacagaacaaaugcccacaaugaagaaauuucugucaagugucaagacugagaaacucuacucuagguaggcaaguugcugcuaucugaagaaauuucaguuguggaucagcagaucauuucuuucucacuauucucacuaauaaagagaauaaagaaacccuuuauucucuuuguuaagguaucuacuccucaaucaaggugucauucaaacuuauuuguguaugauugucuccuagaauuguuugaauuuuuacaaggugaaucuggaaauauaauccaaggaaaaaaucugaggauauaauuuucacaaaucauagucuagcaacuuucuauaagauaacaaggaagaaggggaaauucauuuuggaucuuuuuguuaauuauuuaaaauaaaagaauagggucagaccucaaagauauucuggauugaauuccaaaauauagcuauaaagcaaauauuacaauaaagugaauuacaugaauuuuuugguuucccagugaauauaaacauuguguuuauacuauacuauagucuaucaaaucaacaauagcauuaugucuacaaaaugcacauaucuuaauuuaaaaaauucuuuauugcuauaaauugugaaugauugugcauucagccagucauaauauuuuugcugguguaggauuuuaucuugauguugauggcugcuaacugaucagaguucugguugcugaagguuggggggcugaggcaauuuuuuaaaauaagaauaaaaugaaguuugccacauugauucuuucuuucuuucacaaaagauuucucuguagaaugugaugcuguuugauaucauuuuacccguaguaggauuuucaaaauuggagucaauccucuggaaaucuuucacugcuuuaucaaaucaguuuaugcaauauuugaaauccuuuguugucauuucaacaauguucaaaguauauucaccaagaauaguuuccugagauggaaacuuaaaaccucuuauuuauuccuucauaaaaaccagcuccuggccagacacagugcucacgccuguaaucccagcacuuugggaggcugaggcaggcggauuacaagaucaggagaucgagaccauccuggcuaacauggugaaaccccgucucuacuaaaaauacaaaaaauuagccaggugugguggugggugccuguagucccagcuacgcaggaggcugagguagaagaauagcgugaaccugggagucggagcuugcagggaggugagaucgcaccacugcacuccagccugggcgaaagugugagacuccgucucaaaagaaagaaaaaaaacaaacaaacuccucauucauuaaaauuuuaucauaagauugcagcaauucagucacuucuucaggcuccacuuaaaauucuaauucucuugcaaauccacaucuguaguuacuuucucuacugaagacuugaacccuuaaaagucauguaugaugguugaaaucaacuuccaaauuucuguucauguugauauuuugaccucccccaugaaucaugaauguucugaauggcauccagaauggugaauccuuuccacacgauuuugucccaguccaucagaggaaucacugucuauggcaacuuuagccuuaggaaaaguauuucuuaaauaauuagauugaaaguuaaaauuacuacucaguucuucagaaugaauguuguguuaguagguaugaagacaacauaagucuccucauacaacuccaucagaggucuagguugaccagguugcauuggcaauuagcagacauaauuugaaaggaauuuuguuuucugaacacuaugucuccaaaagugggcuuaagauacucaguaaaccaugcuauaaacaguugugcugucauccaggcuuuauuguuccauuuauagaacacaggcauaauagauuuagcauaauucauaagggaucuaggauuuucagaauggcaaaugagcaauggcuucaacuuaaagucaacagcuucauuagcccauaacaagagagucagccuguucuuugaagguuugaagccaggcuuugauuuaugaaaguccuagauagcauguuuauccaauaucaggcuguccuaucuacauuggaaaucuguuguuggguauauccaccuucaucaaugaucuuagcuauaucuucucaauaacauucugcagcuucuacaugaaaacuuccugcuucaccuuaaaguuuuauguuaugaagaugacuucuuucugugaaccucaggagccaaccucugcuagcuuccaacuuuucuucugcagcuuccuuaccucuuucacauucauaaaauugaagaguuaaggacuugcucugcauuagggcuuugacuuaaagaaaugcuguggcugcuuuggucuucuauccagaccacuaaaacuuucucuauaucagcaacaaggcacuuuugcuuuuuuaucauccauggguucacuggaguaacacuuuucauuuccuuuaagaacacaccaacacacccuguacauucacaacuuugcuaacuggugcaagagcccuggauuucagccuauuuuggcuuucaacacucuuuccucacuaagcuuaauuauuucuagccuuugauuaaaagugagagauguaugacucuuccucucacuucaacacuuaaagaucauuguaggauuguuaauuggcccaauuucaaccuuguuuugucucaagaaauaggaaggcuugaggagcgggaggggaauggaacaauccauugcuggagcaguuagaacacagacaacacugauugauuuaguuugcuaucauaugggcgugguuaauggcacugcaaaacaauuauaacaguaucaaauaucacugaucacagaucccuuuaacauauauaauacuaaugaaaauguuugaaauauucugagaacuaccaaaauauaacacagagacaugaaguaagcacguguucauuguuaaaacguacugacagacuugcucacugcaggguugccacaagauuccaauuuuuuaaaaaaaguucgguaucugugaagugccauaaagcaaaaugcuuaaagguaucccugcaauggugagaaguuaacaauguccguacauaaaaccaacuacguacaagauguugaagaaaaaugcugacauuuuggauaacuucucuaaugcaucagguaagauauucacaggagagaaguuuuugcuucauaacagugauauccuuuaacuuaaacuccaguggaaaaaccuuaagugaaaucuaaugguacagccuuauuuaaguaaauucauaguuugauugcaacugauuaucaauaaugauuuucauacuaucuucuggaaaaaaaguguugaaaaaugcaacagaaacacacacaaauuuacuuguauuuuugacccuauuaugcuuuccaaaggugcaguugccauuagagggauaaacuccaggcuuucaguauacuguuuaaauuuaggcauauugcuuguuaagaauggaaagaccaaacauaaugguaaggagcgaagggacuggaaugggagguggaguuuugguaaauaauggccugauauuagauaguggguauagaaauucagaggacaagaaggacaggaaugaaaauaugauaauagaaaaauaugucguguaaauuguuggugaaaaaagcaaggaacaaggaagaaucaaaucuauuguuuaguucuugaaacuggaucucucuguagacccagcugucuuaaaaauaaaccaguaacacaggaguagagauacagauaaccaauuaaggauaauuggaaaaaaauuccagcuuggaggaaagacucauccacuuuuuacaguaaugguuuuaaaguaucuuuuuugcgugaggcuuuuccuaguaauuguaaauauauuucaaguggaaaaagccugaaacaucgcgugacaugaugcaaccuucaaguagacuguuaacauuguacaaugagugaaaacaaucauuucaccuuuccuauauuuaaaauuagaaagaaaaauauuaauguuauauaccuucuuguacuccauugaucucuaagauaguauuuauuucuagucaggaaauucaccuccagauaaaaauaauucauauuauacuuaugaaguaaucaguucuuaagacuaaaaagguguguguuaaguuuaauaaaaauccuauaaacaacaaugguuauuuuucuauuuauauuaacuuaucacuuuccuuugaccuauauucccaaggccauuacacuaguguauaguauguauauuugcaauauuggaauaugaauuuuguuuuauuucuggaaaauggaauuacaauauuagugauagauuuugaaugacuagaauuaaguaagcaaugucauaugcagaaucaaauaacaaaaagaacaugggaaaccauggucaucuaaagugauugaaucuauuaguagacaauauacaugcauauggcauauauaaauaauaaauauaguaauaauaacaaauaauuuuuuaucugaugugcaggacuauucgccuuuaagguaaagacagguaccauauacaucuuucucuccuuuauacugugguuucagggaauugcuuuaucucuaaagugacauacagagguagaaacuuaauugacaaguaggacacagcucauuaagucagucaucuuuacacuacagugaauaggacauucauuugucauucugucacuagguagcuguaagaaguagucucacaaugcuagauuugggacauccaaaaggcuuacaauuaauucuguaugguuauaguuucaaaauggcuuuuuauaaagaauagcuuccaagugggaauagcagauaugccagaacuuuuauugaauaaaacuaguuuggugacuauaauuuauauuugaauuuuuauccuuuaaaccagauguagaaaacacaaaauauuauuuccuuuccaaauggauauuuugaaguaagagcuaagcagaauacucaauuucauuauggcaaagagauuggcaaaaauaagacauuguucuauaaacuauaaacuuucaaucuucauuuaaaaaauuuuccccuuucuaaauuuuuuuauuauuuacauuaauaauacauuuuuauugagauaaauuuugaaaacuuguguaccuuuauuuggaaauauauuauccugcacuuguucguaaaacuuuacuauuguguaauuuuuuaaaacauauauuuaaaguuuacuuuuccugacuuucauaucaucuuguuuacguagauucuaauuuaaggcuaaguauccucaaaacacagacacacacacacacacacacacauccucacucacacaaacacacaucacaacuucucuccagaaauugcaguguucgaaacauguauaauuaaauuagcuguucucauugugguauaagaauaucacucuauguuccucaagcacagauaagcaaauauuuugauggcuuucucaguaaaugucucugccccuggagugaucuuuucagcccagaauucagagaagggaaaaagaagacaguuauauguuuucuccuaaauguaagaaaguaguaauaagucuucuauuggauuaaaugucuuguucagcaugagggaaauacagcacauuaauucaaacauuuugugugauuuuaauuauagcacauacuacuaguucucuacucucaaauuugaguuuuugcauauggcuacucaaaauaaagucuguagcccagaccaccccuuguauuuagggaugauaaggugaagccacaugaugaagaaagaaagaaaaaaagaauuuugguccucuggcacucuggagucauugcaccacagaucuguucacaguucucaucuuuuuuuuuuuuuuaauuucaaauugauuuuagauauggggguacaugugcagguuuguuacaugggaauguugcaugaugcuaagguuuggugcacagauaucaucacccaggaagcaggcaugguacccgauguguaguuuuucaacccuuucccucaacccucccuccaaccucuagaaguccacauugucuguuguugucauguuuguguacauguguacucaauguuuagcucccaguuacaaguaagaccauuugguauuugguuuucuuuuccaaauucacuguuaauucaucagacuuauaugcucuuuaagccacuauugacagguaagaguuaaauucacucaaaaauaauuuuaacuaauuuaauaaaaugcuaccauugaaauauauaaauuauauuaaauagcuacuaugagucaggguaggcucuggcaaauaaaaaaaggaagucaugugucuuuauuuuauggagucaaaauucuggugagauaaaaugucauuucaaauaagcaugacagaaauaaaaauaugaauacuauuuuaauggagugacagugaggauuuaaauuuucuaugagauuggagaaagucaguguaaaagauaaaacaaaaaaucuucauacaaaggaaauaccucucauuaauuaauucaucuauuuauucaauauaaauuuaucaaacauuuauuguguuuauauccauguuagaguuucauugucuuaaucaauuauuuauuugacauuccuuuaauaauccacuuuggcacuuccugagucauauauuauaucauuuaauccuucugauacuuugugauggucguguuacagauaagggaccugaagguuagugagcugaaacaacuuguccauagucacucagcuaaauguggaucaacaaggcuugagucauggucuaugugauuccaaagucugugcuauaugucaaggauuugccucugcuucuaagaaguucauauccuugcagagcagaccaagcacauuauaagaaaaugcaaacacuggcauauuaaaauacaaagaauuuacagcagaacagaaagaaugauugauuauuccuggguucaugguaggaaggcauaagggagaaucacaaaauaauuaacaaugaagcugaaaauuuaaggaaggguaaaaauucaggcauaacaugggagaaugaaaguuccuagcagaagaaagaguaugugcugagguaaagaggugugaaauaguguggcucuucauaauauuccagugugguuacagcaaagagugcgccacgaggagcuacaggaaaaaugguguagaaacccaggacauggggacuuucaagaaggagggcaugguuaauggaaucuguggccugggagaguuuacuaauaacaaggacuguggaaaaaaaucauugcauuugaugaugaggaaauuauaucaaagagcuucagaguggggucacugaagcagaaaugggugaaaguggacacauauuuuaagacaauugaagugaauggagugaagcaugcaauuuaaauuugaagaaagaguuucccuucagcguggaguuguuuauuuuaagguggaagacaguucagccuaucugagggaaaggagcuaguagggaagaagaugcagaaaguuuauuaaugauucagucuucuggaagaggcagaaagggaaaagaggagacaguacagaugaaaagacuggaacuggcuggagcauguauucagcugagaaaaaaagguaaagaugaggaauuccuaguaaaauagaacaugauuuuuuauagacaaauaccucccuuacacaucucuauccugccuuaaaugccacaaauacaccccccuccacauacagagaaaacacaaguguucaucucuuacccgagauugucuuuaauuugccuaucauugugccuguaaugaauacuuuaauaauguuuuuaaugcaacuuaaauuugugaccaaaggccugcuucuuccccuucugcacagaccuaauuauauaauuaccacucuuuacaaauuucuuaacaaaaggacucuaaauauuuacgaauugauuucuugcaauuuuuuagguggucucaggagucuuucugcauucuuuugcaaagaaaguacauauuuuuugauucauuccuguuuugugaaugaccguuacaaaguucacccacuuuuucacauacuuucucuguaggcaggaacuuagguguuacuuuggccucacuaggcaauauuauguacuccuaugaccuauaauaauggaaagcauggcauuuagaguuugguccuuguuuuaccuguacuacugauucauuacaaaguugaacaaguguuuuaagugcuaugcaucacaacuuuucuuuaacugaaauuuagauauacuaauguuugauaugccucuuuugcauguuaaacauuaccuacauaauuaucucuuaauuacauuuuugagauucuuaauaucugauuauguagaagaaggaaaaacuauucaaagcuauuauauguuuuauuaaauugaagacuagauuacucuaaaaauucuguaauccugauaagaaauaacuacaaugaaauauaaacugaacccucucaaugauuuacuaugcauuuugaaugagcuguauuugccuuugccucauugcuuuaauagaaauguuuuucuggugagauagaaauggucaaauuaccaugucauauuuauuuauucuuauuaccaucaagaguaaaaaaaucauacuuucuuauaagcaagcacuuuugaauugcuaaauuuuuauuuaaaguauuuggcugauuuguuaauauuuuaggucuagcaguaauucacaaguacauauuaccaucacauggcauuaaaugaucaugaagccugauuugaaauaauuaaggauauuugcuauugaaacaauagauuaauaagcugcaaauuaaaaauauuucaguaauacuaauuaaaaguaaacuugacuauaauuaaaugaucauguuugcugccucuccucucucaccguuugacuuucaugugcauaugcacacaccuguggcaaugaaaugauuuuaaugccuuccuauuggugccuaaaauaaagccauuauaugaagaauuuucaaaagacaacugacucacuuaaagucucuggauauccagaaauuuauugcucaaaugguauuuuugaacacaucccaaucaucugaaggaaguaaauugcucuugggucauugugggucucgauucaacagcucuacauuucaaccuuuuuaacuggucacugacaucugcagcagcuugcuauauuguaauaaaauaacugaacuguuucuaucauuugggaauucagauucaccuuucuugaaauuucuuaaaaguggcuagcuccuuaggaggaaaaauacuaaaauauauggguaagaaauaaacaugauaccauaguacacaaucuggguuuguaaaauacucacaaugaaugucugugaucuucuaaguuuauguaugaacacugcaaauaaaaccauaucuaugucaaucaauccuguuuguguucacuaccaaaauaaauuguuuauuaacauccaugaaaaauguucaacuaucaccaagagguaaauauguaacauuuguuuacaaaaaguuuuacaaugaauaaaauaccugaaacaaugcauauuuuuauaagaauauuuguucagguguguaacagagaauaauuauaacauacaauaugaauuaugaaaauauuuuauuucaauguauaucuaaauagaaccaguauguaguguagauucacuuauaauuauauauuguauuuaucuauaaacauaucaauauauauuacuagaaaaacaaugauuucuuagugcugauaaacuuuguagaucuuuuaauaguucaauaguauuagugaacuuugaauauuuguaugaaauauaaaacaugcauuuuugaaaaacacacaauguucugagaaccauaaauauaauuguuuuaaagauauuuaaauuuguggcauaucaugugauuaauucugucuucucaaguagaaagcuauaaaauauauuauaaucuuuaauugcuuuauuacuucuugcaauuaaauuuacuguaauaacccaugauaaaguagauuucuggaaauuucaaucauuaaaaaucauagcaaugaaacaaggaaaauaaguacaaauuauuguaaaaagucuugguucuuuaugccauugaaauaaucaucuagccucauauuagaagccaaucuuacauaauaaauaauaaauuaagguagagauuauaaugucuugguaauaucaaaguaaauauaagugauuuuuagacuauaauaaagauugcuuaauaagcuaaaagaaaagauguuauaaguugaaaaauggaguugaagggguaagcagaugagaauguuucuagaagcugacaaugugagguaacuaucaaagaaaagcacaacuguuuaaauuauuaaaauuacuauuuuguuauaggauauguuuuucuccauauuuuagccaagucaugccuuuuaccugccuuugacaacugcuucuucccacucccuaacucauugcauggucucaaacuuccuuccuuagaaauagagugcauuccaggcagaauucuguaccaacuguuauaaauccccaagucaaagaauacauuccaccaucucccagaagagaaaccaggcccugcagauaaaggcaaguacuaaggaaaaaugcaucugcugauguauccuaucugauagguaaauuauaguacucaagaugcuuucaagcuugauaucucauccuaauacaaacucagaaacaccucuuuuucaucaucaucaauugacaucauccaguuucaauucagugcugggguaaauggcauggugaugguaggcggcauauacaggauacuuauagcccucuauacccuggaaagcuaaugcaaguguauuaguuuauuaagccucuuauaacagaguauacacacugaguggcuuagauaacagaaauuuaauucccacaguuuggaggcuaaaaauacaaaucaaggugucaggaguuuaguuacuucuaagaccucucucuuuggcuugcagauguccacucccucacaguguccucacauggacuuccuuauacccagcuacaccccuggugucucuauaugugucuacauuuucucuucuuauaaagaccaccagucagauuagauuaggccuaccuuaacugugucauuuaaacuuaaucuccucuuuaaagacccuaucuccaaaauagagucauucuggugugacuccagauccccguagcccgcuucauuaaauucucaggugguaaugauguagacucaucaaucuaguuacccauuaacuugacaauaggcauuguuccagguguggguauuagaacaaucaaaggccacuccaaggccuccgauuugcacuuugcaaaauggaguugaagaaguuuucaggucauggaacucuauuucaugaugaucguuuguugcuuccauuucucucaccccauagagaaagccuuucuuuagcaggagggaauaagguacacauacauauggaguagaaacaauaaugaauugagauagagaagaggagugaagagagaaagagauguguagaggaagcaaggcaggaagggaaggcaguagagaaaggagagaauugaaagccuaacuugugucucuacauuaagucaagccuaaaacuaguugagugcugguaaauaauuagcaacuagaucucugugaaaaaaaaaaaaaaaucccugaaugugugauuguguuuguugauuucuguggugugaacacuuccaaaaagacugauuucgagcuguuuguguuacaucaaugacuguggaaauggaagagaugcacaguaacauaccauuauuuucaccauucagacacaauauagauguaaauuacuucaauagcaaaaucuaguaagauaaguguaaagugaugggauuugauuacuuauuaccuuguccuuugacuguugacauggagauaagaaaauccuuucuaaaggcauauaucuauuauauacauauacacugaaugcacaaaugcacaggaagcuaauacugucuacugaauaaaaacauauauaucauuauuauauaaguauuuuaguauacuuuauuuuuaaaaaagaaaguaaauggaacacgauuuguucguuugccacuuaacuguccugugucaugaaacagauuauuuuauuugauuccauuccauaaaauaaacauuccuugggaaauaauuauuuaugacacuagacuaaguauggaauggaauauaugucauuauaaaauuaaugggaacaaauucaucaguauagcuguguauguaagaauaaagcuauauuaaaauuacagagaucugaaguagaagacaucucuuuauguuaucaaaauagacauuuuguuauuuuaaagaaauucauauuuauuauuugaaggcacaaaugcagccuaggagaaggggauuuuaaaauauuaaagagcaggaaaggaagagaaagacagugauagagaggccagcgagauauaacuuaaaucauguagcagcuauugagugcuuauggcaaagaagcccaagaaaaaacugucacagagaucugccauucuuagaguauuugugaaagacugagccaugggaaaaugccaggagcagaagugcuggggguugagauucugcaguuugaccugguugugucuaccuaaugcuucagcaaaaauuuaggcaaggcuccaaaggaagcagcagcauaauuagaaaaggaagagguugucuauuugcaacacugacaauggcuaaagucucagcugucagccaagcagaaagaguuuccauauguuuagcaacauauuccauuucuuaaaauggccauggauugacuugugacauaaaaagucaggaucauagugagagaaaauggaaaagugguaucuuuacauuuuaaauguuuaaaaggauaccacuggugggaggcucuauuguguuaacaaaaagugcuggcuuugaagacagauugucuccuuaggauucagggcucaucaaugggaacaugggaaucuuucuaugacugaguuuccuccuuuguaaauagcauagcgccuacaucuuggguuacuguaaugacuaaauacauguaaggcacacaauaaaaaugagcucucuuuguuucaaguauuuuuuguguggagagcugacugaaauauuuaaacuggagugcaaucuaagcuggaagggugaguaaagaauucacgucacuucaucuucccagaaaggggaauuaugaauacgugagguggacagugggaaugcagguggauuagacaaaacaaagguagagagaggagcacaggaguccaagaauguaggaaucuaaaccaaaggggaagaccugauaagcaacuaaaagcaaggucugaagagaucaagcuguaagcaaagggauauuacauagcuauaaaaaauuaugucuuuguagcaacaugaaugcagugggagaccauuauccuagcaaauuaaugcaggaacagaaaaccaaauacuucauguucucacuuacaaaagggagcuaaacacuggguacacauagacauaaagaugaguacaauacauacuggggacugccagagggaggagagaugaagggggccaaagacucaaaaaauaccuauuagguacuauauacucaguaccaggauggugggaucaucuguacuccaaaguucagcaucacacgauauaccauguaacaaaccugcauauguagccccugaaccuaaaauaaaaggugaaauuauaaacagaaaugaagacgaaagcuagacacaucaucccagggaauaaaggccaacuuggagaaggagguggcuaugaaaucuguaauuuuaacuagauauuaagaagucaugaauuuaacaguuuaagaagagauagauuucucuagugacaaaaauggagguaaaaaaccuaaauagcuuugagguuggggcuagaaaugaagagccagguggaaaaauagaucaaacaggguucagaaagaagggcuaugaccauaaaauggaagagacauugucgaauaucauaauuauggaacagauuaacagaauaaaaaugcauuccuuaaauuacuacacacuagagcaaagcuuguauaugugaaacaaauacaugcugaaaaccaaaugaugaagcgaguuucuuggaagaauauaaagaggucuaggaugauagucaaagggauuaucucuaaagaaaaaugcaugcaacaacaacaaaauugcuucucaauugugugguugcugccaggugugcaccugauauccauuggacucguagggaguguaaaaggagguaaaggagauugagaaggguggaggagggcagagagcaggaugguauauuuacuauguuuuuuuaaaauuuuuauuuuuggucagguaccccaucuacauguccaaaaggaauaaaaaguagggagauaacucccacuccaaugucaacaauaauguuuacaaagagguguugucaaguuucuaaaacaaugcacaggacaugguaagcccucuacagauauuucaugaaugaaagagcaacuuaaaacucaauuuaaugcuauaucuuaaggaacucaaaaaguaaagacaggaaauuguuacagggcuacugcuucugcucuguaugaauaugagcaucaaaaacaaaccaaaaaauaaaccaagagaauaaaaagaguuucaagacauggcauuuagaaaaaucaaucaaagugccucuauuccagugguuuucagggugugguauguggucccugggagucuucaagaccuuucaggggaccaucaagucaggacuauuuucacaauauuaucugagauauuauuauccuccuuguccgcacauuuguacugaugucauuagagcaaugaucaguaaaacuauuggugcuuuaauccuaaucaaggccauggcacuggacuguacuaguuagugcucaacagccacaaauuuauuauuauacaaguaaauagacaaaugcauaaauccaguuucauuaagaauguccuuauuaaagcaguaaaaaagauacuuuuuaaaaaagcauuaacccuugagaauagcuuuuuaauacuacgcuaugugacaaaaugagaaggaggcauagacaucuugugugauuguuugggaaugugagcuggucuagccagauuucuucaucaaauucaaucuuuuuuuuuucuuucuuuuuuuuuuuuuuugagacagagucuugcucuguugcacaggcuggagugcaguggcacaaucugaaauuuucaucauuugcuauguaggacaugacacaagaaaggcuacaaucaauccugaucauacuguucccauucacauauagguauuuaaagguggaugaugaugaugaugauuagagacagagucucacucugucgcccagguuggagugcaguggcaugaucuuggcucacugcaaccuccucuucccagguucaaguuauucuccugccucagccuccugaguaacugggauuacgucgccugccaccacgcuuggcuaauuuuuuguauuuuuagcagagacgggguuucaccaugugguucaggcuggucucaaacuccugaccuccaauaauccacccgucuuggccuccaaaaugcugggauuacaggugugagccaccgcaccuggccuaaucuuuacuuggaagaaugacugacagaaaaacuaguaaucuagauuugaguaucugacagauuuuucucaaaaaugaguuaagcuuguuaauucaaggaaaacggaauuauacuccuuguugaauuuaauaaauuucaaaauuucaagcaaaaauagaauuugaaaaauuuaucuaccacagucaacuuaauagauuaucaauaaaguuuuuuuauuaaaucaguggugauauuaaucaaugggauuugauauuauauaauaaacuacgucagcauuuucaagaucugcaauauucagugaaccagcauuuuccaaaugacgaaugcauuguuacaaaaucauucaugaguaaauaugcauucaaagagcacaguagaccuacggauuuuaauuuaguaaagugaaaaguuuguugauaugauuucagauucuacauugcaacuaaaacuuaaacuacuuguugaauuugguauaguaucaaagaagauauuuauaaauauuugaagguuauuguaaaaaauccucccuuuccaacuacacaucuuugugacacuaaauuuuccucaagucguucaacagaaaccaaguacugaaauacauuggaugcagaaucuucuaauaagauaacauaaaauagauuuguauaaggguaaagcaguaucuucucaugauauuguauuuauuuugaaaaauauaguuauuccucaugaaaauguuauguuaccaugcaacagguuuauaauuuaauauuaccauuuuaaguaauaacauauuuucacauuuucuaagauuaaauuucagauacagcagacaucaauaaguauagcucauaaaaaccaaaguucuacagggcccacacuaauuuucuaagugaaaggaguucuugaauucaaaaugagguuuaagaauuagaccuuguguuguugauggcugaauuuaugaacuucugcuuuaccugauuuuauauucagcuucuugacuuguuuuuauuuuauuauuuuauuuuuuuucggagacagagucuuacucugucgcccaggcuggagugcaguggugcaaucacagcuuauuucacccucuaccucccugguucaagcgauucucccaccucagcuuccaaguagcugggacuacagguauguguuaccccuccuggguauuuuuuauuuuuauuuuuuguauauauggggucuuauuauauugccuaggcuugucucaaacuccugggcucaaaugauccuccagccuuggccugccaaagugcuuacauuaccgguguaaaacaccaugccuggcuuuaauucuuuuugguuuugacuucuuaucuacagccucaucuuuucuaauacacauccccuaaaugccugccucuaccacauuucuuaccacaccugauguuugauaucugcucucucagaucuuuagauacucauaucuaaaugaucuguuuuucugucagucauucuuccaaguaaagauuaggccuggcaugguggcucaugccuguaaucccacuuuuuuuguuuuucaucuuuuucuucuaagucuuaucuuuaucuugccuuuccauguagaucacauuugcuucuagauggcucuucuaggcaaggagaaaaaauacuauuucucagcaccugccaagcugccuacuaucuaaaaggagauguacacuuugaccuacauuacugagugguuguugugaacgaauuauauuacuuuaucuucccaaauuuuagaaacauuucuaaauaauagaauaacacaaaauauaaacuuucccuuuucaguaagcauaugaaauuuccucauauacaacuaagauagaugaguucaacauccaguaaauguuauuuauuaaugauguaaauaacuaccacauuguaggaaaaacugcuuucuugguuuuuguucucuccuauaguagauggugagcauugcaggcaugccgucucugcuuuguaaucacuaugcuucaaauauuuuguggucacagauaccauaaguccuuucaaguaaaacaaauaacuuauggaauagcagguuuagaaauuguguacaguagcaccaaaacccuaaugcaugcuguuuaaugaucccuagagagagucugggcuacaucacuauaaugaauuuacaagcauagcaucaugcagcauucuuaaaaaucuaaccaucguauuuagagagaugacaccuagauuuuuccuaagggguuuuguaaaguugcaaacacugcaauuugguaguaacuucuccagaagcauugcauuaaggccaguuaaggagccuuauucauuuuacugcagcccugccuauuuacacuuucaccuugucuucacaguccuuagcugguauaaaugcaauaaguuaaaaagaaaauaaaauuagagaugauauuccuauguauucccucaagaggagaacucaaagcugucagaauugcuaaaggaaaaaaaaaauuaagcuauaaauauaaauauauguguuuguuugaauaccauauuguuagugauaagguagcaaaaugaagugagaaguacaaauguuuccccuugggcaauaauuuuucuggcuucacuuggccuacauugccacagagaacuggagagcaugcaucuaaaugcagcuuacuuguaaugcugcaccuguuuguaggaaaaaggacugcaucuggaauguuaaacuuuuucuagcgaaacuaauauuaacugauauuuagauucuuauaaacuaaucaucaucuaaauauggaauaaauaguaaugagucuuguggucuggaaauaaaacaaucuaauaauauuagaagcacauugaaagacauaaauagcuccucaaauaagcuuguaaccccgacuucugcauauguaaaauuauaacuguggaaagaugauacaggucauaaacuaucuuguuauuucuggaaaauguaugguacuuguugaaaaaauauauauuugguaaauuuaaacaauuuaaauguuuugagaaaaaagugaguacauuucugacaaaaagauuucagcuggcuuuaaaucagugaauuuuaccugacaguuccuguggaagcaaaauuuugcaauuaacuuguucuauuauguggugaaagcaauuacuaguacagccuagauuaaaugaggagaggaguuacuaggaagaucauaaucugucucugagucaacucacauaaaccauccauauccuaaaucuucuugaugagaccagagcagaucuuggaaucaagauaaguugggaaagcaguuguuucaguguucauucuccauuuggaauaguuauuaagaagaaaagaaucugaggccuuuuagcaagcagaauuaacccauuuaguuacugaaacagagaaacagaguaccaagagaaacaaaaauacuacauuuauugcuauuuucaauaugugaauauugcaguugaagcaagagagcuucaaauauuucuuugaacuauuccuuugauuuugaacuuggaaagauacuacuggugagggcaaggcuaaguauguuuucaguauaaacuauuuggcuuuguagcauagaagaaggaaggacauauaugcucaaugaagaagcugcucaaugaaagcuuuuaggauacaaaaugccccaagaaacaagauuauacauuuucacguagaauuucuugaagcaacauuuuugcuuuugguacuaauuaugaagaauuaauguaaguaacugaguuucaaaaagacaguucaucuggaguuugggaauaauugaggacugaauaaacucccuauguuuaaaaaaaaagacacuaaaucauaucaccauagaaaaucacuuucaguagaggaagaaggggagaaaagaaagaaggaagagaagacuacaagacaaacagaaaacaaauuuaaaaaaauggcaggaguuaagcucuuacuugucaauaauaauauugaauguaaaugaacuaaauuucccuauuaaaaaaacugagacugguugaauggaugaaaaaacaagaucgaucugcaucuguugaauacaagagacacacuuuaccuguaaagacacacauagacuggaaauaaaaguaugaaaaaauauauauuucauagcaauggaaauauaagcaggagucacuauacuuauauuguaaaaauacauuucaagacaaaaccuauaagaagagacaaagaagguaacuauauaaugauaaaggggucaauucagcaggaggauauaacaaguuuuaaauauauguacacucaacaguggagugcccagauauauaacagaaauauuauuagagcuaaagagagagauaggucccaauacaguaacagcuggagaauucaacaccccacuuucagcauugaacagaucuuucagacacaaaaauaacaaagaaaccucagacuuaaucuguacgauagaccaaauggaucuaauagauauuuacaggccacuuuauccaagagauacagaauacacauucuuuuccucagcacacagaucauucucaaagaauagacuagauuuuaggucacaagucucaagacggucaaaaauauuaaaauaauaucaagcaucuucucugacuacaauggaauaaaaauagaaguaaauaucaagaggaauuuuggaaacuauacaaacacauggaaauuaaacaauaugcucuugaaugaccacuggauugaagaagaaauuuaaaagaaaauuuuaaaaacuuuucuuuaaaaaguuuuuaaagaaaacuuuuuaauuuuaaaaacauuaauuuuaaaaacaaugagaacacgcggacacaggaaggggaacaucacacucuggggacuguugugugguggggggaggggggagggauagcauuaggagauauaccuaaugccaaaugacgaguuaaugggugcagcacaccaacauggcacauguauacauaaguaacuaacuggcacauugugcacauguacccuaaaacauaaaguauuaaaaaaaaaaagaacucuuacaacacacaguaugaaauaagaaccaaagucuaaacauaacaacaccaagucauguuuaccaaauuuguaaaucaaacuaagauaccucauuaaaaugauugaaagcaccaaagagcaguucuucaaggaugcaucaagaaaugcuaaaauuacacaugcucgcuugaaagacuuauaaaaucacugccauagcauucucagacacaccaauucauaagcaggacgcuggccagauaauccauuguguuaaucaguagaaaaggaaagagugacccuguaauguuuuauuuguauuguugcucguggcaacuauagaacucacauaaagacuagucuaaguaacuuuaaauaaauccauagcauuucagaaaggugaugauagagguaauagagaucugagaggagaggaaaugauccuaaaaggauaaagaaaauuggggcuaaaguucccugcucaccuccuaacagagauugagcagguauuucuuccagauuacaaaauauggaggaauguuaguuuaccaccuucauauagacaguaacagucuaaugcuuuaugucuaauagaacaugggcuuccaugucauuuucuccauguuaaaauauuaaaguuauuuuuucaagguuacauuugauaauagaaauguacaugcaagcuuguucagccuuuugguuucaaauuauagcagacacagagguaaaacauuucaauuuaauauucauuagucaaauggauuacuaacauucaucuugauguguauuuauguuugggauuauuugauuugcuaaaagcuaggaauacuguauauaguacagagaacuugcauccauauugcaaaaucagaaucaauuaucucaaguguagacuauuaucauaaaaaagauguuucaugcucacaaagacacacaucacucccaucugguaaaugguaacuacuaaaauauuuauaaauauuauaucaaaauucacaugucacacaugguagugauauucaauuuuuaugucucccaguuaaaagccauuauguauuguauaauacacagucacccauuuguguaucuaacagaaaaauaaaugauuuucuuaauaucuccacagggauuacuuucuaauccugcugugcaaauaaugucaauauaauauugaaggagguaaaacaccauggcuuucugaaguuuguuugcauuuguuuucgauaauguaauagaacaaauuguuucuagaugaguuuagguucauaauugcugaucucauuuuuuuaaaacauuauuuuaauugaaugcuugguuacuguguagcacuuagauaucucuccuaggaauaaagcuuauagucaagugacauauguaaaaggagacauuugccauaaagacuuugaacaaggacuugaauucgcggcucaaacauaaaucauacauuguuuaaccacaauuagguuguuguuaauuuaugauagagcauguauuugcgugcaauuaaauaugugaugagaauaaauagauccuaguccaaauccaauuacuuuuuaccaaguaaaacauggaaagguacaguauaauaguauauuaguaugccacaccccuucucaaauuaacuucugauuauaaaagaaguguugaaauaccuuuggccauuucugaacaccaaaaacauuuuuucuuggaauuucauauuuuucaucuuauuuagacagaaauucagaacauaaaauuuuaaccacugaauauuuuuucaagguuacauuugaugaguaaaaauguacauggccuuuuuuuuuuuuuuuaaccugaaggguacaaauacaggcuaugucuagaguggaauuacacacugaauacaguuuuccccaauuuuuuugaagguaguguugaaacggacccaauaguuucacggagacuuguucuuggguaaacauagaaauggacccuucuggucuuaaagcuugaaacuuguauuuguuugaguuccuuucucaggaaaggauccccaggccucuuaaaaaguaucaaagaacugaaacucagcagaucauuucauccagacaaugaaacaccaggccccucguucaucaggauugugucguuaccauucagaguuccugcuuucuacauuucuucccugcuauagaaacuccuaauuuuagucauucagggagauggauuugagacugaacucccaucuccucgacugaagcacuuccuuggcaauacucucacagucucagucauuggccuucugugcagccagcagcaggaccuagacugaacccuugguguuuugaugacccugugucuuccauuuuaaaauuuccucaagcaaucuucgcuugaagauuuucgauuuucuuuugaagcagaucugugcuuugcuguuucaaagauuccucuucuauucccccaccuauuagauuauuacauuauauuuccuuuacuaugggacuauuuuguagucuaugugguuuaccaaauacuaaacuaagucaauuaagugcauuuauauggucuauuuuaaauuaacauuuaugugugugugugugucuuuaauucuguuuacuaggcuagggccgucuuucuacucagccuacaugcucuaauaucuccuacaccaaaauccuuuuccuugauauuucugccuccuuacauuuuccuaaaguagaaauggacaugaaaauuauuuguaaacuguaauauauaacaaugcaaauauuuucuguuuuuuuuugguuaguacuuauucauucaaauauguauuaagcggcugcuauuugccauguaccauccaagugguucccaaacuguguucaucaaauccauucagcuugucauaugaggucaaaacuauuuucuuaauaauacuaagaugcuauuugccuuuuucauucucauucaugauuauacaguggaguuuugaacauuagcucugauggcuaauggaaugugugcuaguauauuucuugauuuuaauuuuucagcuuuaguuuccacugugcuaaaaaucaauagcuauaauccacauacaccagaagccagcaaacauuuucuguaaaggacaagauuguaaauaguuuaggcuuggccaaccguaugaucucugucacuacucaacucugucguuacagugagaaaacagcuauagaugauacaaaaauaaauggcaguagcucuguuccaaaaaaagcuauuuacaaaaagaagauacugguuguauuugacuugcaggcuacaguuugcugaccucugauauaaaugaaagcucuuuugguucucaauauuuuuuaagaauauaaagggucucugacaccaagaaauacagaaacuaccguagaaguauuccacaaucaaauuaagccugugaucugcugucaaggaguugucuagagggaaauuuggacacaauauauugggauuccuguuauauggacaaagugaaagacaauacgaaguguggaggggaguguauacacucauuaccauuaaaacaauuuuuuaagguuuauauguaugcauacauuuguguauguaaauuuuaggaaauguagggaaggaaauugucacaggcuuuuaucuaauuauucucaaauguuaguggcuucagaaucaccuggggguaagaacuggcaugggggguggucccauuuuaaaaauucuucuuaugucuggcauuaggcuacagccuaugaaaucugccuugucaacaggaccucaugcaauucugauguagaaggcaguagguaaaacuaauguacagccucauacguaugagaaacagcauaagcauuaucuguagaauuuccugaaccagaacuuccucuguacuagauagacagauaauauaaacaauuauaaacauuuuuauaauauucuuacaugccucucuaccuacugcuagcuacuuuuagcuuaucugacuuuauuauucaaugucuucauucucuuaugcagccuccaaaaauaauuaauguaugcauagaaugcuuagauuaucuuccuccuuccuaccuuuguuuugacacuuugagauacuuucccuacccucaaccucaucuucauuuguuaccuuuuuuuuuuuuaccucuuucagcugcuuguuguauuuuuuauuauucucaacccuuguuuugucuccuuacaguaaauuuuacuuuccauugagcacugccauaucauauuaaaauuuugugauucuuugacuuauuuaaaauaaguucucagaaaaguaaagcuguuucaaucuuuguuguauuacagaguuucugauacuauguagguauucaacccaugcuaacugaauugaggaaacagggucucaucauacauuuccaaggcgaaguaacagggcaguuucacuugauacauuaucaagagcuguguuuuauuaaaucucauucccagaacauucugcacgugucuuuucacacuuucucaucccuuauucuccauccccaucacaaacaccacacagaccuaaguaaguauuacaggccucauuaggauaaaaaugcaguguccagaaaucacacaaagaaauauuaguacuucccaaccuaccuauaaccaaguaguuaucuaaagccuuuucuacauuugaaauaauguguuuaguuauugaaaaccauuugcuuaauguaccucuucucugaugcaguauaagcugcuugaggguauaaacugugucugucuuauucauuaccauaccccaguaaugcagugcuuggcucauaaaagacguuugcauacugccugauuaaacgacaaaaauucagaaucccucauuucuccaucucauaaaaggacuaaucuuuaugcuagaauguggagaucaccuauagacaauauuccacuguuauaaugccaaaugacaacaacacauaaggcuuaaaugaauaaaaagcaaaaugaaaauagaaacauuuaaacucuuuauggugaaaaaugguuuuauuaucuuugccugagauaugaaaugaaauuccuuagacaaaacaaaagaaaauauaugaaauaaaaaucaaaagagaaccucccauauuguugaaggaaauauugaugauauucauuggaauggcaauagcuuuugacacaguacuagcauuuguuucuuacauugcaauauaaauauaaagguucaggggaaauccuuuaaguugacaccgacaaggaauaaauauucucuuaaucaacuuuaaguagauauuacucuaucauaacugacaguuucaaaucaaugcugcuaaaaaaacgaauuugggaccuaacuuauuugacaugaaucuaucugauuucaacagguaucugugaaaacauccuuuaaaaaagcaguuaguuuuccaugucaugauggcugcuccugaagaaguuaaaaugugcugguguuggcucaggagugaucgucacccacaggaaauuaacuggaggaagauucuaggaggcucagugcuaugcaggagccuguuaccacagccaccaauaagcuaacagcggaagcugcugccuaaaacuauucuuuuuaacauccaagauuuugaaaauaguucauccuuucacuaugcuauuaauaaaaauucauaauacaauuucauucucaauuuauccaauauuuuaggguaugguagauaauggcaguccuuuagaauugguuauccuuuuauucuucaucuguagcuguuuaugugaugguaaaaacuugcucauguuagguagggcauauaugauuacuucuucugucugaauaagaauauuuuaagucauuugcuacagagaaagaaagaucaucaagugucauuccugagcuauagggcaacaugaaguaauuugcugaauuguuuauuaacauuauugccacuguuaugacuggaugaaagaacagauacucauucuugacagcccuugaugggguuuauggaugaaguacaugugucaguacaucccagagucuuguauaacuuuagacucuacuguucuuuaucacaaccugacuuguauuaaccaauauuuauggaaaacuacuuaaaguccaugucagaugauuuuauuacagacuucccccgcuucucuggaaguauguugacagucuacaucgugcccuugacuucaacucaaucauuaagagcuauggaaaguuauccugcauugcuguggcuccuguuaguauuguucaugcuguguugaauuaccucuaugcuucuggcuugcacuagcauauacuuuaagaaacaacuguuggacaugccuuauuaaauuuauucuagggauuuuguaaacauaacaucuaccauaucuuucaauauaccuuuuaaagucaguuuauacugacuuuucccuaugaccuaauuaacgucuuauuucuuaugaacacuaugaauacuguaauugauaaaagugaguucauuacuauauccacuuggaugcauagagaaaaagugcaggcaaauaacaggacuaaauagauuucauuuuuauuuuauauuauuauuauuauugugacagagucucuguuguccaggcuggagugcaguggcaugaucucggcucacugcaaccuccaccuccuggguucaagagauucucuggccagguguggugcuucacccuugugaucccagcacuuugggaggucaagguggguggaucaccugaggucgggauuuugagaccagccuggccaacauggugaaaccccgucucuacuaaaauuacacaaauuagucaggcgugguggcgggugccuguaaucccagguacucuggaggcugaggcagaagaauagcuugaacccgggaggcggagguugcggugagccaagauugcgucacugcacugcagccugggugacagaaugaaacucugucucaaaaaacaaaacaaaacaaaacaaacaaaaacaacaaaaaaagauauucuccugccucagccucccaaguagcugggauuacaggcagguaucaccacauuuggcuaauuuuauuuuuuauuuuuuuaauuuuuaguaaagaucguguuucaucuugguggccaggcuggucuccaacuccuggccucaagugaucagcccgccuuggccucauaaagugcugggauuacaggagugagccaccaugcccggucucauuuuuauuuacuaaucuuuccuuuuuuuuauuuucauaaguugauauuuguauucucuuaauaccuuacuuauuuuauauaucuuuacauauaaagcauauuaauagaauuuguggccaauauuacuaguuauuacauccuuuuuauacacuaaucauugcugaaacagucuuuuaugcacuguaucauuaaucgucagagccauguuaagauguagguagcaguuauguucuauuuacuuucuuauuuugggggguuuauuuauauagauguauaauuuauuuauuuauauagcaagauggggucuugcucugucucccagucuagaguauaguggcgugaucucagcucacugcagccucaaccuccauggcuuaagugauccuccucucucagccucucaaguagcuaggacuaacuaaggcauguaccaccacccccagcuaacuuuacuuuaauuuuuuguagagacagcaucuccuuacguuguccaggcuguucacaaauuccagugcucaaaugauccuccugccccagcuucccaaaguacugggauuacaggcaugagccaccaugccuggaaucauuuuauagauaaggaaaauaagcuuucugccaguuaacuugcucaaagccaugcagguuugaaaaaaaaaaaaaacgaaauuggcauuugaauccagguuucucugacuacagaguaaaaguguuuaacuuuauacuacagcuggaucuccaaucauuuagcucacguuuuuguugaguuguacauuaccuuuuuaaucucauugucauuugacaucucucagaccagccauuuguaauuaggggagcagcucuuugguuuucugugaagcauacucacucauauucugaaaagucauucacaauccuuugguucuuugguaaauuucuguugcuuucuuucacagugauauaaaagaauagacauaaaaugaugauauucauuuuacauggucuauuuuuuguuacauggaaugcaaguuaaaauucagagugggaaaaaauccuagaaucuucuuauauaguaacaauuuaaaaacuggcucucuccuuccccuagucccuucuguuucucaauaucccaagguauaucaguuuaaaugucaggcaauauggcauugaaacuauuguccuuucaguggcacuagaagauaaugacagcuuaaccauucuaucuccuccugagaaagacauaggcagccuugaauggcugucugagagaaggguuagaugacugcucuaugauauguucuguaacuacacaaugaauuauugcaauacccagauacuuaaauggaauagcuuuguuuuccucuuaaagugaugaagacuguagaccuagguagaauaaguauuuuugcuuuaguuuaaauaagaguguaauaaaaccauaaaauuagaaagaaaacaacuuaaaaaauaaaacuaugaagaaucucuuaguaaacucaacagaacuuauuucuuggcaucugcccauagcagucugugcugagaacaguuauuuaacuuaugacucuuuaaagauauuuuuaaaugagaaauaaaaaauguguuuugauaaaguugaauuauuaguacuaaaauaauaauaauaguaugcuuaaauaaggaaaauuauucaugauaaaauaaaaaauaucuagaagacagugaaugccuuggaacauaaagcaaagugguaccauaaugaaugauuaaugccauaaugauguugguauguugguaugguuuaugcaccacaaaacguaggcuuagcucaguucacuuuuuagagaacauagaaauauuuugaaguaagacauaaggagucuuucagaauaaaaaaaaaaaaaacaauguaaaucccaguuguccuacuuacugcaugaucuuggagaaauaauuuauuguucuuagccucaguucauuuucuguucuuaaaauaacuggacacuguuuugagaauuauauuagaaaauaugggaguguuuaugagucccaggauugcuuuagguguuuccucagugcuaguuuugcuuuuuuuuuuuucaauuuuauuuuaagcgcuggaauacauauguagaauguucagauuuguugcauagguauauaugugucacgguaguuugcuguaccuauuaacccaucuuccagcuuuucagccccacauguauuagguaucucuacuaaugcucucacuccccuuguccccaccccugacaggcccucgugugugauguuccccuccuuguguccauauguucuuauuguucaacuccaacuuaucagugagaacauguggcguuugguuuuccauugcuguguuaguuugcugagaaugaugguuuccagcuucauccaugucccugcaaaggacaugaacucauucuuucuuaugccugcauaguauuccaugguguauaugugccacauuuucuuuguccagucuaucauugaugggcauuuggguugguuccaagucuuugcaauuguaaauagugcugcaauaaacauaugugugcauaugucuuuauagaaugauuuauaauccuuuggguauauacccaauaaugggauugcugggucaaaugguauuugguucuagauccuugagaaauugccauacugccuuccacaaugguucaacuaauuuacacucccaccaacaguguaaagguguuccuauuucucaauaaccuccccagcaucuguuguuuccugacuuuuaaaugauugccauucuaacuggcaugagaugguauccuguugugguuuugauuugcauuucuccaaugaccagugaugaugaccuuuuuugcauauguguguuggcccaauaaaugucuucugacaaaaacaagcaaugacgaaaggauucccuauuuaauaaauggugcugggaaaacuggcuagccauaugcagaaaacagaaaacuggaucccuuccuuacaccuuauacaaaaauuaacucaagaucgauuaaaggcuuaaauguaaaaccuaaaacuauaaaaacccuagaagaaaaccuagacaacaccauucaggacauagguaugggcaaagacuucaugacuaaaacaccaaaagcaauugcaacaaaagccaaaauugacaaaugggaucuaauuaaacuaaagagcuucugcacagccaaagaaacuaucaucagagugaacaggcaaccuacaggaugggagaaaauuuuugcaaucuauccaucugacaaaggucuaauauccagaagcuacaaggaacuuaaacaaauuuacaagaaaaaaacaaacaacuccaucaaaaagugggugaagaauauguacagacacuuguuugccuucuuuuaguuacuuauaccuguuucaacauguacuaaaacagagcauaaaaaaagcuagcaaauuuuugaaaaacaauguuuuucaguguugauuaacauuaccaaaaucacacaagagaaaaagaaaaaaauguaaaacuucauuaauugaguuaauuggggugaggaaguuaucaucuguaauuaguuaaaagucagaaauguagggcauuuauaaccaaauaugaauuuauuuucuucagggcuauaaagcaauauaaaccaauuauuaaacaauguugccaaagaaugauucugacaaaucuaccuuaaugaagagauaagaaacacauaauuagcacacuauucuauacaagugcucuaguagacugcuuagaccaaguuguuuucuuaaauaaguuaagcaguuucaucuuaagucccuaccuaauccaauuaaaacuauuaauuuacuaauucuaucaaagguaauuuuugucuaucuaucaagugcaaaucuauucgcagauuucuacaauaaagucauuaugaauucugaauaaauuuaacuuaauaaacuuugguugccagugacugguagaagagucaaaguggaccugggaacuaaaaucaguauaguccuauuuugauuuuagcaacucaaauguaaucggcuuugguuuuauuuaggaaacaauccuugaccaauauuaccaauuacuugaggaguuguaggggaauacaguuucucagacuuuuuaguuggagauugaagucaagaaagccuagcaggaaguuccugaaacugaaucugcaauaggaauucuuacauaucuauuaaucugaucauuuguggagauauauuuugacauucucaacauuaacuaucaaguuaacuaucaaaauugguuacuuagcuauagauucauaccaaacaaaugacuugacagcauauuccugcaaguuuaaaaaagaaagaaaacugucagcaauauaacaagcucuauguuaaauaauuugaaacauaaaauagcaaacuagauuuauuuuagcuaaaaggaaagugcuuauauccaucucuucauauaucauucauucauuaauucauuuuuuuauucguugagcauuuacacugcuuuguacccucuuaagggcaucagaugcaacaauuaagugugagucacugccaugaaauggcuucucugaaauauuggugucuuggcuggagaaaaaaaucauauuuaagauaauaugauuaaaagcuacuuagcauuuaaacaaaacccaguagugugaagauacuaccaggaugguagaauaucgggucuugacggggcugggagguguuaaacacauaaauguuuuaacaaauaaagacagaagggacauaguaacaaaaauugacucccuccuuuuuuuuuuuuuuuuuaaaucucaggaucccuuuacauugcuaaaaaguauugaguuuuccaaagaguuuuuguuuauguggauuauaccuguugauguuuauugcacccaaaauuaaccugauaauuuccaauauauaugcuuuuucauucauuaaacguuaauauaacuaacaaauauuuuuuggauaaauauaaaugguuuuaaauaaaauagaauaguuuaauugccuaacacuugcaaaucccuugguauuugacuuaauagaggauaaguggauucuuuuaucugauuuucuacucaauuuguuaagaaacaugaauugaaauaugaggaaggcccagcuuuauacaggaauguaacuggaggggagaaguguauuucaauagccuucccauaaaauuuuggauauuuuugaugaaacauaaaaacuccuaucucaguuagaauauggaaccugaaacauaucaaugaacucuucucaaugaacugauaguaucccaaggccacaccaugagaacacuuggauauaaaggaaauaacauuagaucaaucaaaccaauuaccagucuauaaaaucagauugccuaagucuuucuaauuguuauaugaaaaacucauguuguaauacuugacauuuuaaaucagcugauuugcaaaucaauauaagguuuuguacaaaaguacuaaauuaauuuaaauauguugguuaucuuauacagauaauuauaaauugucacauucaaagcuagaauaauguaaugcaaguagucuaguaagcuuaacugcuaugauucaugcauuugacaaauaucuaucaagagccuucugaguccuagguacuauuauggauacuggacaugcaguauggaacaaaacuggcaaaaaucacuucuuuuuggaacuuacacuccagugggaauaacagaccacaaaugagauaauuaauuaaaaacugaaacauguuauacagaaguacuauggacaaauauagagcaggaaggaagauagaaaauaugguguguuagggauugcugguuggaacgucauuagauggugcauccaggaaaagccucaaugagagaggaagauuaauguaaagagcaaaagagucuuaggaaucaauccaugaagcuaucagggaagaguuuucaaggcagaggauagcaagugcaaagacccuaaguuggaugcauaccuugucuguuuaaauaaaauggacaaagagaaauaaguaggaaugaguucagagaagguaggaggaaaggaggagacagagcaagggcagauuacauaggauuucuagcucugaaaaaggacuuuggcauuuacucugaaugaaagagaaaacuacugagaauuuugagcagaagggugacaagaugccacuuguguuuuaacaggaucacucuggcugcuguacugaguacucacugaaggagugccaaguuggaacacucaggauacuuucagcuacaaguagcaauauaucaaaccaaaaguggcuuaagcaguuaggacauuuaauauuucuccuaacaugggcuccagaaaaugaauuaaguaguuccccaguguugcuaagaacaugaaggcuguuuccuuuuuugcugauggcacaauguccaggugucuauugaacauuccuucaggccugcauaugggcugccuuggcuccuugcauuacaugcuauuuugacaacaugguuucuguugggggcggagguggcucucauuuauaugggaauaauaugcaaccuagcuuacuaaaauauccaccuuuaaauacccauaugugaaugggaacaguaugaccaagacugguuuuagccuugcuaugugucaugucacauagcaaauaaugauagagguaugagauguuagagcaaacagacaagacugcagaagccuggagguguucuguuuauggcauuuggccauguuaagacucacuucgcugucaugacagcugaagaaucaaugucucagcauguuuguaacccuccucggugccauagcacaacugauaagcagagcugcugcuuauguucauguaacuugguaccuggccaagaguuuuaguaggggcugaaguucagucuggauucuucucaacagacugcgagccccaauggaaggugaauuuuuuucuguucaucauccuugaguucauaggaugauuuuuuauuguaauuugcgcaaagguucucuuuaggcuaguuguacccugguuuacuacugguuuuucaucccugggcauaauacaugaacuaaaucagaagaagagguggacgauuguuugcaaaguaucuaagugucugucauggaaauauuucuuaaaugggcagauauauguuaguacuuuuaaaaaaaauuuuauguauuuuuaauuauacuuuaaguucugggauacauguuaauaccuuuuuuuuaagaaauuuguggauaugaaaaauaaauuguggauuauaaacuuucauauauuuaucugguuaucaugucauuauugcuauagcaucaauguguuuaauaguuuuucuaacaaccuauuuugauuauuuuauuaauuacaaaggagcacuucauggguuuuccuaaaaaacaauaucuaaagguaaaguuuaauguuuauagaggcaauuuaaaguuaauuucuuagucaauccaaauucuuaauauuauuuauacaguaguuuaugaguagacauaucagcaauuaacauaaacuaaaagaguaaacuuguuacacauaaaugcaaggggaauggacugauaagagacaaaggcagagcuuugaggugggucugauaauuauaauuuucuuuaguuuuuuaaaagagcaauuaauggcuuucaacuguuauuaaauuuugaaauaaauaauaaaaguuuauuuucagaaacauauguuaauaauuaauuuauucuuuugagaauauaaaacccuagccaugaaacuagcacccaagacagaaguauuuucuuagcaaaaaagggugucacagguagcagggaauagcuggcaaaaacugcuagaaacaaacaaacaaaagaaauggggaaaaaaaucauagcuacuacacagcagagacuuaaacauuuggagauaauaaaaagaucauauauuuuucaaauacacaaguaaugauaaauuuuaauaaccuccaacaaauauaagaaccuaaugauauuuuauggauucuauuuauaaaggaagagaaccucagccuaagcaggcaaaaaugccuuuaucuacgucuuucuuagccuacaggucaaacuccuaacauuccuguucaccuggccuaaccuucauuaucuagcucagacauuucagagauguuucacuucauccuaucuccccugaacuaccagccagauugaaggucccuuuguauuagauauuauccauaauauuaguuauuaggcaaccccauagacaccaucccuguuccuacuaccaccagucccuauucuaaauuucauugucaacacuggaaggaauuacugaugggauucagaguauucuggagucaucacaaacaguucgaccugucaggcacugggguggacaaugcacacuccuaggaaaauagucacauccuucuuuuauuuuguggccauuuuuguauccaugguaagauaaauaaacaaaagggcuuagaaggaauuucagaguuuaucagauuagcaccucuuuaccaaacaacuaauuuaucuuauuacugacacacuaaaauuaaucauaacuuaaggaagauguaagauuuuuuuuauugugcaaugaucuagauacauuuuuaaucuagaacuuuucagugauuguuucuaauaaauauaaauacuauucaguugacaagaagauggauuggaguuuucuagucaaacagacccguguugccauccagguuccaaccuuucuaucugugugacuauagacagcauaauuugcuucccugagcugauuucucucaugucaccuauuacggauucaauaaguuauuaauguccuuuaacaaauuuagcaaauaucaauagaucaaucuuguacagggugcuagggauuggcagcaaauaagagauaagcucuguauauuuuaaauauaaaaggcugcuuuuuucauuacuuauauauugucaaaaauucugccaugaaauguucauaguuccuaauuuuaauccuuguaccaauuggcaauagacaacuucuuuucuccauauauaugugacucauaaagggcaaagggcaaacaauucaaccagcuccaagauacuuuuguacauaauuaccuucuccaauauugcccuucacauagacucuaaauuagugaaacuauuccauccuaugccuauauuuuguauuuuucauguauuaaaauuucccugcuuggcuuacuuuuuuguggcagggcuguggcaggacuggcugugguguuugucccucuggucucucugaguggcauccucguugcugcagugacaccugaccucaccaccaccaugacagagcagaagacccuuugugacacucuugaaggccacaauaccugaguaaccagaucgcuacugcccuggacaugauacaguccaccucuugagacaaaaucaucaucauguggacauugaacagggacgaaaccaacuauggcaucccacagcaugcccuggagggucauuuccacuuugucuaugacaaaaucaucucuucagguggccacuuuuuccucucagccuccugagauggaaaccugugcuucugggaucugacaaagggcaccacuaugagaugaucuguaggccauaccaaggacguguugaguguggccuucuccauugacaaccuguagauugucucuagauccugagauaaaaccgucuaguuaugguuauaacccugaguauauacaaauacacuguccagguggagagccacucagaguaggugucuuauguccacuucucaccuaacggcagcaacacuaucaccucuguagcugggacaagcuggucaagguacggaaucuggcuaacugcaagcugaagaugaaccacuuuggccacacaguccaucugaacacugugacugucucuccagauggaucccucugugcuucuggaggcaaugcuggccaugccaugccaugccaugcgaucucaacaaaggcaagcaccuugauaugcuauguggugggaauaucaucaaugcccugugcuuuagccucaacugcuacugguucugcgcuaccacaggccucagcaucaagaucugggacuuagaaggcaagaccaccauagaaauuaagcaagaaguuaucggaaucugcagcaaggcagagacuccccauugcaccucucuggucugcugauggccagacugcuggcuacauagacaaucuggugcaaguguggcagguggccaucagcaccugcuagauauuuauggcagaacuuuagguuucuuucaacugacuuucugauuuaaaacaaaaaaucuuccuacuuuaaucauuauuaacuuccccagcagugaaacauaaagagauggggagaaaguauuuaaguggcuguucauauuaugaaacacaguuuuugcuugaguugccggacugcuuagcuugaggacaaguuggaaauggaaaaaggaaucacugccuuuuggucuugcuauguguguuuuauuaugauugagagaauauuacuuaaaauagcuuuuauggugccuuauugagggggugggcuauaugcaggcagauuccaacacaauuuguaaguugaucacaguagaaugaucugguuuucuuguauuacauuaaugaauguggaaugcuuguagaaucaaaaauauuauuuuaaauuucuguuuauguaacuccaggguauuaacugaaaucaagaucaauuaccuaguaauauggucaaauuuaaaucuuaaacacuuuugagaaacuuaaaaaaaacaaacagcuacaaaaauacuguaacaaauucuuacauagaauccaugauuaucaauagaaacauuucaucauuuuaacuuuaucuaugaaauaaauuaagcaugacagauaagguugucaaccauuuuguucucucuucuaaucccauucccucauugccagaggcgcugaccauccuaauuuuggugugcuucuuaaugucgcauuuugcuccacauauuuuuguauuggaauuauuuacaagaagcacucauuacuuuagaaauaaacacaauuuuaugaaauaucuggccuaaauuauguugaauuaagccaguuaaacauaucaauucaaaauaucuacuuuuggaguauaccuaaauuucaaauuggcuauauauaugguuauuuaaauguaucaauuucuuuaucacuguguuaaguaaaaaucacaauauuuaugcauacuuccauguauaaguuguuuauaauuagcuguuuuaucuuaaguauauauauuagagaagaugauuauaguauugcuucuagguuauuuuguuaauuugaaaaucagauuagauuuuuagacaucuaauuugauauuauacagauacaagagaauaggaauuuuguacaauuuaagauuauuaauuauaacaugauaauuuuaauagauauugauuucaguaaaaauugaaccugaaauuaauagaauguugaagauacuuguauauacaucacuguugccugaaauaucaaccguaguacaaaaaaugcauucuaaauagaacugaagaaguuuaucugcugaaacgagacugcagaagacauuaugccacccgcuauuuccaggguauuuauaggauucugacauucucuaagcuaaacacuuucuauaaaguucauugcagccaagacuacucacuucuaguaaguaccauaagcaaaccagagguugcauagugcuguuuucuuucuuuguuuucauuugcugcuaacaguguuuugagucauucugacuuugguagaguuaacucugccuguuugauauuuugagaauuuuuagguuucugcuaucuuaacuguuucucugacuuucagcuuaaaucuaaaggcauuagagugcccuuuagaaucccuaagaucuacucacaucgaguucacagcauugcacugguccuuuugccuacauauuaauucuuaguuucuagacuuucaacauauuccaaauaaguaugugugucauaaaagaagcauuacauucaaaguuagaagggaaggauucuugucauagcccucuccccuaaaaaccaauaaacuuuauaaaacucauuaauucccaugucucagggcugugggcagaaccaaaugagaagugaaugugaaagucuuuaauaugcaaagcagaguaucuuauguugucauuugucaguucuagauuguuucaagacagugucuuucaaaaaugagauuguaaaugguacuacgcaauugguaguuaacucaucgaaauucuauucaucugaaaaauaucugaugcuuaguaaaagaaagcacauuauaauucucacuauuauucauauauuaucaaaacaagacagacuuuuaucauuucucuucauuauggaguacuaauaauuuauaagcuuauugcaauuaaaacugcuuaauaccaaagauuacuuaacugcaaacaagauaugaaaagaaaaaaaauauuuuaagcaucugagcaaaaaauauaucucuaauuuguuuuugucaccuaugcugucguaguaauauccuuuccugcaguugguagucaaauauuuccacaacauaguccuauuaucauuuuucaaauuuauuuuuuuuaaauaguaagaaugaccauuaauuaaacugacuccaaauacuaaguauuuuacaugcuuuaguuuauccccaucuuacaggaaaauagagauuucaagaaguuuaguaacuagcccaagaucacauaguuacugagugaggcuguuuggguuuuauccugcccaugugauucuaauauuccuuuuuaaacccuauucacucuucaugccgcccccauacaugugcccuucauuuuaguccagugguucucaguacuggcugcacauuggaaucacucaggagcuuaaaaacuucugaugccaggaccccucucucagcaauugggguugaauuugucugugguggagauuugugaugaugucugagccuaaguuuuaaaaccucccaugggugauugugauguauaaacagcacugagaaucucagauuuggccaaaauuauccacuuucuagauaauucuuugaaugauacuaugcuuuccuauugccguaacauuugcucaugcucaugcucaugcugggaguaaaguugccuaguuuauaaaacaagggcuuugguguaggacagaaauaaauaguucugauucagugcccauuacuaaccuaucacagcauucagguauauacagugagaaugaagcucuugcaacauaagcuucuucauaaauauuuaaaaaugagaaaaauuauaugcuauagaauuauugugaaggguauaucaagcagauaaauuacagauacaauuauauaauuugggcuucaagauauuauucauguagaaaacaugcuucaaguaaguauugcaaaaggguaguuguccauaggcagaaauucauugaguauauucauaugugucugauauaaacuucauguuugccucacacacccagaagagacaugaaguaugaaagagcacuuccagaggggcugcucugggugagguaagagauuucaaugguauagcgacucaucaaguuaauauaagaaagguucuucugacuuccucauauauuugccacuugcccauuuacuuaaaacuaaauugaacagcuaauaaguuugcgagcaagaucauuuccaagcaauacaccaaaucagacuguuaacuguccauuaguauaggcaaaauagcucuuauuaaguugggccuucguugguaaugccuuuucucauucuaccuccaccugucaaaauucuccaucauuaucuuucaacacccaucucaaaugccauuuuucuuuuuuaauguuuccugaauacaaagauaauagcuaaugacacuuuuagucucucuuguaugggugaaguugaauacaaaaaaaagaaggaaucuguauuauucauucauucauucaaauguaauuuauugagaaauauacacugggcaagagguuaugauuuuuaaaauacuguuauucugcuuaucaguuuauaauuaagugggaauaacagacauaaaguucacaguugaaguuuagugugacaccugagauaaugugacaccugagauaacagaaacaguuguggauauagugauaacauaaaagacaacaugaucaucaauaucucauauguagaugugucacaaaagguuucacacacaugaauaugauugaggucaguuuugcagcaucuuuuggauaacauaguuuuuagcggcaaacauagcauuggccugacucuaccacuuauaauucuguaaacuuggacaugaaauaaaacuccucuguaucuguuuccucacuaaauugccauagaacuuacauuaaauaauauguguaaaaaaauuggcaaggcuggacgcaagggcucacaccuauaaucucaacacuuugagaggccaagggagaggaucacuugggccaaggaguuugagacuagcaugggcaauauagugagacaccaucucuccaaaaaaaaaaagccaaauaucuaacaacauaaggcaagaagccaucaacaaaucccaguaguuuugauacaaaucaauuaaacauuauuauaauggcauuccagauaaaauauaagauuugaaaaaauaaggaagcauaaaaacaaucucaaggaauugucagcaauucucauaaaauuaagcauuagauauuuaugaggagauauggccuuaugagagauauggcuagacagguagguuaagacuagaacuuaaagguuuugguaaggucauccuauggauaaaguaaugucaucuaggauaaguacaaacuuuauccugaagaaaauaggaguaagguguauggagagaaugguauuaaaaguuuuguagagaggaauaauaugauccaauuauaauuuuuuaaacccacagcaauguagcugauaaaagcggggauaaaaugcagugaaaaacuaaaugaauuaagccaaauaagaaaaaaauauauagaauugcugguauuuacaguuaaagaaaauuuuaagggugaauaugaggaaggaaacauacuaaauugaauuuuaaaagacagauugaacaugacuuaguggccagcuggaugugaaugugaguaguguaggguuaauggugacuccugggucccugaauuguguaacuaggugaaggucauugaagguuuuaaccauccaagaugguuaaaacaugggacuagauuuuaaagauaguagaugaaguucuaaguuacaugaagggcagcuagguaguuauguacaaaguaaaccuuagaagagagagaagaauugcagauacaugcacacuauaucccuguuuuuaaauuuaacaguuuuuauuuauuguaaaguuauuucuccucaauuuucaauacagcagagcuuuguaaguuguuaaugaguuuaaucuuuuacuaaauccacaaaaacucuuucauaaacuaguacuauuagaauccccauuuuccagaagaguuauguaaacuuuaaacagugaaugaaaagguagaauuugaaucuagaccacaugaaucaaaugccagaacucuuuuaguagcaaauauuuacgcaucauuucuuagaaaauacuuaagauauuuguaauuuuuguaauuuuagcauauuuaaccuucauuugcaaacacuccucccuucuccuuguggaaaccuuuaccaaacucugacauuuauuuugccuggcuauauaacagacaaucaguauacauaaaccugaaaacaaggaaacaugcauuaauguaugagcaauaauaagguuuuaaugugaauaaauuugaagacaaauggguuaaaguacauucggcauaaauggguuaagguacaucuuuaguaaaauguacuuuuuuuuuuuuuuuuuuuuuuuggugagacagagauuuacucuuguugcccagacuggagugcaauggugcgauuucagcucaccacauacuccgccucccagguucaagugauucuccugccucagccucccgaguagcugggauugcacgcaugugccaccacacccggcuaauuuuguauuuuugguagagaugggguuucaccauguugccuaggcugaucucgaacuccggaccucaggugauccaccugccuuggccucccaaagugcugggauuacaggcaugagccaccaugcuuggccaguaaaauguacuuuuaaaaacaauauugcucuuuuguuugugagggguuuuuuuuuugguugguuuuuuuuuggcuuuuuguuuuuuucuuuccuuuuuuuuuuuuuuuuuuuuuuuugagacagggucaugcacugucaccuuggcuggaguacagugauacggucacggcucacugcagccuccuggacucaggugaucuuuccaccucagccucccaaguagcugggacuacagguacacaccacaaugcccaguuaguuuuuauuuauuuauuuauuuuguagagaugaaguaucaucauguugcccaggcugguauugaacuccuuugcucaagcaaucccccugccucagccucccaaaguauugagauuacagguaugagccacuacacccagccccaauguuauccuuuaaguauaauaagauuauaacauuucagaaaucaacauguguuaguacaauauuuuauaacauucaaagauggaaacuaaaguaaauuuccuauaccuaccuuuauuuaaauuaauaggaaaaucaauguguggcauaauccuuucaaagguagaaacuuauguuuuuaacuagcugauaccaagacuugucauuugucuuucugauguuuaaaguagcuaccuucuagcuuucagcaagcccauuuuauuaauuuucaaauuggucaaucauaaaucaaauauugacuuuauauacacccauauaugcccacacaugcucauacacuuacuaagcacaauaaugugcacuuauguaacacaguuaucuuuaaugcuuaggauauaucuugugcacauaaaaugucaaaguuuauaucauauuaauaagaauaugauggagaaauauaguaauauuuauuugagauuuuuuaaaaauccugggcacaaaaggaaaguuaagaauguauuucuaucuuguaagaaauucugauuuguucaaagagucaauaaacaaguauauugugccaauuaugaauacauugauuaucacauccaaauccaccccccacugccugcucuacaauaauggagauggguuugauaaauauuucucccuugugaacuugcacauuuugagcucugucaguacaugacauuggggggacacuagagggagaaagguuucucuuucugguccuagugugcuccucucagcaugcagcuucuuuaauaccuggcuccuauagaacaugguggcuagaagcacccagacacugugucugauggcuuuucagugaguuccgaagcccagcacuuccuguggauggcaucuuccacacccccuuaaguugcuuugcauuaacuuucaaugugcagucuccuuguggauagcauuuuccauuacccucucagauagcauagcagugaaguguugccaaugaggcaccucuacgaagauggcaccccuuagauggcuuugaagaggagugcugcugguuaggauccucccuaugggugacuuauuuggaaucccagaggaaaacauuuccaacaaguccugcuguuccagcaccucagcaauuuguccaccagccagugagccacgggcauguccucacaaauaaaguuuggauaucagccuugcaggggaugaagagguucuuuuuggguaccucucagcuucagaggcaaugguuucuccuuauaauuauuauuacuauauucuuuagacuccucuuuaguuauuacuagcuaaucuuccauuacauaaauacuguauuauaucuacuuauucuuuauguaaaacuuucuccaaauuacuguguggguucuaucuguugguaggccucugacuaccacauacaucaaaaguaaaauaagauccaauccaaggaucaagucacaauaauacaagacacaaauacaaaaugugcccacuccauggcauaaaagaaauagcaagugcugcaacagaaaaugaaaguaucaguaaaaugcuucauggacuuuggguuagaucuccaaggauagaggacauuuuuuuucagauagagaagaauagggaaaacuuucugugaaugacuuaacaaaggaacucugcuuacauuguuagggaaucaaugaguaggaacagagaacuggcaggguaaauguagaagauuaauuaggcuagaaauauaugguaagaucagauccaaagaaucuuucaaugcgauguuaaggauuuugcacauauuauauagacacugguaagcuaaacagauuuucaccucaaaauacguuuccuuuagaaacucaguuuuauauuagauacuuuaucuguggacacugacuuauaauaugguucugccugauucuaaaaugaaaucauaugcuuacaucuuaaaaagugugugugaguauaugugugugugugugcgugcgugugucuguacugaaguuaaaugaagaauucugauaaaucugaauggauauaaauauguauucaaaagcaaaacagcugaaauaauuugucagagaugccagauacuaagagcauuauuuguauuaugaauauuuugauuuugguagguguuaugaauugaauguuuguauauccaaaaaauuuuauaugugaaaucaaauccccacagcauacggaguuagggucuuugggagauaauuaaguagaaccuauuaaugaaauuaagcgccuguauagcuugcucucuuucugcugugugaggauauaaguugguuguuugcaacaaggaagagggcuugaaccagaaccuggccaugcugacguucugaucucagaugucuagccuucagaauuguuagacauaaaugucuguuguuuaagcaucccagucuaugguaauuugcuauagcagccuaaauugaccaaaacagugggugaccaggaaauauauuuuuaucauaauuuccuucacaguccauauuguaaacaucaguuauaguuuaagaacugcagggcauaaagauuugacauuucaagauagagucugaaggaaaucuaaagguauauacacauaucuuaaaaagccacaaguaaaagugcacauuauucacuauccagaggaacagaauugaguccuggauacuaucaaagucauaaaaugacauaaaauggauauuaccuagggguuuagauaaugcauucuuuucccauuuuguuaagcucugagugagacugaacugucagacaccugucaaguagaaggaaacuucaagcaacaccuucaagaaguagcaaauuaaguaucugucaacgaguuauuggacugaaugggaaugucaaacaugccagaauuauagacacuuucuguaucaaguugcaagauuauuuauaaagaguuguauaccuguacagcauaaaucaguuuuucauucaucugaugcuagugaucuuaucaucacuauauauaauucagcuuggauaagaaaacaaaaaucaccauauaaaguugcuuuauuaaaacagggguauuaugcuaaauuaauuauugguauuuaaauacuacauuuaaaaucacagugguaauaguguaaugaaaauauacauguaaaauuugcauuuauaugauguaugguuucauccauguguugauuguaauuuuuaaauccaaauacauuuccauuuucucagggaagagaguuccuaucaccaaaaacacccuccucccauggaaagaauguuuugauuaaaucuguuucacucuuuuuuauuuauccgauuuggcagaucauuuucaccacuuaagaauguuuuuauaaucuauauuacaauauuaaaucagagugauuuauuuuuaaaugucuaaacugacauauaucucacucacagauaauaaacauccacuuaccuuucuugggaaaaugcugauauucauauauuaaagaucuucacauauuuauuugaaaaucagaguuccuaauaagcuauugcuaaaaacaauguucauucacguucacauaaagguuguacagauuuucuaaggcgaagccuuuuuggcacauguuauuuuuaauauauagaauauuguagggagcaaacaaauggaguuuacuuaugcaaaaugccuauucucaagauuuaaaaauuugguagaugauccuuacugguacugccuuucagaugacugaaugugacagucucuaauuacagauaaguacaucuuuaaaauugaaucuaagcauaaagaaguacgucacgauuuugaauuauuugauuaccucuuugcuacuuuuaaauuguuaacagacauuuguucaaugauauucacauuguuaaauaugucucccauuuucauaugauuuuacuuuaauugucgacuguuuauauuuuacucacaauaaaauuauauuauaaaaugcaauuacuuuaacuggcauaaguuccugaagaaaaaaaucauauaggucaauuuuccugacucauuauucagccaucaauacaauccuggaccucuagugaaaaacacaaaacugagucaauuuguuuuugagaaauacuaggauauuuggaaucauuuagguaaauuuggggguuaaugacugauuugauauacauuucaguuuaucucagugaauagacaauuacaaaaauaauguccucccucacauuuuguuuuaaugcaugcaaaacagacaaaauacaaaagaaacaguaaagaaagcaauuuuacagauaauacugaaaauauuaaguaaaagaaaauuuggguaugaaauauacuaaaacacggaauuuuccuuuuccaaugcauauacacuggagucagaguaaaaaagguauggauauguuuuacuauuauuuaaaagaaaaauuauaguauaaaacuacauuuuuaguuagaaaauuauacuuuuuauuucaaggauuucagggacaguugcauacugcaaaaagauauuuuuggauuaaguaccuaaaugcucuaagauuuaucuuagauaugguaccaggugaacuaaaaaucuugauucuaggccaggcacagcaguucaugccuguaguuccagcacuuuggaaggccgaggcagguggacugcuugaggccaggaguuugagaccaaccuggccaacauggugaaacuucaucucuacuaaaaguacaaaaauugcguggugugcaccuguagucccagauaaucuggaggcugaggcaugagaaucacuugaacccgggaggcggagguugcagugagccaagauugugccaccacacuccagucugggcaauagagugagacucugucucaaaaacaaaauaaauaaauaaguacgaaauaaaaauuuaagaaaacagcaagcaaaaaauuaaaaccuugauuccugcuaaagagaaauguauuuuacaaaaguaguuauauaagcuuucauccucaaaguuacuauuacacuuccauucauuuuucuuacugugguaagaauucauaagauugucuaugaaucagauuuacacacaaccuuguauaucuacaaaugccucacaaauuuuauaauuuaugggcuaccaguaacagugccaaugugaaaaaugauaaaaagucauugacacuucuuuuuauucuuuuuuaaaaauuguauuauuucaguagcuucagggguacaaguaguuuuuaguuaaauagacgaacuguguaaugguggagucuaggauuuuagugcaacugucacaugaguagcacacacuaugccaauuuuuaaaaauucuuaaagugugcuauaauucccaaaaaugaaaauaucuaacugugguuaaaaaaauuuaaaauaacucauaaauuaaggauagguuccgugaaauuugcaaaaaaaaaaagugcauccuaaaaaucucuaauuucaucaaauuagaaacuguaacugaaugaauuuucaaaaaauuuuaaguucuuucagagacauaagugacauucaaauuuauauuguucaaucaaauauuagaugauauaaauuauacuaaguagucacaacauugaagucauauuaaaucugaugaaaauuaugcuuauaucuaauugaaauuauguuuaaaguugaagaauuaucaauagaacccucaguaucuaucagaugaaauacuauauuuucaaaaaugaaaagugaacaggaccaacguuuguugaacaucuacaaggugucaggucagacauuaacaggaauuauuaaguuuauacuucacuacaccuggugauauaaauauuaugauauauuuacaacauaaacuauacauuuuuagaugcaauaaagaauaaaauaguggaaaaaugcaugaguuugguagguaauaccuucaacugcagacuaaugcaacuauagugauacaguggacaaauaacagcauaauguaauuuuaaaauaauaucuuguuuuauccuauuucuguuugguuugccaaugucagaucaagaaggagauuauucaugcuauuuuucaaacuggggcuggauggucaccuaucaggaguauugcgaaauggaauguugcaauuuagaacagaagaccauuuuggaggucuccuucaaaucuaagaaucuaggauuugaaauauucaggaaagcuaaucaacuuccccaaaauauuaaacguauauucacuacuguaucucacaaauaacugcaaucacuaacuguaugaguaggcacuaaaaugacauuugggucaaagaagauucuaauaaauauuuauuccacauuccaugauaguaaauuuuuaguauaguuccuugacaauaguucccucagaauuuuuuaugcagguucaauuuacugcugauuauuuucauacuccuaaggcucaauuaaaauuuauuuuuauuugcaaaguggcucaaaguuuuagccaugaaaacuaagauuuuuuaguuuuaaauacuacuacaugcuaucucuuaaaauguuuguucuaaagggcauggauaagaaaauauuaauaaaaugugaugcuuuugaagagacaauuuagcaagauauuauauuaauauuuuggcagaguaucuuuucuugcucaaaucauggaccuauuuccgcaauuauacuaugugaaaauauuuguaaaauauggcuaaaauuaaggaaauucauuuuuauacccuauuugauuuguaaauuuguuugaccaaaaugcucucaucuaggauauccuuugagugacugucuuauuucuucacuuauccuagcauaaauauuggcccaaaauauuuuguuuuauccaacugagaauauaaguuucucaguguuagccaacaugggaauaaaauaguaaaaaaaaaaaaaauucacgaucuuuugccuuauuaacgugugcauuuugcugggugaaaguacccagagauuucauguucugugaccucaaaacaauaguguguauaaugauauugaacccaauacuucaguuauuuccaguacacugauguuuauucaguuguucaguucucugguccuguuuauaaacuuaagcucuacaaaaauaaagcagaaacaaugaguucacuuugacuugaaaguuucuuccgaaauggaaguuaccuuuucuaauuaaaucacuuccuuugcuuaaauuuuacauccccuaaacauguuuauuucuaaucuaaaauaauucuggugaaauauuuguaagcaguguuaaucauauaugcugaucuuaugacugaguaacaaauucugauuuaaauuuacaccuuauugguaccauaaaauguuugacuuuuuuacuacuuuccuauugauucuguaacaaauuaccagaagcuuaguggcuuaccucaacacgaauacauuaucuuauaauuauagaggccagaaaaccaaaauggaucuuauggaguuaaauaaauguuucaacucugcuguguguuccuucuggaggcuucaaggaggguuucuuccagucucuagugauacccgcauaccucagcuuacacccuuuucuuccaucuucaaagccagcaguugcagcaccaaaaaaucucucuccugcucugacacuuuuaucucccucuuacaagaacccuuaugauuacaauauaaucacccagauaaucugggaaaaucuccccauuucaaaauccucaauuuaauuauauccguaaaguccuuuuugcaaguagguaauauguucacagguuuuggggauuagaacaugggcauauuggggagacauuauucugccuaccacaauacuuaauaauguucauuuaagcugauuuccacaaaauaauacauagacagacacauacgcacacaugcacacacacauaaacauguggguaaauguagaaguuagaaaaacuaugucuaaaagagaacgugaaguuguuauaaugauauccuaccccugcugauucucuuccgucuuauuauuucuucagcauaucuuaucaacgucuccuuucacuuacaauuugaggggacuuuucugcauauaugguaaauuaauuggccaaugucucaugucauggucaucucuuuugguagugcuuuuguauuuuuuaauauuauagauuuuauuauguguauaaaauauucacauauucuucauuugagaaauauuccaauuacaacuccuuguauucacugcuuauuuuuugccuuuucuugcugagucacugauacuuacuuugacauuuuuuuugcacaucacauuuaaaauaugcacacagaaagaaaauauauuaaaaauauaaaaaagguacaaacuuuaaucaacauauauguugccuagguaguuuuauuuuuuaugaguccucugaaaauaagcaaaggguacacuuuaucuguaugcacaauauauagauauuccagaaaaagguuauauuuaaaaaauggugcaguaggccaaaauuuaaauacucaauuuaagucgaacucacauuguugaaaugaucaaaugacaagaaagcaaucuguucuuaaacauuuaaggcaaauacauauauugaggcaugaucauauaaccugaaauuuggaacaauauuggaugaauauguagaaaacugagccuuuacaauugcaagagaauaaaagaugauugauuuuccagauaauaggugaacaauugacauauuucuuuuaaauucccuauucuauccaaaaugcauguuuuuaugucccacaacauaugucauagcugcuuucauccccggacuuuugcuuuuuuuuggucucugaaaugacuucaccucugcccucugccuaucuaaauauuauauaaccuucaauuucaauuguaaugauaacuuucuuugaguuaaucauuuaaagcuuuuguuuucuuaucugcaaauuacaaauaauacuaaaacuuauuugcagaaguuuugaaaguuccaucaaaauacuauuagaaauacuacugaaguaaaauuauuuuuucaaacuaugaaauguuguccaaauaauaauuauuaauaucuuagauuauauuugguauguacaauauaugucaggcucuuauauaucuuagguccuaauuaucauacuuagcacagaacauaaauuucaaauaagauacauuacuugguauaaaagaaaauauauauuguaauaguggagacagaaauauaaaaagaaggcuuauuuucuuaaaaaaauacauacuaggaaaggggucagcagaagguauaauggaggaagaacaccuaugucaguuuuggaacaacagaugaaaauaagccuauugcauuuauacaaucuuuuaauauagauaacaagaacaauauaaccacaagucuccaguguauuuuuaaaaauucuuuguguaagagauaguuuucuaaguccuucuuucgguauccuaaggagugaauggaaucucuuaagguaacgaaaaugugauuuauuuagauauccgugugugugugugugugugugugugugugugugugugugugugugucgauagccuauuuucuaauagauuugacauaguuuauagcaaagaugcaauauaacccuuaaaucacaguacauauaaaagggccaagaauaaaugauguuugagagaaauauuguuucagauaauuuagaauuuugggaauuuguauauauuugaacauaaugaugagagaaaagaucaauacaaaauaugauuguguagugccaggaaggugauaguagggagaaaaaacaguaaauacgauuugcagaguugaaagggaaaucaaagagauaaucugaacucuuggaaaaagagcucaaaaaaaauaacauauagagaaacuaugagaagugucaaaaagaggaaauuacuuuuuuuucuuucuuuuaagagagaguuucacuuuaucacucaggcuggagagugcaaugucaaugucauagcucacugccuucaacuucuuggcuaaagugauucugcugccugggccucccaaagugcugggauuacaagcgugagccacugcaccaagcaaaucaucuuccuuuaaacaccguauaauaggauuuuuagagaucaagagaacuuuagaggaucuaaauucagaauuucccaaacgaugucuccaaaauacauuuuauuaguuggcauuucuuucauaaaaaucgcugaucauauacauuuguaaaaaguaccucaaaugaaagaaaugcuuuugcuacauaaauucucagacccaaugcugauguguccucaaaagaaggauguuguauuucccaaauguauuugaccacaauucucuuuuuauaguaauuucuauuaacaccaaaaagagaauuuugguguugggaacaauaagaaaucccaauuuaauccauuuauuuuauuuauguuauuaaaauaacuguauaaaugagguaguugaagcacagagagagagagagaaaaguaucaaaaaaaucacacagaaauuugguaaaagagaaauaacgauaucguuguaaaaagcugcacugcaguaguuauuagaaggauaaacauaagcaaauuuaaucuguuucuuaguuucaucauguagaaaaugagauaauaauaguuaccuaucugcuagacuuguuuugagcauaaauuaguuaauacuugcaaagcuuaggauagcuuuggcccauaauaaaaaucagaagaaauauuagccaguauaaguauuagcaauggaguuuaggcaauaacaaauaaccacauaaaguuggauaauguaaguuaucauucccaucaauuuuucaucuuaaaugcuaacugcugaccuaguaacaauaaagacaaaauuguuauuaaauuagguuauuaaauuuaggcuccagccuauuuacaaaaagacuucaacuaggacacuuaugaauaaacuagaaauacuuuacuucccacuugcaguugcauuugcaaacucacaaagcaaucuuggugaauuaauuaaguuauacgauacuugcuacuuuuuaguucuguuucccaauucucauuuauaucuagagaauacagaauuaaagcagucuuacaggagaauacuaaucaagaaaacaauuucuuacucaaaagaaaaauaguuuauuaaaaugcacauacuaaguuuugcuguuauuguuagacugaguauauaucuguacauaaacucaccuaauaauuuaaccauuuuuuuuacuuauaaccaaacuagacaauaucuucuacagaauuuuucuccugacauaugauauaaaugacauucagcucauaaauugccaguauucauaucuauuauaauuguaauccuuaaaacuagaacuauuuugugccuaugcaaaaaauauuaaugguuaucucugaauuauauccauccuuugaaauguuuuguaaaauacaauaauuaaauagaauauuuuuccauaugauuuaauuacuuuaauaacauaguaagauuauuugucuacuaaaaaaugauaugaccuuauuugcaaagaagaucuuggaagacaucaaguuaagguaaagucguuagggugggccuuaaucuguuguuacugguguccuuauaugaagaaugaaauuuggaugcagauacacacaaaaagaauacgauguaaugacacagacacagaaggaagucuggcuuguggcagcaucacuccaaucucugccucugugaagcccagacugaagugaugcugccacaagccaagaaaugcuaggggcuaccagaagguagauggcacagaagaauccaucccuagagccuuuggagagagcaugacucuacugacauccugauuucagacuucuugccuccagaacugagagagaauaaagucucauugucauuugaagccacccaguuuguggaacucuguuacagcagcucuaagaaacaaauacaaaaagaauguauggcuguauaccuuuuagcauucaaugcaauaaaagcaauuacuuucaugccuggggucccccuuaaaaacaagaagauaaacacaugugagugggcuccagauagaagcaaaaauaaaaugcucugaaaaucuuuucacugaacuuaaaauucuauaaacacacagaaaaaguuauuauaugaggagauacaaagauugguugaugggguaccugaauuucuagaaauacauuuuuuuauaaugacauaugggcuaccuauuauuaggaagaguauccacaguuaggaaaaguuaaaacaaaaaugacaucaaaauaauauauuuucuuucccgucuuuguuauauuuaacauugaaucuauauaaauaauuaaacuucuauuuacauuuguguuaaaacuccaugauauugaaacaaaauaugcauuguauaauaucuaauggggacuccaggaaaacuccugaauuacaccuuacuuuugugaucacaaagggauauugaauuccuuaaaaugguagucucacugugaaaauggaaauagaaugccagcuuugguuaauggcuaccaauucuuuauuuuuuuucuucuacuucaaauuuuguauggaaaaaaauagcacuauauuaagaggaaauuagcaccaaaagauugugaacaucccucgagagagaaaaacaaagucuccaaaaaauauccugauauuaccuagacaacaaauauugucuucaaaacaggaagccagcaauaaauaguucuauccuaucucuuagaucugugagggcaaucuuggguuuucucauaugaacuuucuuugggauucacauaugguucuacauauuaauaaaauagaaaaaugcagcagugauaccauuccuagugguucagacuuauucuaaggcucuaucccuaaccuccucccauuggaaugaagaggccugguaauaacacaaucagcaacauaucguggaggcaucuuccuacuugauuugaaaacuuacuauaaagcugcuauaaccaaacaguaugacaugcucagaagaauaaaauaauagagagcugggaaacacaauagggagcccacaaauagauccaaauauauacuggcaccuuauuguaugaaaagcaaacuuuagcuuuguaacgcaguagaaacagaauuacuuguauaauaacuggaauugguucaauggcugugugaaaacaacaucauuggauucucuugcagcaacaaugauuaugauauauacuagauagaguagauuuuaaugcaaaaaguacaacuagcaaagggcuggguggaggcagugauaaauacacaaagcacagagaauuuuuagggcagugaaacaauuucguauaacacuauaaugguggauauaugucauuauauaccuuugugaaagccacuagaauguauaaaaccaugagugaacccuaauguaaacuauggaauugugugauaauaaugugucaauguaaguacaucaauuuuaacaaaugcaccauucuuguguaugauguugauaauggagaaggcugugaguguauguagggacgggggcuuuauggaaaaucucugugccuucuagucaauguugcuaugagccuaaaacuucucuaaaaaauauuguauauguauuuuaaaaaguacaacuuaggauagacaaguaaaaccaaaauuauaaugaaaacauuggcauaauuaacagcauaagaauuaauaaaauuuaaaaaucauccgauaguauauuaugaaguuuuuuuuaaaaaaaacaaugugguauuucauuguauaccuguguggucauggccaccagagauggauugcccagguaugaaucuuggcuaugcuacauacuaccugugugacagaggaauagcgauuuaacuuccuuucuccucaguuucuuuaucuauaaaauaaggauaagaaaaaguccaacuuuuggguuuguuaugaguauuaugaguuaauaaauguaaggcaccagaaaaguacuuggcaucuauuuaagcauugcacuguuuguguuagccuauauguauuauuacacuaaauuuaccauaugcuuauauuacuuuugcuuauauauaugcuuauauuacaaaaauauuuuauaaauaaguauucgcauguaaagaugaccaaguuauguagcuuaagugaaguaaucaauuugaagaacagaauaauauguauuauuaaauaaaacaaagaaaucuauaugcuauaauacagguuuugaauacuuauaugcaacuauuaaagcaagaaaagguacacucugcaguguuuacaauguuuaccuuaauggggguggaauuuuaagaauugaagagagaagcguaaaggguuuuugcucagagguuuuuguagaaauaaauuacuugcauaaaaaauaacaaaauuucauccauaugauuaauaugccauaaacuuagcauaauauugugaacauauguuaaacuuuuaagacaagacacacuacacagaaguuauccacaagauaaaugauuggcaaagagaugauuccuugggaggaacuucuaacagcuggaagagcccguaguguguugucugccuuucucaggggcucuucucagagaacuaaaagaauuucuuaaagacacauuucauguaauaauguauucuaagaaaagugcuuaauguuuuuaucauugcauugcaacaauacucaaugagccaggugcuaugugacacauuauauaugcauugcauauuucaacuaacucaacaauccuuuaauguaaucaccguguuuaucauuauguuuccggaugaaaaaacggaggcuuaagagagcuuaaguaacugagcaagacagggguuaauaaaaagugggaccaguauucagauugaaaucacuguucuguguuuuaagauuuuagccugggacuuucaacugucaucuuauuauauggaaaacauuuuugggucuaaaucuguccaagaguggccuaggcauaaugucuugaguccugacagccuaaaauaccagaaucagaugaucgggcuucaugacucucuagaauuuuuuuucuccccuguaccauacugaaguugaagaucguccuauuaugcuuuacacuuuguuucugaaugcccacaaguaucaaaagugaauaugaugccaguuccaacuggcuguaaacagcaguaauguaaacacauuauuuuguuauucugaaccauguauaugugacugugguuaccucuccuucaauugauaugccuuccauauugauauaugugcuauuuuauuuccuauuugcuuacucuauuauguuagcauguugugucaaucuacaaccuugauuccuucuuaacuaauucuuaguucaauauuuuuauuucuuaucccaaggcuaccucuucgaguugcuuugcugaguuuauuucuuuuuuuucuuuccuuccuuccuuucucuuuuguuaaucuguuuuaugugauuuuuguuguugucuuuguuacugacauuuccuuugcuaugccaucuucccaguuagucuaacuucagaagggugaaguccuguuuuagaaaaaauauaguauuccacugauauccuuaacugacucacguuaaauaaauugcugauuauuuuucuuuauuaauauauaaaaagggguaaugagauuaccuaaucagagucuuguuugaagagcaaauaauauagcauaugaaaaagaacugacguagugcaaaugagaauuauauuaauuauaggaauuguaauuuacucauucaacaaauauuuacugaguccuuacuaugagcaagcauaugaaaggaaauaggaacagagugaauaugauuguuuaagcaucccuaggcauuaaaaagcuaagcuuaaaauuguuuaauuauaauuaugcugaguagagaauaacuugaccuagucuaucaaaaauaauuuuccuugagaaaacgauacuuacuguuaugggcaggauugugaaccccuaaaaugcacauguggaagcccuaaccuccaguacuuuagaaugugacuuuaugcuguaucuguuuuguauuuguauuuguaaccccuuuaaagaggugauuaaguuuaaauggaugacagcuguuaggguaggccccaaaacaaucugauugguguucuucuaagaagaggaaauguauaaaaaagagaugcuagggaugugcacacgaagaaaaaagaugaugugaggacacagugacaaggaggcuaccugcaagccaaaaagaaaggccucagaagaaucccaaagugcugacaucuugaucuuggacuuccagccacuaaaacagcgagaaauaaauuucuauuguuuaagccagggguccccagggucauggacugguauuagucuguggccuguuaggaacagggccccacagcaggaggugaguggccaguauuaucgccugggcuccacuucccaucagaucagcagcagcauuagguuaucacaggagcaccgaccuuauugcaaacugugcaugagaaggaucuagguugcgccuucauuaugagaaucugagaaucuaaugccgggugaucugucacugucucccaucacagcccaucugggacugucugguuucaggaaaacaagcucugggcucccagugauucuacauuauggugaguauguaauaauaauggaaauaaagugcacaauaaauguaaugcacuugaaucacacugaaaccaucuacccagcccccauggaaaaauugucuuccaccaaucguaucccuggugucaaaaaggcuggggaccauugguuuaagcuauccagugugcauuuguuauaguagccuuaggaacccaauacacuuacauaauuuuuaaaaugaacauuuuaacugcuauuucaguuaauucguagccaugcaaguagcauacaaagugccccuuccuugcugacuugguaacucuguacccuaauuauaaaaaaaguacaaaagaggagaacaucuacuuugcaguccuguaucuauugagugggaaaguaauuucagguacuuauuaacaaauaaacagugaguacugcaacacugcauaaaguaguugauggaucugaauuuauuaagacagagauucuucagagaguuacuccuaaugaaugcaaguuuuaagagggaaggaggugugaaaacuaaccaaauguccaaaguuagauucugucauucuuguaaaucaucucuaagggucucuuaaggggcaugcauaugcaacucaaucccauauuuuuagcaguggucccuuuaauuuguaaacauucaauaaugguaauaccagaaagacaucacaaggggaaauccugacugacuaacaccaacagcauucaauccuagagccauauuuagcuauguugacauguuugccuugucacuuuuuuuaguauucuugauauaagcuuauuugauuuacacacuuuuaauagcucaucagguacaauuguugcugaaugcugcauaaaauuaaaauacaguuauuagauauuaggcaaggucuuacaaaauaugacuuauuuucacauauacauguuaacgugucugaaaucaaaauagguggguugaaauauccgcuucuuaaaauauagaaaauagcauuucaaauaaguuuuacugaaugaaaauauuaaaaacaaugauacuuaacccccccuuuuuuaaagaaacauuuaaaaaauuuucaaacuauguuaucuuuguuugauucaggaccuuaaaaaaguaaauucaaggaagcaggcugacugcuccauuaaaauaacaauuuuuaaggcaguaaaaacuuuaucaaguauuguacuuucaaccuaaauugcuguauuacauuugauuguuacuuuagaauguaaguguaggugauuaguguaguuuugcauuuguacauuuggguauaguuggcccuugaacaacauggguuucaauugcauagguccagucugugcacagaguuuuuucaauaaauacauugaaaaauauuuuguagauuugugacaauuugaaaaaaauuugcagaugaaccauguagcauagaaauagcaaaaaaagaaaaaguuagauaugucauaaaugcauaaaauauaaagauacuuuuuuucaucauucacuaucauaaaauauacaaaaauauauugaaaaaguuaaaauuuuuaacuuaaaaguguaugcaaaucuauugaaagaguuaaaacuuuuacguuaacuuaaaaauauaugcaaaacaugugcauacauuuagcacauggugcuauuugcaguccaaagaaauguaaacaaauguaaagaucuaguauuaaaccacaauguauaaucuucacuauacugcauaaugugcuaguaucacaauuucauaggcaacucccauugcuauugcaaugagcucaagucuuaugagcaugugcuuaaaaugccaugugaugaucauuguuucuacaugaacaguucaucucucuaguaaaauaugcaugauaguaaaagugaucccucaugguucuugcauguuguuuauuauguugaaugcaauaccauaaaccuuggauaaaacaaggggacccauaugaagugccacuagugaugcuagaaguguucccaagaagcagauaaaagucaagauauuacaagaaaaaguugaacuacuugauauccacuauaaacggaggccuggagcugugguugucuuccauaucaagauaaaugaaucuaucauuaaggaucaauguaaaaaaagaaaugaaaauuaaugaagcugucccuguaacugugcaagcaagugcaaaauaccuuccacuuuuugaaaaauaucuuuuuaucuuguaugaaaaauauagcuuuuacaugggugcagaauugcuagaaaagagccuaccuauagacucuaacaugauuugagaacaagugaagucauuaucugacgaggaaggggaaaagucuaaaguucuagaauuuaaucccagcaaaggaugguuugauaauuuuauaaagguuugauguacagaaugauaucaggagaagcagcaucugccaaccaagaggcagcaaacaaguucccagaugccauuaggaaaaucaguaagaagaaaagauaucugccugaacauauuuuuaaugcagacaaaagugcccuacucugaaaaauauauauauauucugaaaaagaacauuuauuaguaaggaagagaagcaagcuccaguaauaggcuaacucuacuguuauguacaaauaaaguuggguuuaugaucaggauugcccuaccuauaaagcuacuaauccccaagccuugaaggcaaagaugaacacgagcugucagucuuucgguuguacaagaaggcugggacaaugacaauucuuuuucuauacugguuccauugauugucccugaaucaggaaguaccuuucuaguaagggacugccuuauaaaguucuuuugauauuggacaaugucccaggccacccagaaccccaagauuucaauacuuaagguguugaaguggucuacuugcccccagacacaguaucucuaguucagccucuagaucaagggucauaaagaccuuuaagacucauugcaugcaguauucuacggaaaauauugucagugcuauggaagagaauccuaauagagagaacaucauggaagucgggaaugauuacaguauuaaggaugauaucauuauaaaaaaauccauaauuccauccagucuaaaacaguaaauuccuacuaaagaaacuguccagauguugugcauaacuucacaggauuuacaacagaaccaaucaaggaaaucaugaaagaaacuguggauguggcaaaaauauauaaauaaaaaaggagggaggugaaggguuucaacauagggaucuuggaggaauugaagagcuaauagacaccacaucagauaaauuaacagaaaacaacuugauggagaugagugcuuuugaacccguuccagacaaugaggaaaaagaugcagaagaagcagugccagaaaucaaauuaacaauagacaaucugacagaagguuccaauuauucaagacuauuuuugacuuauuuugugacauggauacuucuaggaauaggacacugaaaguaaagcacaugguguaagaaggauugguaugguauagacacauuuuuagagaagugaaaaagcaaaacaagucaggcaaaaauuaugauauauuucuguaaaguuacacugaaugugccugccucucuccauuaguccauuuucaggcuacugauaaagacauacgugagacugggaagaaaaggagguuuaauuggauuuacaguuucacauggcuggggaggccucagaaucauggcuggaggugaaaggcacuucuuacauggugguggcaacagaaaaugaggaagaagcaaaagcagaaaccccugauaaacccaucagaucucuugagacguauucaauaucacuagaauagcacaggaaagaccagcccaccugauuaauuuaccucccacugggucccuccuacagcacaugggaauucugggagauauaauucgaguugagauuugaaugggguugcagacaaaucauaucacucuccugccuccccuuccaccuccuccaccuguucugcucugccacccuaaaacagccagacaaaguccuccugaucuugccccucuucugccuuuucaaugugaagaugaugagaaugaagacuuuaauaaugauucacuaccacuuaauuaauagugaauauauuuucucuuccuuaugauuuucuuaauaauguucucuuuucuccagguuacuuuauuguaaguauacaggauauguguguguguguguguguguauauauauauauauauauauauauauauauaaaacaauuauuuauuaaaugacucuguguuaucaguaaggcuucuggucaacaguagccgguugauaguuaaguuuuuguguagucaaaauuuauacauggauuuucaacugcacaaggugucagugccccuagaccuuauguuguucaagagucaacuguauuagaauaucagaauuuggauaucucuauuccuucuuuuuacuuuucuuuuuucacucaccagguuacuucuaggacaaacgucuguuuacuuugaggauaaaauguuucaauugcaaauauucggcaguuuuuggagucaauuaguuucacuauuuaucaaugaggauaaacauaucaauuuaugaaaugauuuuaagugagaaaccauggcuucugugugaaucugcaagcuagucacacauggaagagaaucuuguuuugguauuuugccauacaauuuuucuuuuaauaacuaagagauaauguauaaacuauauacauguauauauguauauacacacauauauauauggcagggugauaggguguuauaaauuugcaggcagaagagaguggccaguggccaauugcaauaugaguugccuauguuucauuuuaaaguaaaguuuuugugguggcucaugccuguaaucucaccaguuugggaggaucacuugagcccaggaguuggaggcuacagugagcuuacaugugccacuggauuguagccuggcugauaguaagaacucugacucaaaaaaauaaaauaaagaaaagauuuacacuuauuugcaauaauguugucucuuauguuacuuuuuacuccucuugcuaaaucccaauuuuccaaacaauggccacuaaucggcauuccagucuugcugccccuacacucuaaugugugacuaauucccuaccuucuaaaaauuugugcaguaaccaauugaaugucaauguaccugcuccauucugccuuauaaaagcuuuaaauucuuugcugucuucaagaacacucaauuuaaagcuguucuuaccuugucugcaacauuuuaaugaagacuugagcuaauggguuuuguuuguguucuguccuuucauguagcagauuuucacuauugaaaaguaugaaaggucugagaaagugguagagcaugcccaagagaaaguagagagccaacuuucagcucaaauacucccaaaacacauauucuacuaacagaaggcuuauuuucauuaauaauucuaaaauaaauuaaaugcauaacauauucaaaguaaguaagccugauuggcccuacagacauucauuccuacuucaacuauuuucuuuuuuuuuuuaauuuuuauuuuauguucagggguaaaagugcagauuuguuacauagguaaacuugugucauggggguuugugguacaaauuauuucaucucccagguguuaagccuaguacccauuaguuauuuuuccugaucuucucccuguuccgacccuccacccucagaaagucccaaacacuucaacuguuacugaaguaccuauuuuugcuauugaguauauuaaccaguugagcaaauccauuggaauauuuaaggaagggagacuuccuuuggcauaaaaauuaggcaaaaaaaugaacauucuaggcaaaauaaucaaacaagacacaaccauaggaugugaaagugacaagcaguguaguacaggauacaaaggcagaaaacguccaagauucaaaacggagaaaacugucuuacugcucagcucugccacugaccugguauauggaacuggugcauaaaugaacacagaaacaaauuucuuuucuuuaaaauauaaaaaaucuuaauuacucucuuuacgcaaaauguuaugauucuggaauaucuaagaagguaauguaggaggacaaagggaaagccaagauacuagauuuaccaacaaguuauuuauguccagaagcuuuaagaaagugcaaaaugacaaaaaaaaaaaaaaaauggauauuaugagucgcugguccuggaauuaaauauuucaaaaauauuuuuuaacuuuacagaucguagacuggcauuaugaauacucaauuaguuuaguacucccacucaaaaaaauuaaaauauaguaacuuuuuucaaccucauuaugcagaagugggagacauagcaaauauguggaaaauuucuauuucucuaugcucuauaaaucuauaguaucacaaacuuuguuuucacuaaaguuuucaaacaauuacauuuuuagaccauaucuccaagaaccauaugggucuacaauucagugccaaggauucuuccucuucccaaaaauuauguuauucaacuuugggggacaaaagcuaagagagaaagggagagagagagugacaguguguguguguguguguguguguguguguguguguguguguguguguucucuugccugcuaauaaaaucauuuccugguuuccaggggucaggaaguaaaguagcauucugaacuacacaaggaaaacagugucucacacgagguauuaaugaacauuacugugggaagaggcaaaagcuaacugcaacguaccucccuaacaacucugaacuucacgugaccuuaugagugauuuuauuaccaugcuugagguccacuggaguccuuacauaacuggcauaauauaauauuggacaguaaguaauuaaacaauaauguguucagggaagagcuuaaagcugcacaguaaaugcaugaugcugaaaaaauucaggaagcuauuuucagcucagacuccuacuagaaagaggcucuuggucaccaagugucuuggacagauuccaugucauggccacggcucacugaggacaaaacuauuggcagaaaauaaccaauguuauggaaacaagacagccuggaguuuauuuaaguauauccauauauuacauauuucuuguuuucagcacuauuuucaacacaugcugcaugaggcccuacacuaaagaaccucuuaaauuccuguuaaauuuagauaucuggccaaggagaguucuuccaauucgaguuuguauugugaugucuuguuuggguaaaaucauggaacuaacacugcuuauaaaguucugccuaaagaaaggguuacugcugucucaggguauugauugcauaucucaccuggaaacuccucacacaauucagugaugguuuagcaauuucauuauaaucaugaaacaacagacaccauagcacuaguuuaauauuaacuuuccuuauuauauuuucauucauauuacugucaugcuuuuuugaaacugauuauucuguuuucuacagcuuccuaacagguuaggaaagcacacauggaaguuagcacuguauaauucuuuauuuaaagcauauaauuugauagcaugugaaauuuagaugacaauucuuaaguaaaacuaaucauaaaaauuauaucugacauuuauuuuuaugugcagauuguguacucagauguuuuacauuagugauuuuuuuaaguuaucacaucagcccuaagaggaagguauuccuacuuuccuuauucuguagguaggaaaucugaggauuugacaacuugaguuguuuguuaaugugauacuggcgggaaguaauaaggcugaaucuaaaccucuugagacagacuccacaguccauaaacuuaccacuaauuaagaaggaaaaaaaagucauucucuuucucauuuuugguauuucauuaguaagcuggaacaauuucuggcaauuugggauauaauuuuuuuuuguucugauaaucauaguaaauauuuaccgagaaucagcauuaaacuaagcaauuucaauauaguaacaaauauucauucucacaagaagcacauaaaggagaaacuauuauuucuucuguuguacaaauaaacaaaagcauagagauuaaaauaaacuugccgaagguaacauaaggcuuacguaguggaaaugggauuaaaacucagcagucuggcuccugugccccggugcuugccccuucacucuaaugcuuccaagaagaaaacaaaacacaacaaaaagugacaaauucccaacuuaaaauauuuaugaaagauacauuuacuggccacauaggauuuaggaggagaaagguuauuuuaaaaacacuuuuuuuuuuuuuuuuucuuaaaaagcugggcacaguagcucaugcauguuaucccaacauuuugagaggcugaguugggagaaucgcuugaaucuaggaguuugagaccagccugggcaauauagugagacugcuaucucuacaaaaaauaaacaaaauuagcugggcgugguggugcaugucuguagucccaacuacuuggacaggugaggugagagaaucacuugaacccaggaaauucagccugcagugagcugugaauccaccacugcuuuccagacugggcaacagaauaagaccuuguccaaaaaauaugauaauaaauaaagacacauuuuuuucuaauguugaaggaacauaaguauauuaacaauguuaguugccauuuauugagaaauaugagauuuguaaaagaaagaaagguuaggaaaaaguuuuaaaaaaugaccuaagguuacagagcuuauauuuagaggugauggaauccaaaucuaaguagacagauagguuuguaaaaaaauauauacauauauuuguauaaauaaguaucuauguacacauacauauuuagauguguauauacuuauauguauaacuauauauacuuauauauguauacacgcauacgcacauacauauauacauacauuaagcaaguacuaaagcuagguuacucuagugcagaugcuaaaaauaacauagaaaaucuggagauuaugccugggucccaccagaaauugaggagucccaucugagucuuuugcacugaacaggaacucuguaauugucucagacuggcagcuuucccuggcuuccagcagaaggaaacacauaucuuugaacaaaacaauuccuaauuagacuguuggcauucccucauauugacuucuaacaaauaugagcacacaguauaaaacugaaaauauauaaagaaaucaguggacgugugugauaaccagcagagaaauaccaacaacuaaauauuuaaaacuguaaggacaucaaauauuguacuuauccauagcagaaaauaaaauaaauacguuuaaauagauugaaauuuuaaaguaucaaagauauauagcaagaaauuauaaauaacagauaacauacuaaaagucaaauacacauuuuagaaauaacaaacacagaaauguuaauggauauuguacuguaaacaguacaauagauccgaaagaggagagaguuaauuggaagauuggucaaaggcauaagagacaggcaagucaaugaaauuugugagagaggauaaaagacauggcaaacagaguaagauaaucuaacguguguccaacugaaaucccaaagggaaagaauaaaagucagguuauauuugacuagauaaucacuuagcaauucccacaacuaauggaguccugaaaacagugauaucaaagccuuauguauguaaaucaacaugaauaaaaaucaacaauucucagccacauuauagugcagcuacaaaacagcaaagauaaaguguagauuugaagagcaagugugagggaaagggugugacagacagaucacuuacaaaagacauacaauuagucuaaaacuagguuucucaagguuucucaagcaacagaaacugaaagacacugaaauaauaucuucuaaaugcuaauagaaaauaaccacaaauccagaauuguauaucugacaaaauuaucuuuuaaguaaauaauacaaauauuuuuaaauuaaaagaaaaacugugacuauuuauuaaaauaugcuuuaaauuaagaauggucaaagaauguguuauaggaagaagaauucuguuccucauccaagaauaaaucaaagagaauccaauaaccuggaaaguuacuugcaacauauaauugucaaaaaguuuauuauaaaacauacaaaaaauacuaaaaauaucagauaaaaauacaucucaagagaaaaaaccugcuacauuucaaaauagauauuucaagauagauauacauauuuaaaaucaauaucuuaagauagauaauaauguccaauaaacauaugaaaaaguguucaaucugauuuguagucaggaaaauaaaaauuaagaucauaauuuuauauaauuguuacacccaagauuagaauuuagaagauaaauaauacuaaguauugaugaggauguggauccaugagaaugcuuucauauuucuaaaaagaaugugaaccacugaaaaacauuugaauaaaaaauucuugcauguucucuuuuaaggaugaacacaugugcaucuuauaauucaaccauuucacuccuuacuuucuuuagcagcaaagcuccuugaaagaagaguuagcuauauuccccuuucccauuucuuucaauucucuaucaaaaccacuucaguugggacuuugucuucauuacucuauaacaccugcucuugcuaaggucaacaauaauuuccucauuucugauucugauuguugacucucaaccuuuagucugagagguuuaguuuucccaguaacucauugguuacuucuuuucagccuccuuugcuacaucuuccuauuuccccagacuuaaugcuagaauaccccagagaaauguccucgccucuccccucuucuccaucaauguucacacucuugauaaucuuauccaagcucaugguuugaaauuccaucuauauauccacaauuauauuaggccuagaucacccucuuggaauguuuaauuauauauauuuaacucuuacauugcuuuggaaacauauccuugcaacccuccccauguauguuccauuuauacagccuaaaagccacgagguuauccuucacucuucucucuaacacacugcauaucaagcggucagacaauccugaugacacucacuucaaaagauagucagaauccaaccacaugucaucggucuucuaucaccguaggaggcagcaccaucucuuaucaggauaaugguaacaccucucaaucauuuucuuaacuuuuaacuuugcuuucuucauuuguucuaugaaauagccagaaggacucuucuagaauguaauaauuauguaccucucugggcaacauccuguaauggcuucccauuucacucagagaaaaaucuaaaacacuuacaguuaacuauaaaaccuuaagugaugccaucauuuaagguuaccuccacaucauaucacucugcugcagucuuugcuguuuucacacaccagucaugcuccugccuuagggcuuuucaccagcuguccccuccugaacuugucuuccuucaaauauuuauauggauaauucccuaccuccucuuuuuucuaaaauguaaccaucuccaugaagccuacacgagccuccucauuuaaaauuccucaccucuuuuucauuccuggaaccccuaggacuccuuacaccugcucacuauuauuuuaaaaucccauaacauuuauagucuuguaaaauguaauuacaccuuuuuauguuuguuuugggucaucugauucuaucaguuagaauauauacuugaugugucugggaucuuugucuuuuauguuuaucaaaguaacuuagaacacuauccacagaguaagggcucaacacauguauucuaaauaaauaaauggacuacacuauuugguauguucucuagagaaaccguuauucagaugcaguauugauaauagcaguuguguuuguaaaagcaaaacaccagaaaucacccaaacauauauugacuuuuaggaaaggugcugcucagaagcaccaacucuucuguagguauuucaucuugucacauguugcuauucauuucaaugacacuucuguccuuauuuucaaaggucugcauuuguaaucuuuuaauuagcugucugauuaaaaucuauuuaauugagcuuucgguuaaauuugguaugaaagaugggaacuuccucccucuccccucaccaggauuguucaacuguggucuguuuuaagucuaaaaauacaugagaauauucugccucuucagaguaaguaauaaugaauacagcaucaucaaaugacagcuuuucuuuuuguuuugccaauuaaaaccccuaaauaauguauuuuaacauugccagcacccuaaaaucuaccuuuauauucacauuuauauuuugaugcccuauuaucauugcaucuugcccauuugcaagggggaaggguccucaguguuugaauugaauauucuuucuuucuuucuucccaaucauuuaugugucccugaguccuuguaauggugacagcacauaucuaggggcuaaaaagaauauagaguuaaaauauagaguuuaaaaaagccuuaagauagugauguaaaauaaacauguaaaacuauuagaaugaaauauuauucaaacucucucauuuucaaagcagauaucacgauaaauauuggucaguaaauucuucuugacuaaaguuaucaaaccccaaaaaggaacuguaaaauuuauuuuuauuuauauuuaaacuaggguccauguccaacauuuccuuaauaacuggauuacagagggaaggcauguuagagacaggaagccaacagauacuuagauaaaauacaagaaguuuuaggcaagguuaaaagaaaagcaugaauucaagacacaggaauaaaguucaggacaacagauucaugugacauacauacaguuguuuucuuuuuaacuuuuuagauucuagagguaccuaacucauuuccaugaacacuugugccuuuguuuagcuaaagaucuuagaaauuguguuaaugcauugcuagcucugacaucucuaauguuaaacuuaaaucauauguuccaacccugucauuuucaaaacaagaaacgcuuccaugaucagguauugaaaugucaauuuacaauuuauaguuuuaaaaaaaguuuuuuuuaaagcuaaaauacacaaaaguauucaaaaaucuuuguuaacuacuguuucuugucuuucuuuuacuuuguguguuugacagcauguuuucccagaaaaaauucacuaagaggauuauaucaaaaguaaaauaggaauuuaaaaagcuuaacuacacacauacugaaaaugacaaaacacuaggaauaucucuuuugugacuuaguuucuuuaacuaaucaaagaaauacaggaacaaucaagauuaauucuuccaggguugccuuuaaauauagccuguuuuuaaagauagcacucaaaguagaaaauuguauuuuugguuagaauacugacuuagaacuuaaaaaaguuaauuucuuauauuuuuuuucuccucauuucucaaaaacguaucuuggaaaaaacuaaguugcaguuuuaaugaaagaaaacaauauuuaauauauauuuauuuaaaaaauuaaaagcuagagagcugaagaauuaauguaaacaaacuacuucauaaugaaguauuucugccacuuauagauucaaggaauugcagaauauuuuaauauuguggcuguugaugguaauuaauauugcuacuucaguuuuauagaaauagcuucauccguuugucuacaaauuuaaaacaaucucaaucuguauuuuaaaacaaucuauauaauguuuggauuuugucuggaaaugcaugagugguacuaagagacuuaucauuuuuaguggauuaugucaguuguuaaaaaaaaaaaaaaaaaaggaacacaaaacugccccuagcuuggaauuaaaguggaaaauuuuaaauggccuuucagacacuaacuuuuccacauucuaaaaggauuuaugauauaauguuuaauagugcuacugcaguacuuaauaccacauaauucauacccauaacaaagcaaaugacuuuaaacuaccuaaagaaaagaugacacagcucagaccacuggaucaaaaucuuuacugccacgcuugaagacagaaaaauacuucuccaugagaaaauuacuuucacauggaucauauuuggcaccugguuugcuauuuuucacuguauuuggaucaaugauagcuugaaaagaaauauagacauaaccuaaaaaugcccaaauauauaaaaacuuauuuucuaaguacuauaagacugucagcaaacacuaaaguauugacuuucuuauauuucaaacauuucacauuuuaucauuucauauuuucugauaaauaugauacagauaucacuucaaaaauuuaauuuuuaaccucagaauuuuauauaauauuuaauuuuaccagaaucuuuaagaguaaaaguauauacucaugaauuucacuugccugacuggaugaaauacaaugcauauuagauaaaauauauuaaauuauaacuuucacaaauuguauaauuuauaaaauuauguggaugaacagguagucauugacauaauuuuaacaaucauucucagugaaguuuuuguuaagggaauguuucaaaagcuccagucuuuguuaaaauaauaaaaauggacaugcauuaaaaaauguuuugccacguugaaauuucauaugagguuggaaauauguuuuaaauuuuuugagacuauauauuuacaugauauagaaguaaagaugauaaaaagagcaguaucuuugaaacaugcucuuauccaaaucuacauaauuaaaaucagcuuguuuauaggugauauuaauguauaaauuugauaucaucauaaaaacaaaagcacaccagauaaaaaucauucccaaggguaaaauucagauaaguuuguuaauauuaagaacauaugaaaggaaaaacauugauuuaguggcaagcaaaaauaaaaauuuuucccaauuaccaaaacgucuuaagaaguuuuaaaauaggaggaagcaaaguugaaguuauagacuuuuuuuuuaauuagagagaguguuucacucugucacccaggcuagagugcaguagcaugaucauaacucacuguaaccucaaaauuccugggcuaaagcaacccucccuucucagccuccauaguagcuaggacuacaagggcacaguacggcacucggcuaauuuuuuguuuguuuuuuguaaagacugggugucacuuuguugccuaggcugguccugaacuccuggccucaggcaauccuccugccugggccuccaaaacucuggaauuagagguauaagccaccaacucuggccuuuuguguauuuguuuuagagcuaaugacauaaaauuaaguaagugaauacuuaaaaugagagcaaaacaucuaaagaaaacaaugauuugauauucuuaauauuugaauuaauucacauaaaaaauucagacacuuuuacuaauuggauuuuaaugaccucuauuacgucauuauguucagaguuuuaaaaggcaauaucuaguaaggaaacaauacaacauucucugauuuuauuugcuagcauuuuggaauacuuugacaaaucuacacuucuaacuguaauacugaaucauguaaaacugccauuuuugcgggugaaaacaauacuuucuaagccaacccuaauucuauaaaagaagcauuugaaaacccacaacauagcuauuccaaauugugucuucauagcccuugcuucagaacuauuugaaaguucaguuaagugaucagaauuagcuaugaauauaauuuuauaagcauaacauaucucaagcuauuuauacauaaaaucaugauauaugaauaauuuuaauaauaauguauuaacucaauuggacauuuuaccaacacauugauaauacuaagaguaauaaaaguaaauauuuauauaaacuugcuuucaaaguaccuuagaaaaaguuauuuuaucucuaacaagguuggaaaacagguaucauuuucuguucuccuguuaaguuucccuauaaaauuuccuuaaguagccucacccucugucaccucuuuuaguacuaauccaacuucuguuggaagaugaagaccuaaaucuccuccaaaccacuucccuagcccugagcaaucucaccuucgacccuccaggacaccaacuuucucaucuuuaucuuuucccacucaucauguauuacgcacacucuucucucuaguuugcaaucaugucuuuucaucacugguaauacauuuccauaucuaccucaggaucaugcucucuaaucacagguuugaaagccuaguaauuaaagucuuccaaauuaugauugaacaguauagucuuugaguaaaauuuuuaggguuuccccuaaugcuaacauacauagcaugaauaaaggacuugguuaagccuauuuuuaauucucagauaagaauuuuacaggcagcuuaagugaaaacauauguauauaauauaaagaaacacauggauagguaaguguuuucaaucaucuugauuuuguaaaauggaccuucaaaguaaagccuuuguagguuuaaaauuauggugacaauaauaaaagucugaaaacgcuaagauaauaaauaagcauuagcaaaaguauuauauuaaugauacaauuuuagcacaaauuaggagagcucucaaaguaccaauaaaccccaaauuccugaagaaauuuuacugauaaggaaaaauuguuuuauauaaauaacaguauuacugucagcccuuugaggacaacagccauaucuaaauaugaugcauuuucguauauacauuuguaaauugaugguauugaaaaacuugacuuuucuguuucaauguacuuuucauuauuucagucagaaaacucuuaugaagccuccauuaaaauccagauacuguacuaagcauuaaggauaccgaaaguaaaaacaauaaagucccuauucauaaaaagaaaaauaagcagacaauaucaauacaguguaucauuuguuuuauaauaaacuguaaauugauguccaauacauauuuuaaaauuuuauugagcuauaacacacauacuguaaaauguacauaucucgaauguacagcuccauuaauuuugauuaaugaccuuguagcauaugugaaauuguaacgcguaaaaauauagguaaacagcacuaugaucaauauauagaauauuagaaucccucaauagcuccuuucuauuacugauaaaaguagaaguuugaaaaacaaaaucccaguaauaaauaguauaacauauauacauaguuagcuuauauacugcaaaaaauuaugaagguagaaaacuaauuuggcauuuaaaaaaucauaacacggaauuuccaaccaucucuaucauuuuaauaauaauguguugaaaagauuaaugcguauuuuaucacuuugaagauuucaaucucuuugaaauguaaaauaauuaaguuuauauugcaugggaaauaaguguauaaacuuaucuuaguuacugauuccaaauagguaaguuugaaaacuucaauuaaugauuuguauccacacauuugaaaaaguaaaaauuacauaguaauuaaagccuagguaaguuuugcuuaauagccauggcaauguuuguuuuuuuguuguuguuuuguuauguuuuuguuuuuguuuuuuugagagggagucuugcucugucacccaggcuggagugcaguggugugaucucagcucacugaaaccucugccucccagguucaagcgauucuucugccucagccucccaaguagcugggacuaaaaggcacgugccaccaugcccggcuaauuuuuguauuuuuaguagagaccgaguuucaccauuuugguuaagcuggucucaaacuccugaccucacaguccaccugccuuggccucccaaagugcugggauuacccauggcaaaauuuuuuguaccuguuguuuaagcaaaaauaaaacaaaagaaaacgaucaaaaacccugacaaguaauuauacuagucauuugccaauguccuaggaaaauaauaauguuuaaugaaauaguuugauggguggacacauuauaauguaagaucagaaggcauauaagcaaguuuuaaucccuuuagcuuuuuauuaucaugcaugaacagucuaacugcaggaagagaaauacacacagaauacucauuaccuugaagagagggcuuaccaggccagaggauggacagaaaccuugccaggguuacuuaucugaaggaaguccauauucacccuuucuucauaaggauugaaaccuuaaggacuaagugcuacaaaaggcauaaaaggauccuugccucauuagaaacacuuccucuuucaucccccuuccuuauuguuuaaaugauuuaaaauauuuaaauuauacucauuauaguaccaaaaguuauguaauaaaaaugaagacuguuaaaacuucuaaacaucagacaagauaacuuugagaaaacaaauaauuugagaaugaaucuuaagauuucuuuagcuggcuuuaaaugugacaaaauuauucacuguccauuugaaaguaauauuucaggauguugaauuaauuacuaaaauacauucuuauuuaaaacagucugaauuaaguugcuaaaaacaaaacaacucaacaacaacaaaaauaaugauuaauguuaacuccagaaauaaaguaaucugaccaauaggacaagucauacacugaugacuuuauccacuauuugcucuauuauuaguuucuaaauugcgugucuaagauuuuaccuguaggaaaacagaaguuuaugcauuauguguugugauuugugcacaaagaugcugcuauguaucaccuucucuauuaguuuuguuuucucaguaauuaaguugauauuuuuucauuucucucuauuaacuuucuugaggcaaaugccaaauguuuuuaguaucacaugcuguaguuaccaaagauuaaaacaucuuaauuauuccaaacuagacuuuaugaacauauuccccuaaacaaaggugaaaacaucuaaagagaagcaaaaauaauaacaaagcauacauugagaaaacuguuggcuaacaauccaauguguauuuucuucauaguaacaaagcccugacuuuauuccagaugaugguaguugcuaaugaaauauaacuauauguuauuaguggcgcuuauuggaaaacucauuauaaaaggggagauaucuugcacauguucuuuuugcccuucucccauuccuuauuuucuguucaaaacaaggaugccauaguuggacaugcagguucaucuuggaucuuuaggauggaagccauaacuaaggacaucagagcagaauaugagaaaccugcuuccugaugcuuuuguaaauuuaggaaugcucacuucuagcuuuauuuggugugcgagagaauaaacucaucugucuuuaagcucuuuuaguuaaauugcuguuauuaacaucugaaugcuuccuaguuuagaaagaaaguaaugagaaaaucuaagauucaucaauuuucauucaaaauauuauuuacauaaagauuuuaugaaaaugaacaguaaugaaagcaauauauucugccagaaacuugguuugcauugugugauaggggcauccaaaaguaaccuaauccccaacauugacuuuauuccguuaaggacacagauuaaaauacacacacacauacacacacacacacacacacacauuuacuuacuacuuaaaaauuauaguaaaaaauucuuguuugcuucaauagaaaugcuacuauaguucuucucaagcaucucuaacaauugcauauuuaggguaggugauaauuuuaauuuuugauauugccuuacauuucauacauaugauagaaugaaaauuuccagugaaugaacugaaaugauuuuuuaggaauaaauaggagccaaguauaagggugauagggugucauucuuaggaucuugguaaccugucaauucaccaaaauucucugaggauuaagcucuuuuauauaauaaagaguuauaauagauuaucuuuaaggcaugaaccagcauuaaauuuccaugauauacugaagauaacuucacauaaauaccacuaauaagcacuagaugggaaauggccuguaaauauuuucugaccauaauucuuaguucuguaagacuuuaacucugcgcucaauguucauaccuguuagcugaaauguuauagcucuaaaguuccauaaugccauaaaauuauuauugccaauuugugaaaugcuacauuuacuuauauaaguaaucuguuacacaugccaaagauauauaccguuuaguauauuaagauugaauaaaauucuucuuaaacccaccagcuugucacaaugucguaaaaccguugucaaaaauaugcauuucuaggucccugaaccuaucagucagaauguacacgagaggguacuaguugucucuauuuuuaucaauggggcaaaauaaaauugagaucaggagcauuaggaauauacuaggcaaaaucauacaaauugcucugaagaauacgagggauguaagguuuaacauuucaugaaaacuuucaaaaaguuuacaggccaguagaagaaauuaaaaggcaaacaucauucaaaauucauuacauaaagagcaauugucgauuuaaaaaaaaacaauggagaagguauaaaugaggaucaaguauuucucuuugagguguugaaaaaguucucauugagaugggaacauaaggucagugggaugagcauguugagaagaggggcagguacuguggaugaaauaagcauguagggcaguccucugcuuuguaggauguucagcagcauccugggcuucuauaccugugauccuaguggcacccuaaaugccuaguuaucucuuccauuaaggaaacugauuaguuacucuacacauuugcauggggguuaaacguaggacucccuguauuaguccccuagggcugccauaacaaaauacccaauaccacagacugggugacucaaacaauagaaauguauuuucucauauaguucuggaaucugaaaguccaaagucaagguguuggcaggguugguuucucccaaggccuuuccccucagcuugcagauggccacuuucacuguguccucacauggcuuuuuuuuuuuuuuuucugugcacaugcauuccuaguaucucuuccucuucuuauaaggacauuggucauaaugaauuagggcauggcucgaugaccuuauuuaaccuucauuacuucuuuaauggcccuaucucuaaauauagucacguugagguuagcacuucaaaauauaaauuuuggggagaacacaauucaguccagaucaucucguuuaagaagcgaugcaucaagaggugaggcuaaaaagaaaaguaguaguaucagauccuugaguacuuugcuaaggauuucuuauuucccuuagcaacauauggagaaauacaauuuuuaaguggauuuggacuggaugagaaaaacguggaggcacggugacugguauggggcuguuauuaccacacaaagcaaaacauaaugacuaucugaacuauaacagcaaggucauaaaaggggagaaaaauuacauaguauauaguauuuuuaaaaaauuucuguuuacacagguaaguuaaagaaauuaauucagcacaauacugagaaaccuacuuauacaugcuuagaaccacagagcucuaaaacugaaaaagauuucaagguaauuuuuaccagucucccaggcaaagugggaaucucuucucuaguaucucggaugaagaauuaucuagucuuuacauaagcacuuccaugagcggaggacuuacuuccacacugagaaauuuauucaauuuuuuaaguuauuguuugagccaaacuuucaugcauugcaaucauuuucuuaauuaugugauaaaauuauuucacauauuucagaucacuucacaucauuuuuuucccuggcucucuuucauaauuaaauucuccagggaucagaaaaagcauuucuuuaguucuuaucaggggcauacugauauacuaccuucauuaauauacucuagagugaguuccacucaauauucacuuaauauauuaacuucuuuuaguuaauauauuaacuaucuucuuuaaaaugaaaauagcagaccuucauuuuauuguauuccuauagaaguagagagaacaaucuuuacagaggaaugaggcaacauuucaacacaagaugcuaauguuuccuuccagcacauuuacuuucuugguagaucuuuaauuauaaaaguuaaaaacgaacagucaaaaaauaaucuaauugaccguaacaguuuuauuaugcaacucaauaauguaauccucuucuagcacacacacccucacacacauacccucccccuacacaaggagcacacucacaccgacccuucuguguggguagcuguauguguggaugucaugugugucuggguauauaucccauucuaauuauuuuauuuuugugucaaaggaaaauaauuacugaagauucuuugaguagcagugagcaaauacgacucacuauauacuauauaucuaugggacccaagauuugcccuggagugugucauacugugacuaauuuuccuguaucaguauacugguaucuuguaaaagcacccaauauuucacaaaaguuauuuauuuuacaaaguauauuuauaucaaacauggcacugaacauauuucaaaaguuuauagcgaugaaagauuaacacacacucauacauauaccaguuauuuuucccucaggcaaaauaaaaggaauaaaaguuuuaaucugagauuaucaaaacauaucuguuaauuuuuacagaaucauauggccuuccuauagugugucagaggucaauuuuuuaaaauuaucuuccguaugacaaucuaccugcagaauuacucauuucuuaaacauaguguaugcauuaacuguaugugcaaugacauuaguaacuuuaaaaaaugaaucucauuuuuguugugagcauuaaucauuuucugggccuugacauaagaaaugaacagugugaaggaugacaguuaugauagaggaggccauguguuaaggccaauaauuacucugacaauuaaacuaaaccuauuugcugguucaauacuuuaacaguaacaaagaugcaaguuacaagaaagugaaaauuagacucuugccagguagucuagguauuuuucugcaagcuguaugccagcuaauguugggaugcaaaaauaagacuugcauggcaguauccugagcccguauguauacagaaaaggcuugaauuccuuugaaaaauuaacaggaacaaaaauagaaauuuuuagcauacucugaaauuugcauuuuuaguuugcuauaucagcaagucugcucuaggcauagacuuccucuuggaagguugauacauaaaauuuacugucuuauuuagagaugacugaucugagacucaaguuacuugcacuugaugguuuuucugucaucgauaauuuuguuuuugucagcuguuuuacuuucaaggaaacaguagucaacagucaacaugcagaucugcgaaugucuugcaaaacagugagcgaaagguaauuuuaauaacacagauuucucaaacucuaucccaggguacugaaucaaacuucccauuaaauuuuaagaacugcuacccuaggaauccuaugcauucugaguaauuggaagaagaaaaugaagguaacacuaacucuaaugauaacucaggguuuacuaaaaugugaaauggagugggauuguaaagaucuuggagggauuuagaaagagaauccuuuauagucuuacaggcaaaauggaucuucccaagcccagucuccacacaaacucugaugaacauaaaucaguuaucacuuaccucuaaauaauggacagauuagaaaaaugaguuacuugguaacuucaaauaacaaaauaagaauagaucaaaucaaacuaaaguauuuagaaaaauuuuggaagagaucacauguggugggaggccauggugagaggauugcuugagcccagagguuugagaccagccugggcaacaugacaaaaccccauuucuacaaaaaauacacaaauuagccuugcaugguggugugagccuguagucccagcuauuuaggaggcugaggcaggaggaucacuugagacugggagguggagaaaauagugagccaugauugcaccacugcaccacugcacugcacuucagccugggugacagagugagacacugucucaaaaaaaaaaaaaaaaaaaaaaaggaaagaaaaauucuggaagaaauuagaauaucuugauucauuccuucauuccuguuuaaucuaaauguaugggauaauuucauucucaauaaacauuauaaguaaaguaccucaguagcauucuguaucaaugauaccccaguucucuacaaauaaugcaugcccaaucauagaauaagaaaagcuacacugaugcauuucuucaaaaguuucaguauaucuuacaagguuucauauaauuuagaacuaccagucucuucucccauggccguggguuguugacauuuuguggagcaucagauuuuuuguuuccuuggaaugcucucccuccauggccuaucccaugccucaccccugucccuacuuuuccugucuaacuccugcuuauccuucacucugagcuuaaagugaggucuuauacucuuacuuccaccuucugccuuggcugggcuggauccagaucacuuacauguuuucaugggucuuguuuuuccucuuuauagcacuaugcaacuaaaauuauuuaguuauauuuauaacuuuuauuauaucuccccaucacuuguguauaaauucaaaaagguaaugaaacguaguuuucuuggucaaucuauuugucuuuugcacuuaaaagcauauggaauguagaagggcuuuuaaauauauauauuuuuaaugcaugcuuguacaacuaaaugugcaaauaugacaggauaauuucuuuagcagcauuuguggauuauauaugucucaaaauuacuaaaaagcucuaaauuauacuuuacauuuuauuguuuuucuuuuauucccaaaugauugcuaagggauauagugugacuguggccucuuuaaaauagauagauaaaacaaaaauuaaauuauuaagguauuuuaccuuuuucauuaaacuguaugggaauaguuaaauuuaugguauuaacuauuuuuuauauaauauuugauaacauuauacauuuuaauauuugugauauauuaaauuagauauaaaucuuggacuuuaaaagaagguagaaagacuuucauaguauauuuuacauuuaauuagcaaagaaguaucuucaaauguguaaaucucacuaaaaguuuauguuuguuuauagagcuguuuaucauuguugcuucuuuucugguacaguuacucuauuaugagcacagaaucuguaaguaaaauacaaugaagugaaaagacauaacugaguuaaaugauuuccaaaucuugguauuuuagggaacuagaaccuaaucuguuaaaaugaauguaaagcuucaaaacacauuucuuccauuuuucuuucaacugaugccagaguggcauuucagagggaauuaaaguguagcuaaauagccacaguuuuauauccauuguauugauguuuaguauacuaugaacccaggaauggauucauaauaucauagacugcauuagcaggcuuuccauuuaauuagauuuuuaucauaucuaauggauauuuaacaaguaaagacaauacaagugaaaaauaugaagaaauccuauggcagauaauacaaauuuccauugugcugaacuaaugaguaggugauuuuucuagaaugacuugacagagcauguaaaauauccagcaauaugaagccucagagacuaaagcaauuggaagcugaaguagaugcugagguucagagacuauagcaucaccuuucagugagguaagaauugauguguaugcauaaguaaaacugugcuauucaccauacaacaggucccaugacaaacaguaacauggguuuuugcacagugugcuauaaauucucaaccuucauuuuccaggcaaaaugugggaaaauggaguucaguguguuucaaauugcaggcaaucuuugacuacauaguaauaugaagagaacauggggucgcaaauuuauaggaugcaugagcuaugauauguaauuauucauagugacucaguuuugucauuacuaaaaugggauaauaucuacaauauggaaauauugagaagaauaaauuagauaugcucguuaugaauaaauuagaauauuaacacagagcauauguuuucaugaaugugccacugcuccucccuuauuguauacaauucauuaaggugggaagguaaaagucucacuauugacucaaacgccauaaacugcaggaagaaagagaguagggcacaggaaaucaaguagagagggacacagaaagguaagaagguauguaaaugaaaaagaacauuacauaugaauaaaagauugagauauguaguuagucugauaaacuuuggucuggcuccaauauccauuucacuuuccuucugugugccuuucagcauaguaaaggcuagaaagaaggauacauuuccuaaacucacuggugccaagguuuuagaugauaaauucaaccaaucagauacaauuaaagaugauuuggaaaacuaaagugaggcagaggcaguguuuucauuucuauuugaaaaccuggccaugaagaaaauacuuuuucuauuuuuuucugcagcauuagcuagguuuccaguguuccaucaucguuuuuggaggccaguaggggcuagacauggcugauugaauuaagucuaauacaguucugaaucuagcaauaguagacguauuuuccugauccuugugguuuuuggagcauacaugauuccugacagugaauggauccugaucuuggcucuaugaacugguucucaagccgauggcuuuucaucacagaaaaggcauuaccucccuuggguagcuuacuuaacucagugauaugauuuugggacuuguucuugacagcucaaucuggaaucuguuucaucaacccuacccagugauuuaauacuuagaaaauauuuuucuguuuaaacuaauuaagggaauucuagccucugaaacuagaugaagauuccaauaaaguugcauaaaacuuauaaucaaaggaagaauuauguagacaaacaacaucuuagaccauuugaaaggcaacucucauuugauuaagucuuaacaugcuuuauuuuuuaaaacuuacacauucacacuccaaccaaaagagggaugaaauacagaaaauaaucuccgaccuccccaccguauacucuauuagaaaauguaggauaacagaaagaagaaaacagauuacuauuuuaaaugaacucacaaccauauagggagucacaugugaaaaagaaauaugaguacaaaacagaguaaggcaagcacaauaaagugguaaagugauacagcagcacagaucaaagggagaguauaauaauugugucugugacgaugagagaagggcaauggcauuucuugugauacuaacgacugcaauauuuuggagaagguuucucaaaaugggauccaaacaacuaguugucugagauuaauaaagaauguguuucaguaacauguuuggaaauacuggguuaaagcaaauuauguuuuguuucucaaggacugcucagagacuuuaauacuuaacacaccuuagguauuggcaaaaaaggagaauaauccacaauacaucaugauuuuuuauaaauauauuucaguucucaugagccaucugucagaaguacuguucuaagaaacaccuucuuaaaauaagugucauagauaacaaagauucuuaugaaaaugaaaaaaauggcgauuguaugugcaacgcauugagaaaaaucagaccaggggauaugguuugucuguguccccacucaaaucuuaucuugaguuguaacucccacaauuccgaggugucgugggaggaacccgguuggaggugauugaauuaugguggugggucuuucccgcgcuuuucucgugauagugaaugagucucaugagaucugaugguuuuaaaaaugggaguuuccccgcacaaguucucucuuugccugccaccauucauguaagacaugaauugccccuccuugccuuucaccuuccaccaugauugugaggccuccccagccacguggaacuguuaaguccaauaaaccucuuuauuuuaugaauuguccagucucggguaugucuuuaucagcaacaugaaaacagaugacuagaguaaauuugugcugggagugcgacacugcugaaaagauacccaaaaguauggaagcaacuuuggaauuggguaacaggcagagguuggaacaguuuggagggcucagaagaagaaaggaaaaugugggaauguuuggaacuuccuagagacuuguugaauggcuuugacaaaaaugcugauagugauaugaacaauaagauccaggcugagguagucucagauagagaugaggaacuuuuugggaacuggaacaaaggugauucucuuuauguuuuagcaaagagacugguggcauuuugccccugccuuagagauuucuggagcuuugaacuugagagagaugauuuaggcuaucuuguggaagaaauuucuaagcaacgaagcauucaagaggugacuugagugcuguuaaaagcauucaguuuuauaagauuagcagaggauaaaaguuuggaaaauuugcagccuaacaaugcaauagaaauuaaaucucauuuucugaggagaaauucaagccagcugcagaaauuugcauaaguaaugagaagccaaauguuaaucuccaagacaauggagaaaaugucuccagggccugucagaggccuucacaguagcccuucccaucacaggccugaaggccuaagagaaauaaaugauucuguggacugggcccugggucccugugcuaugugcagucuaggggcuuggugcccuguaucccagucacuccagcugugacuaaaaggggccaagguacaccuugggcuguggcuuuagagggugcaagccccaagccuuggcagccuccaugugguguugagccugcaggugcacagaagucaagacuugagguuugagaaccuccaccuagauuucagaggauguauggaaaugccuggauguccaggcaaaaguuugcugcagggauggugcucucauggagaaccucugcuagggcagugaggaagggaaaugugagguuggagcccccauacagaguccccacuggggcaccaccuagugcagcuggaagaagagggcuaccauacuccagaccccaaaaugguagcuccaccaacagcuuguaccaugugccuggaaaagccacagacacucaacgccggcccaugaaagcaggugagagggaggcugugcccugcaaagcuacaggggcaaagcuaccuaagaccaugggaauccauuuuuugcaucagcaugaccuggaugugagacauggagucaaaagagauaauuuuggcacuuuaggauugccccacuggguuucggacugcacagggccuguagccccuuuguuuuggccaauuucucccauuuggaauggcugcauuuacccaaugucuguaccccccauuguaucuagaaaguaacuaacuugcuuugaauuucacaggcucauaggcagaaggggcuugccuugucucagaugagauguugacuguggacuucugaguuaaugaugaaauaagacuuugggagacuguucagaaggcauaauugguuuugaaaugugaggacaugagauuugggagcagucagggcagaauaauaugguuuguauguguccccacgcaaaucucaucuugaauuguaacucccacaauucccauguguuguaggaggaacgaagugggaggugauugaauuauggggcgggucuuuccuguacucuucuugugauagugaaugaaucucaugagaucugaugguuuaaaaaugggaguuuaucuccacaagcucucucuuugccugccaccauucuuguaagacgugaguugcuccuccuugcuuuccaacuucugccaugauugugaggccuccccagccauguggaacuguaaguccaauaaaccucuuuauuuuguaaauuacccagucucugauaugucuuuauuagcaaugggaaaauaaacuaauacaccaggauaaugcccacugcuauaacuaauuugcugcuagauugaaaaagucuuucagaugcuauguuaaggaacuugcacaacauauuucaguaaaggggaagccauccacacuuguuuuuuaaaugagguguuccaaacccuguuuaagaacaaccauguggcauuaaggucacagaucagaucaaaguaccagcccggauuggauggcaacuuugaaaaguaaaaaauuuuuuuucaaagguaaaaaauaauuauaaacaguauauguucuuugaaaauuugcaaugcaaaacacucauauguaacaggaacacacauauaacaauagaaaaacauaaaucugcaucaauaucaaagucaaaaacucauuucaguaauuuucuugaaaggguuuugugguuaaaaaagaaaauaauuucaugacauugauaaagauuuuauuuucaaucacaacuuucuuuuaguauugcucaauaugucuuauugaggaugaaaauauuuaauuuuaugauuuuuuaaguacacaaauaacagauauaauaauaauuagaagaauacaaaauaagcauaaguaacacuuaugugcugaucauguaccaggcacuauuaaauuuuuuuuuuuuuuuugagaugauggcucacuauguuggugagauuggagugcaguggcuauucacaggcacaaucuuagccaacuacagccuugaaauccuggccucaagugauucuccugccacaacccucccaguaguuggaacuaaaggcacgcauacugugccuggcuugaaauucuuuuuuauacauagucucugucgcccagacuggagugcagugguguggucucgguucacugcaaauuccaccucccagguucaagcgauucuccugccucagucuccggaguagcuggaauuacagauacccaccaccaugcccagcuaguuuuuguauuuuuaguugagccuggguuucagcauguuagccaggcuggucuugaacuccugaccucaagugaucugccugucuuggccucccaugaaaugcuuugucuuaaaaauaacauuauaaguaguaucauuacuauuauacaucauguuuauggauuaucaaaguaaaaaucuggggucuagugcuuugcucaaagugaugguuuucugguuacaggccaaguuaccauaacagacacacaaguacaguggcuucaauaagauagaauuuucucuauuacauggcagcugaaaguuacaggcaaguuagcaaggcaccuuuguuucacaagagcaaucaucagggacccagauacuuucugucuguugguucugucauccuccagauauugcuuucaaggguauggcugaaaccagcuuuccaugacuaugucuacauucaagcccacuggaaguaucugagagcaguggaggguaaagaggugcuuuaaaagggugagauugagaacgugcuacaucauuuccuuucauaucccauugaccaaaauuuagucauaugacuuugcauagcuccaagggaagguggaugauuaccaaaagugaguaaaagggaaugaauauuggggacuauuagcauucagacuuaaaaaguccuaguaaaucaccuggguucccuucuacuaauucacagagcugagauacaaauccaguccuuauuuaacuccuagcugauauucuacaucuaaaaucaaucugugaaacagguauuaaccccacugauaaauguauacuuaugaauacagagauaaaguuauuucucuaaggucagcagcuucucagaagcauugcaaaauaugaaacugcaucuucaguaagcaacaauuuuguucaaaaucacauuauauguauuuuucuaugauuagcaaugcauuauucuuuuauguauaugaccuuuagacagucuagucuuauauucuacaaauauaucauucauucaacuuauucauucauacauuaccauuccuuagugaaaguguccuuuuuuuuuuuuuuuuuuuuugagaaggagucuugcucugucgcccaagcuguagugcaguggcacuaucucggcucaccgcaagcuccaccuccuggguucacgccauucuccugccucagccucccgaguagcugggacuacaggcgcccaccaccaugccuggcuaauuguuguaguuuugguagagacgggguuucaccauguuagccaggauggccuggaucuccugaccucaugauccucccaccucggccucccaaagugcuggaauuauaggcaugagccaccgcacccagcuaaaagugucuucuuaucuacaagaggcugacuaccaggucuucaaaaagaauccucuuuugugacuucuucuggcagaaaauuugacuaaugucauuuuaacuuauaguagcuuugccagaagaauguaccccugaaaaucagaagauuaucuguauugacuguaggcuaugaaaucuaucuccuagagcucacuagucaaauauggcucaagcuuucagugagagagaaucaguaugcaaaucggaucacuuacauauaauaagucagucuauuucuaggucagucucuacagaaguguauaucaaaauaaaagcucucuccugaauuccacuaacuuuaaaucucagcagagaggcaaaggucaaacagagagggccaagagcaaauugagaauaaaguaaucuugcacaugccuugaguuuccacuacaagugauaccagcaaucaggggaugccucucugugcugggaguugagguggauaaagugagggcaccaccagacuuuagugcucucugucuggauacuuucauaacuacuaaaaugcacuuuaaaaauuucagguacauuagcagugccauagggaguugaaaucucuuuucauaccauuuuagcagucauuuggcuguaucacaggucacuguuucuuguaugcuacaguaaaccucuaccuaaaaagugucagucuggcugugagaagcuaucaacuaucugcaugguccacaggacucaaaaaaaaaaaauagcuugucucacaugccagacaaacucucugcuucauugaauagcagcaacaguccuuccuggagaucaacgacagcuuccaaaugcauuuccauuauccuuacccauaaaauauguguauaacaaugcauauaaugaugaguuuggacgucgauuuuuaaugaaaaauaguucucagauuuguccaaguaauuugcuuuuauguuucugaccuuccucugaaauuaguuccauguguucuguaacauucuucauccagauuuuuaaauuucuaaagaauuaaaaauguuauauuaaugauuuauaccauuuuuaucuaaguuuauugagaaacauaauaccaaaaaauaguauaaaauugaaagugugagcagguguuuuuccucaaaagacauuccauauauuucccaauagaauaaaaacuaucauuuaggccugaaaaauaauaucauguuuugauauuuaaauuguagcuuuccaaacucuugaauuuuuuaaaaguguuauaaagagggaaugaguuauuaugguggucauuauacauacaugagcaacauauauuaugaaaaauauuuaauagauuugauguguuuauuuuaauguuuccaggaaauuucuagucuccuagaguucagcacuaagaccuuuacauucaaccccaugucuugcuuucuacuauacaauacuaagugaauuccucgauguuuauuuacucaauagauauuuccagucaacagcuaugcaucaggcauuguguuagcacugaaaaugcaaugaugggaaaagaagacauggauccugcucaugucuuuuaaagccuuagaagagagauaaacauuaauaaaauaauuauacaugcaugaauuacaaauuguguuaaguucuauaaaaaagggguauagauguuaaugacaggguaauacggagugggauaauuuaaucugugauuugagagggcuccugugaagaagugcacgaagcuacaaaguuuacaaaaacaaugugugugggugaguagggugggcagccaacugugagcuggcaggggagaggauuggguacucugagcaauggguuguccacaugcucacucucaaaagacccaauuguaaguccuugggcuugagcuucaguuguuuaaauagaguuccucaauuuacaugccuccuuccuuguacuauuuugggaugcuucccuaaauguucaguaagaggacugcuucaaaaucuuugacuuuuuuuuucuuuuugaccaggcaaacaaauggcuagguuaaagaauguguuugccagccucccuccaaccaugcaaggucacugaacugaauucucgccaguggugugcugcugaacggucauacauuccagaaagucuucaaagaaaagguuagauuauggauggaaucgcuagagcacagacaaccaucuuagaccaugagguggagaauaaagagggaaccagauggaaguaggcugguuccugaugagucuacucuuccugugcuggacuuccugccuuuaacguuuuuuuuaacauaaauaaauuuuucuuuagcaguuauauuccauucuccacccagcaaccaaagugaugcuuucaaaauuuaaaugagauuauaucuguucuuuguuuagaccccuaaaugauuucuagucucacucagaguaaaauacaaagucuucuggcccuucaaggcccuuugugauuuagccucaucuacuaacucucucccucuuucacuguguucucuugaaauacuauuaaccucaaauaacccuauagcuaacucugucacuuaauucguauccccacucauuuaaagcauaaagugcauucuaugaucauccuacaaaaaauuacgcuccacauauuacucuguccagcagugcucaagucacuuauauggguacaaaauaucauaguauuugcauauaaccuaugcacauauggcuguucacuuuaaaucaucuuuagauuacuugcaauaccuaauguuguguaauaguugccaaacuauauuuuuaaauguguauuguuuuaaauuguuguauuauuuuuuauuguuuuucaaaaauauguuugagccacauuugguugaauccugggaugcagaaccuggggauauggaggacagacuguauaaauauuauguauauuuaugggaaaauacauauaugugcauuuuucccuuguccuaucauucaguuguaagcuccaucaggauaagggcuuugugcauaguuuuucaauguauacccagcacuuaggauaaaagugacuaaagccuagaaguuaauuuauaaauauuuguugaacacagaaauaaaagaucuuuauuaaguucacucuagcucauuauagauuguuacaauagcaaaaguaaaagcugauguuucccuguagccuaccuagcugagaggguaaaaaaaagucuuggcaguguguauacucccaaagucggcugauacucuuuuuaaaagcuacuuaaccacuucccaauccccagacuuauauaacacaacccccucaauaacuauguaguaaacucaguaacacugguuagauggggaagaaacugugucugaagaagacauggaaaacaucagaguaaagcauaggucagaaaaaggagaaaacagagaagaguagcauccuggagacuggaaagaauccccuacgucaguguggcugggaaagaugccacaacaucacaggauaaaaaguaaugcagaucuaaaugcaccacaauuuaaauauccucuuccugucuauuccuuuggaaagucuuuauucacucaacaaauaugacuugagcuuaaggcauuagggguacaacgaacaaaaaccacagacucugcauacaacuuuuugagggaaaaucgaacaaguggggcaucacuacauccuaggguuuaugguaucauauuucauuccuucugaagcugaguuauagaaauauauacucugacuagguuaagagguuuauguaaaauauuaaugagguaaauuuugauaaacugaauuucucagauaaaaagauacaauaaaauguuuuuuuuuuuuaauuuuagcaaggaaauugaauuaggauaaagugacagauaaaagagucuauuucauuuaaaggaguauucauuugacucuacacuaaagcuuagucuacuuggaagaaaugcauuacauucauacacauucacuauuauaugauuuuaauauauuuuaauauauuuaaucaguaagaaauugcucuuaaucucagccuggacaguaucauaaaaguacaguuaaaaccuagcauaggcugggcgcgguggcucacgccuguaaucucagcacuuugggaggcugagggggguggaucaugaguucaggagauggagaccauccuggccaaaauggugagacccugucuccacuaaaaauacaaaaaauagcuggguguggugguacaugcccucaggaggcugaggcaggagaaucacuugaaucagggaguuggagguugcagugagccaagauugugccacugcacuccagccuggagacagagcgagacucucucaaaacaaacaaacaaacaaaaauaaaaaacaacuuaacacauauuauauagaaauauuauauuuuauauuuucaaaucgaagucaggaacuuggcauuuucuucauuucugacauaccuuugcuuagaacccuuggcugaggaaguggcugauuugaguuguauuugaucucuccucaccagcugugcauuauugauagaaagaggaaagggagggacagguggauggaguggagguugucuauucauauuuuauaagccuuuccuugugagcccugcaguugucaucagagcacaggcccacaugcagugucccucacagcccaaggaccacugacacagaaccagggucaggauaugcagcaugacagauucuuugaagucugcauuuugguggcacuuagacacaaaauauuuggucacuuuugaccucaaauaacccaugaggccaugggcuaaaccacauaugaauugucuaacaucaucaugaauccugucuuuugaaaaucucaauuacuauuucuuauaucugacuaaauagagcuguaaagaaaccagagcacagaacugaaauuugguaacacagugaaagaguacaaauagcuggucauuacuuuccuauacuaauuuaaucaauaguucccuguuguaacaaccuaugcaaaaggacuuaaucacaacuucuaaaacaaacuagagaaauauauguaauauauaauauagaacuagaaaaaagcaggaauuugaauaaugugauuuuuuuuuuuaagcauggauauguucuagugcaaagcagacagaaagucaaucccagaaaaccuuuuucuuacuaagguuugcaaugaucaaaguuuggauaaaaaacaauugauccaggauacaauguaguuaaaauaggcaguaaaucaaacacaugaaauagagguuuauguaguugccauauauggauuuaacuaauaaagauauuaguuaauaauugacuagcagggugaguacuuaaaggcuauuacaucauauuacugugguaaccugucuuuuuaaugaauauuagucacaacaaaaugugaucauuuagagccucaagaugaaguguauucauagcuaucuguauauuuuuaaagaacaaauaaagcccaacaugccauugccaauagcagaugugauucaaaaagcuugaaaaauagcauaucauaaaaaugugcuuuuuaguuugcagcauuuuuuccugaaugccauggauugaggucucccaggaaacagacucuguauagagaugugaaugcaggagauuuaucaggacaugcugucucagggucaacaccaauuuggcagugugugagaggaaggaguaggaauugggagagcuauagauuaggcugugauauagucacaguaagaccuugggcaacccugaagcaacccugaagcuggauuggcuguggagaguaguucuggguauggugagggcauugugccuucauacucccaugucacaagcacuggcugugaccugcucagugaaaggguguugguaucuucaaccaaagcauuuccccaaaaggaucgagagccuucugcuuacaaucuucccagcagccagaggaaggaauccuuuaguacugaaaggagaucuggguggaacagcacagcaucucugacacuaacugacuucuucaaauauuucuuuucuuuuuuuuuuuuuuuuuuuuuuuugagacagagucucgcuaugucacccaggcuggagugcaguggcccaaucuuggucacugcagccucugccucccagguucaagugguucuccugccucaccuccugaguagcugaguagacaggcauaugccaccacaccuggcuaauuuuuguguuuuuaguagagaugagguuucaccauauuggacaggcuggucucgaacuccugaccucgugauccacccgccucagcuaugugccguauaaacuaccauuaucgaaggcguucaaaacuuauaugaccaauuccuuccuccaagagcuugagagcaggcugagcacugucgugcacaccugcagucccagcacuuugggaggcugaggcaggugaucaccugaggucaggaguucaugaccagccugacuaacauggugaaaccccgucucuacuaaauacaaaaaaaaaaaagaagaagaagaagaaaaaaaagcccggcaugguggcgcaugucuguaauccgagcuacuugggaaacugagacaggagaauccuuguaccugggagguggagguugcagugagccaagaucacgccauugcacuccagccugggcaacaaaagcgaaacuccaucugaaaagaauaaaaaagagcugagagcauagaugauacacauauacacacauaacauauauuugauauuacucuguaaguuaacaaauauuuagagacauguaagagguaaaagucaagcacaagauauuuacaaaguggagcgcucaucagugaaugaaaaguauuggggggaaguuccuuuucauuugaauuaggccuuaaauaugaaugggauuuuaacauggggagauaaaguaaaaaaaaauuagaaaguaugugagucaauauaaaauaggacccaagcaacaaggccaacuugacagaaauauagguuauauuuuaaaaguuuauguugauauugucaaaauagaaguuggugcacauuuaaaaacccagacuuuauuggagauauuauggaucucuaccaaaagaucacuaccuguuuguuuaugaauagauggaaggaaugacauuuugagaugugaccuucucucuacuaguauagccaaaugaccuuucccaaaaauuccaugguuuuucuagaaucccgucccuagaguagacaaucaaaauguuuacuuuuauuuguggacaucuugacugacuguuuuucaaaugaacuaaguuuuaaaaguuaaacuuuuuaaaaauugauucuccuaggagaguaauuuagccuaaauauuccauauuuguuugcagaaagaaguuacaaaauuuucccaaaccuuugcugcucuccaugcauaauuuugaaauaauuuccuaaacuuuauacuuuagcuaaguauaggaccaaucuuuacaucuauauagaauagguuaagucuguccugcauggacucaacugauacugaaauaagaggaaauacuuuaauuaaaauguaaaacaaacaaacaaacccccauagccaugaagaugcuauuuaucaagcaccagauucugagugguguaauuacugcuaacauuauuauuguuagaaguauuuuuauucuaauuuuccugauaagugaauugccugaauccucacagcuaaucagcagcggaguucagguucaaacucaagcuguuuaccccaaauauauuauccccauugaguacuuaaaguugaggcuuauacaauuaaggaauuuaaccuguuguagucaggccuauuugacucaaaaguucauacuucuaaucacuagacuaugaggacccacauaaaaauauauuaaacaagacuuaaaauauaguugucguaacaaaaaaaggguucuuguugguuuccaaauagucauagaacaaaauccugagugaaagaaaaacaaaauguacugauaaauuuugcaucucacuaauucauuauuauucauuuucauuccuugagacaauuuuaucacauuuugguccucaaaccuccaauaccacuucuccuauucucagcugauaauugugacuuauauaccacuuugaaagaaaaaaaggcaaacaagcaaaagagaacagacucuuuuuuccaauaccagaucuaccaaucuaccuccauguuuaaauguuuaaucuguucuccuuauugaaauuaguaaguguccacaugcacuucuucucugcuuccuuucacagaaaaacaucuccaaaggaauuguuacuacuugugaauucuauuugacuccuccccaucucacccccauguucuuuuugaucuccuccuuuuuuggaauuugccccacuacucuguuuaaaaccuuucuuaggaagauuacuacugacguguaucuuacuaaauccaauguauaaaccuuuuuuuuuuuuaacaucguuuuaaguaacuucucggcaguauuauguagacggcucccugcuuccaaaaacacagcuuuuuagccuauagaaaacaucugcuuuucauucugcuucaauggcuguuccucacuagugauauuuccuuacucuuccuccucaaauuaacucuguauguuaguggcucuugagcugaauuuauggcccuuuauucuucucuaucauacucuuuucauagaugaucuuaucuguucucaugacuugaaacauaaucuguauguggaugacaucuguuuuuauauacucagaaauaaaaucucccugagcuccaaauuuguacauacauaugauuucuugucaacuucccuuugauaagacaaggagaaaagcagccccugacaucugagauguugugaauaaauguuugugaauaaauauuuuugucaacauucacaaccaguccaucaaggugucuauuuccaaagaaaauuuugaaucccuuuuuaccucaucacagauagcaucguuuucaccccauaauuaucuauggacuagguauacaaucuccacugaguacauagauucuguucauugaucugugugaaaacaaguggccuccacaauguauucuccaugcaaaaucuuaauaauuuugaaaacauaauaaaugguuuugggaaaacuggauguccauauacagaagaauaaaacuagaugcuuaucccucagcaaauacaauaauccacuaaaaugacuuaaaaacauaaacauaagaccugaaacuauaaaacuacuagaagaaagcauaagagaaacacuccagaauauuggucuaggccaagauuuuauggguaagaauucaaaaucacaggaaacaaaacgaagacagacaaaugggacuauauuaaaccaaaaaccuucugcacagcaaggaaacaaucaacauaauaaagagacaaacuguugaaugaaguauuugcaaaaucuuuaucugacaagaaacuaauacacagaauauacaaagaacuuaaacaacucaacauaaaaaaaccccaaacauuaaaaagugcgcaaaagaucuaaauacacacuacucaaaagaaggcaugcaaaccaccaacagguauaugaaaaaauguucaacaucaguaagagucagggaaaugaaaaucagacccaaaauaaaaucucaucaaaaccaaaauaaaauaucaucuuaccccacuuagaaugacuuuuaucaaaaagacauuaauacuggcaaagaugcagagaaaagggaauuguuauacauuguuggugggaauacaaguuaguagaagccauuauagaaaacaauauagauauuucucaaaaaacuaaaauuagaacuacuauuugauugaauaaucucacuacuacauauuuaucuuaaaaucaaacagagaaucaauguaucaaaggcauacaugcaccccuauguuuauugcggcacuacgcaauagcaaagaugugaaaucaaacuaaguguccgucaagagaugaaaagauaaggaaaaugugguauguauacacaaugaaauacuauuuagcuaaaaaaagaacaaaauuaugccauuuacagcaacauugauggaaauaggaguuauuauguuaagugaaauaagccagauacagaaagacaaauaucccaugugcucacucauauaugggagcuaaaaaguugaucucauggagguagagaggagaauaauaguuaccagagccugggaaggaugcagggguggggacgcgugugaagagaguuuggaaggaacaaggaauaaguucuaauguuugaucauagaguagggugacuauaguuaauaacaauguacuguacauuucaaauagcuagaagcguggacuugaaauguacucagcagacggaaaagauaaaugcucauggugaugaccaucuuagcuacccugacuugaucauuacacagugcaugcauguaacaaaauguaucccacagauaugaacaaauuuuauguaucaauaaaaacauguaaauauaacaaugucauuucacugcuuaaauucuugcaaugauauacacucagaauaaaauuaaaugcaagauuccuauacaaauagcucuaggguacuuacuucuaugauaguaucuugaaaggcuuuucccuuuaacaacucuguuuuauccauacugccuccuuuuuguuucauuaauacauuacauucuuuccugacucaagcuuuuugcacauuuucuuaacauugccuguaacguucaucacucaucauccaggucuuuacauggugggcucccucgcuuaacucacuuugcguuccuaauucaguuauucaaagagauguuuccuuacaacuccacuuaaaauaggacacuccauccuguuacucugcauugcuuuaucugcuuaucuauuuuauucuuugguaauaguacuugaagauaggaaauuaucuucaugaauugcuuauuuacuuaucuauacaaugauagcuucuuacaagcagaaaccucugucugauuucucacuguauccccagugcuaagagcaguaccugccaaaaaaguuauuuuuuuagaagaauaacaauagguauagauuaaauaucucaaaaauggcagaaacaaaguuuaacauucauuuucauauuaugucuacuggaguucagucaaaagccagaaagccagucugaugcccauauuugacguguagaccccugggaaaaggccagcacaaaugguaccagcucugccugcagcucauggacugucuuuagacacagccuccugucacaucauguuucccucuuuguaggggaauugcaguugcaauaugaagcacacaccaggucauguaaagaauaucacacauguaugcacacgcacagaaaaggaaauaguagaagugaugcuaacaggaauauuaaaucuguuauuugguuuacaauagauguaaaugaaaaugagauauaaaauauacauagcaguaaaaagagcgacaauuggaaaauaaucauagccaauaaaauucucuuuucucuuuugaaucuccaauucaaagaauuuugcucaucugaauuuguccggaaaguuggacccuuucccaaauggucauuuuaagucuggauauugaaauaccauuucaaaauacacugguucaagaaggguauuuaaacacaucaaagcuauauaaaucauucuaaauaauacuaacccuauacaguguuuuguacugugucaggcgcugauuuaagggguuuaauuauaauaauucauuuaauccccacaacaccacggugagaucgguaucaugaucaucacugccauuucacaaaugaggaaauuaaagcauaaagcauguaaguuacugaaagauuuggguuugaaccuagauaguuuugauccuauaguuuauaggcuccucacacucucuuggaaagccccuauuaccugggaucgucuaucuccuacuaccaucaugcuguuucuugguaucaugcuucucauggggcagauuucacgagcuuuuugguguauguaaagaucuuaaucuuuccccaacucauaagcauacugacuccugaacuguucuuccacagauagugcaacaacagccuaagcccucaguauucacaggacuaugaaaugucugggcacuguaguuuacauuagucuuuucagacacccauuacaugcccuuccuaaggcaaguaauuaagggaucuguguuaaugcauuaaaugguuugcacguuaacuuuccuacaauuaucagugacagguuaugcauuagcaaauauguaaacgauguguuuguguuuauguuguuguuuuggaaaugauggagaacaaauacugaaggaguuucuauauugucauauauagcuauuacugguaucuauacaguuaagagacuuucuaauucuaauuugauaauuauuuaacaauggaaaaacccuccuuuuaaaaacuauaguaucaugaaauucuuauagucuuauuuuuacuuaaucuuacauauuuugguuuucacacauuuguucauuggggagucauuuuuaccacagucuuucauguacuugaauugccuucuuuccucaaacugacaguaacuccgugaacccuucuuuagagguccugguuuccagcccauuacucauuuuaguugccaucuccaagucuuacacauguucaucccaucaguuuugaaguauagaaauuaaacugcacacuuguucugacucagacugagaauuguuuucuaauacuugcagccauccugcucugaggacauucaaguuuuuguucguuauuaugcuuuguuuuuaacugaacaaacgccacucuaugaaaacaggaugcauaaggaugcuuuuaguaagaucacauugcuuaugcacauuaacugguuucagacaaccugguuuuugccuagccagcuauuuucuauuacacucauccccuuugaauacaaugucauuuauuacgcaucauuccuccaguguuucaaagucacaagaaauccuaccucucucuccagaucuuggcaaucucauccaaagugguaucauucuauagaucacuaaaaauauucugauaacauaaucuaauaaaaccaggccaaggacuuaucuuuaaaggacaauaccugauauguccacagauggugauauuuauugguuucaauuauucuuugagcaguuaccuaacuaaucauugucuaaaaauguguguauuacuuacauuuguaauaaaucaguuuuauauaacaaucagaaacaguaaaauauagaaaucugagugcuaugaauauucauucauuuguccucucuucacuuaauauguaccuucuccuauguugauuaccauaaagauuaaaauacaauuuuaaaauguauuuguucaaaaaagaauugguauaaaugaaacacacacuguugccuuugaaagucguaaauuugcuuucucuccuuuuuaagcauacuuguuccaauuucugcaacaauauauguacacacacaaaguuacagacacagacauuuaccuacuggaccucuauuaauaagucauuuacauauucacuugccacaauauauauauuugguguauguuucaguaaaaguuuuucaaaucacaaguauccuauuagcuacuagcaguuuaaaaagucuagucuguaucauauuacgaucuguacuauuuaucagaggaauaucaaaaugaacuaaauaaaaaauccacugaaaucaaaauauauuaaauguauuacuuuuucacagauauccuaaaauaucccuucauaucucucuacgcccaugaacauuuuaaacacuacagaaauuauuauauagcuaucugauaauuugacuuuuguacacucuuauuuugcuaagaauccauucauaccuuuguuuaguauuccacucaaagguguuauucuugucacagacuaagaaaugugggcucuucuuagaggaauacaugaacaaauucauugguuuacuguguucaucucuuguauuuuuuucuauaugauuaagagagaauguuguuugaaacaagaaauacuauggaaaagugaaagaauuacaucuugcuucaaaggauuggaaagcuauaaggcuugacuuucucacuacugaauugaaguuucaugaauccacuccagcacugcuuacauuugagguacagaauacugcucuguaaaucuggcucuguauucaccacuucucucagaauccuucagagaacgaauauuguuuacagccaacauguguuuaccaagcacuguagcuucguggguguguuucauuaaucauacaacugccugagacagagaaauucgcacuuuugcaaaauucacuacaaggucaccgacagcccuuagaacacuggcucaucuggccaucauccaaacugucuagguggcuauugaagucuuacuuugcccuugucuacauagguuauuaugaaggauauuucagauuagacuccuugauguaaacaucaaaacauaguuacuaaucaaagaguugugcauauuuuuugccaacuagcuuuagauugcuuaguuacuagaauguugaaaugacuaugaaugucaaaaaucauuacaguauaguauaaguuaguauuuaaaagucuagaaacuguuagugccuacccauccugucugacauugaaggcaaaggaaggucagaacaaguguuaaaaaagccacaaaacugaguuauagcacauauauacuuuauuuaacaacauugaaaagaaagcucuguggaaaagagaacauugauuuaagcuugucuauuucuaagaacuaucucuuugcaguuacucaacuuggaaguuuuauauuuuguaaaucaaacagccuuuuuggacuaauuucuuuaacuguauuaaaagucaauaaauuauuuugauguauauuuagaauagguaaacaaauacuuucauuuuaaauguguuuugauuauugccuuauagcugacaaauaauugaaagauggcuauuuuuuauuuauuuacuaguuuucucuuagcugcauuuucauauuuuaaaugcuuaaaacuauauuauuuuuaaucuacguaucuuuuugcauuuucuuaaaguuaguuuaaaaaucguuaccaccuaacuuauuuuaaaaccugauaaaaugucaacaauauuuuauuaucuuaauacauuuucuacugcauuugauuauuuacgcuuuuuucuuaauuggguaucuguauaaauaaaauguacccauggucucuauguuugcuuugcccauucuuauaaaaagguguguuugccaagaauuaacaaauaccauuccaauuuuucuagugaaauacgauuuucuuauaauuaauauuuugugaacacacaaucauuagaaaucaucucauuauuuauauuugauugauacaauaugaagcucagcuugauaaauuaaaaaauuacuuaucucuaaaauuauuguuaccaauaaauauguauguauauauuuucaaguauauauuugaauaucuguguaaauuauugcugcuauucaaaaaugaagcaugcucuucugcaacacuguugaaguacugagacucaaaaucaacuaauaguugauaaggcagacacuccuucaaacacuuuuuguaacauagaagauauuaagguuacagaacaagcauggaacuuuucaaaauguauuauacaggcuggaggcuacugacauaagaaauguucaggugcuauuccccauagugucgccucaacagccagggucuggaaucacaaauacuuguugagggcaaguguaucauuucuagcaccauucuagcacacauucucuuaaauucuuucuuuggucuaugugaauauggacauguucuuuaacuagauaaccuuguuauuuugaauugaacuaauauuuucauucacaaauguugaauuuucauauuaauuaucgauccuaagggcuuagcgaaaguagaauaggcaggaggcaaaagaggguaaaaagcugguaaagauuuucccucuauggcaggaccuguuuggaggaaguauuucuagcugaaugagauaguaacagauacuggguucagcggauaagcuagaguucccaaggggaaguggugacuucaucacauucuauaguugguuggugcaaaguguuagaaugugaggcgcccgggccaggugcgguggcucauaucuguaaucccagcacuuugguaggccgaggugggcagaucagcuaaggucgggaguucaagaccggucugagcaauauggagaaacccugucucuacuaaaaauaccaaauuagcugggcuugguggcguaugccuguaaucccagcuacucgggaggcugaggcaggagaauugcuggaacuagggaggcagagguugcagucagccgagaucucaccauugcacuccagccugggcaacaagagcgaaauugucucaaucaaucaaucaaucaaucaaucaauaaaaugugaggugccuggagaugucuguaaggaauacacacugcuccacuguugauccuaaagaauauauuccuuccaucuaccuguauguuuguacccauuaaacaaccccucuucagcauuauccaucuucucuccucugguuuuccuuaaaaggaaaccuugccauuauguggaacuaaucuuacccucagcuucagcagagaacuucaauuggcuuaaaauaccagcgcaucuacugucuuggaaacaaaaaaucauuuaaaaaugguacaaaucuugggaggccgaggcgggcggaucacgaggucaagagauggagaccaucuuggccaacauagugaaacccggucucuacuaaaaauauaaaaauuagccaggugugguggcuggcgccuguagucucagcuacuugagaggcugaggcagaagaauugcuugagcccgggaggcggagguugcagugagcugagaucgcgccacugcacuccagccugggcgacagagcgagacuccgucucaaaaaaaaaaaaaaaaaaaaaagcuacaaaucaaggccgggcgcggcgucucaugccugcuguaaucccaguacuuugggaggcgggcagaucacgaggucaagagaucgagaccauccuggccaacauggugaagccccgucucuacuaaaaauacaaaaaucagcuaggccugauggugcaugguggugcgcgccuauagucccagcuacucaggcggcuuaggcaggagaaucgcuugcaccugggagguggagguugcagugagccaagaucgcgccacugcacuccagccuggugacagagcaagacuccgccuccaaaaauaaauaaauaaauaaauagaaaugguacaaaucagaaucugcugggugagguggcuggugguucaugccuguaaucucacugugggaggcugcgguaggcagaucaccugagcucaggaguucgagaccugccuggccaacauggcaaaaccccuucuuuaguaaaaauacaaaaaaauuagcagggcuugguggugugugccuguaaucccagcuacucaggaggcugaggcaggagaaucguuugaacccaggagguggagguuacagugaggugagaucacaccacugcacuccagccugggcaacagagugaaacuccaucucaaauaauaauaauaauaauaauaauaauaauaauaauaauaauaauacaauuuaauuaaaugguacaaaucgauugagaccagagaggaggugaaccucaagacuugugcagagccuaccaaaggagauuuucucuacucuuggacaauauacugugaaaguaugagggcuagaaugcuccuuggcugcaaaacauuuacuaccacauaggaagaggguagaguugcuggugggauggagaucaucauguaguuuuucaggaugaagucaacacccugggaaaguagcgggaaacuagagaaaccagagaugguggugucgcugguccuccaugucaaaccugaaucugaauuuucuuuuuugaagucaacacauuccuugcuuguuuuuucauuuauuuguguuagucaguuuaaguugaguuuuuuggcacuucccaaacaaauuaccuuagcuguuauauuuuucuaauacaugccuuaaauauugagaugggaaacauagaaaaaauguauucagaaaucuaagcaggcuaguaguugucaucaagauuugacuacugguaucagggucccauuccucaggcugagcaggaccagaaaagaugaaagcaaguaaaggagucaggcaaaaacauaacauugucuuaguccuagaaagaaacagagaaacaagacuacccauuacugagaaaggaaauaaugcaguccuaguaauucuuaagucagaaacuucuaguauagggacuucauuaagaagaaauugcaucagugaaguuuggaaaacagcuaugucucaggaguccauguaugaucagaggagagggaaauuacaacaguuaaggguuaaaguagcugcaucugaagacuuaacaucaaggucuuaccuggaaguauggcuuaauaauaaauauuauugaauguuuauuaguaaaugcuuuugauucuuaauaggaucaggguaggauuaagcuggcauuucuugaggaaaaaggaaaggucaggaagcuuguaauagucucuuuucuuguauaauauaaaagaauaccauauuuagaaaguguaauugaaaaaguaaagauaguuggaugagaaagaagauaauggcaauagcuauggauaagaguuguagcaggauaucauuucccccucccucccugauaacauacucauuacagaacagaaacuuuacccugccuugagcguaggagaguccuaagaaacauacgcugaauaaugcaucuuuuacuuuuacuucugaaauuuaaggcaaaugccuuaagcuuuuagcuuuuaggggaauuuauuuuuucuaguauauucaacauucccugaauaaaaacaauuucuaaaagaaccacaauucauucuuacaaagcauucaagcauauauaaaaaauuagauaugagaauuuuuuaaagaucagaacuuacucaaauuuauauaucuuuuuuuauaaauaauuacaauaaaaguaaccugucuuauuguuuugccauuauaaaacggcaauagauaucauuuuaggguauuuuaccucuaauucuauguuuggauuuaucuauaguuagauaacuuaagcuuuucauaauaaacuaaauuaauauuuauccaacuccuauaugauaaacuuucaaggauugggggauuuuuauuccaucaauucucuauauguuuaguaaauucuuaaugaaaaggcaguacacuuuccaacauugacguguuagaaauaaugcaucugcucuacaaauaacuuaccuaauuggugaagauuucugggaagaagugugugcauaggcccgauggguuaaaggaaaaaguuaccuuucuauagagagagugacauguaauuucaggcccuuaguguucaagaaaaguauaucuuaagggaguauaaagauuuaggacucaguggaaaaaaauaauuugcucaaagugacacagcaaguuagugacagacuagaaauacagaagguaagaaaaaaagacucuucagaaucccagcaugcauaccagugaaacauucuguaaguacguaaagagaugacaugaaguaaaaugaguuguagcugauaaacagagauaaacuaucccauaacuccacuaauuuagcauuccagagcaaaacaaaauggucauguugcuuucagguaaacacaucuaauaacugguaaauugacagcaguuuaauacauacuccuauaaagccuacacaauagccacuaaacaucucuauaaaggaaccucuagauggucuggcuuuaauauuguucuuggccacuaaucauaggauaaaacuacauauaaauuuucuuucuaaaucuuugcauuuuaaaaauaaaaacugucacaauaaauauauuuuaaaaguuauaugcuauguguagugugacauaaauucccuaaauuucaauucagauacuugaaguuacccuugaguuuauucaaucaugaguuuauucacagcauacaacagacuauuuaaucagguaccauagcgcaaaauaugugcaaggugaugauauuuuaggaagauauacagagacagcacaaauauuuugaaguaaagugaaaucauuguagguuacuaccuaaacacuagaucuacaggaguuaaaaaguggcuggaugcagacguacugcauuuuauucucucauguuuauguaaggaaaaacugagaaaaugcagcgcuuugggaagcuuuguucagcagucaaaucaugaaaacaugugagaaagaaagaaacccgaugauuuucagccaaauccuaugacuucacaaauuuauaugcugaucaugcuucuuuuucuuuuauaucacuuauuuuugcuuuucuuuuuacuuuauagcauugaauuugcuacauggucuuuuuguauuuaaauauauuauaaacuuccaagcccaauauaucuaaacugaaaccaaagaacaaaagugagaccucaccaccaccacacaccaaauuauugcucucauucaacuuagaauaugcucaaauauauuggagaacucaauagcaaguaccacuacugaaaaaaauuaaacuaaauuuaaauaucuaguuguuucauaacaagaauacaaugaccucacauuuaaaauucucaucuaguauuaaaauaucucuucuuaaauauuuagacauuaucaaagcugucaggaguagaacaacuguccugcucccuaauauuuaguaaguagcauguuaaacaguauaaacauggaccuauagguaugugugugugucuauacaauaugccuaggcaaagaagagagaaugaaaaugaaaaauaguacauuagacacuaaauagcuuuauaauuuaugaucaauucaacaaagggaaauacucuaaaucaaaugagcauauuauguuuuuuaaauauucucaauguaaguaauuuuuuaaagacauaccuuaaaagcagaaauaagaaguaucacuuaacuuugucauuucugaucuuggaaauguuuaccaaaacaaugaucauaaguaauuuaauauaucugugcugucagacuaggacauuuggacacuacaaguuuccacucauguuauguuucuguuuuauucuccucuguggaguuuagauuaaucucucaugugacacuucagagaaaggaacaagaggacugagugcuagaaucuucucauuuacuuuauaaauuucuguugauccuacagaccucaaacugugauuuugacauaaauuucacccccaaagauggauuucucaacagugcuaaauuagcccuucccuuugcuacaaagcacuguacccagacagaacgccagaaaucuuaaagaauucauaauccaguuagggaaauggagcauaauuacauaagagauaaauaacgauuuacaaaacauuauacaguagaacauaaugaguagguaaauauuugcuuuguauucagaaaagguuucauggaacuggagcauuugccuugagccucagguaauagauuuucaaauuaaggaaaaaaacuaaaggaugagaaacacuagaaaagugcaaggcacuuucuagggcaguggguguaccagauucauugggaaagacauaauguggguaaaaaguaguggaggagguugaaaagaguuggaguaagguuuaugauggagucacacauuuucauguaccaaaccucugaaaaaaaauuuuuuuuuuuuuuuuuuugagauggaggauugcucugucgcccagacuggagugcaguagcgugaucucagcucacugcaaccuccgccucccggguucaaggaauucuccugccucagucucccgaguagcuaggauuacaggcgugugccaccacacccggcuaauuuuuguacuuuuaguagagacgggguuucaccauguuggccaggcuggucuugaacucuugaccucaugaucugcccaccuuggccucccaaaguggauuacagaugucagccaccgugccuggccccucugaauaucuuaaaagcauuuauuaucuccuuuucauuuucuuuucuccuuguucugcuuucucaugcagacuggaaauacacaggguaaacaugcauuuaaaauaccauugauaaucacauuucccucuuuuauaacauaacaaaugugauauuagguugaguaggaaaaauaaaaacaagcaugagauaaggaaaacaaagaaaaaaaauaagugaaggacaauuugaauagagaacuaaggagcaucauaucaagcggucaaauagacuuaagaaaccugaauuccucuguuuuacaacauauaugucaaacauaaaaauucaacuucuauuuacagaucuucugucuacacucaauuucguugagacuuuuuuaaagagaagguuuaauuuccaguaacaaagugaacuagcaggagaauagcagaugagauacaaguagccccugaaucaucaaacagauauaauuaucaaagaggcccauacaaccuuauguaaaaugcagcccuccauuuguacaacauggacacugauuuauuccaguccauuucuuugagagaggaagauccaauaauuugaugagcaguuucuuuaguauucagcuauaacaugcccccaaaauuuuacauaaaaugaagucaaaacaauaaaaauaaauauaaauaaaaauauguagugaagaaaagcuauuucuuguccucuuccucauguacuuacauagcauuggcugucaacucugucuuucuaaauuuaauagaaucuauuuucuaguuaucauuauucaaagugagaguuucuacaaaucagaaaucuauaugacugcucauauacaacagaaaugaaagaaaaaagcacaaaaauauaauggccuauaacaacagagaaaugaucauucuauuuuuuagaugaugaugaugaugacgauuuguugagacagggucucauucuguugcccaggcugcagugcaguggcaggaucacagcucaaugcagccuugaccuccugggcugaagcgauccuccuaccugaaauucccuaacagcugggacuacaugaaaacacuaucauaccaggguaauuuuuguauguuuuguaggaauaggguuucaccauguuguccaagcuggucucaaacuccuggacucaagugaucuuccugccucaaccucccaaacuguuggaauuacaggcaugagccacugcuccuggcccuuauuuuuuagauuauuaaauacauauaagacuagucuguaauggaauaauuaucaguaaagaacuaguggaauaaaagauaaaacaagaucucacuacacauagcccuuugcucugugacacaacuagggucuuaauucuccuuuuauuuucuucuuuuuauuuuauuuccuagagagagguuccugaugcuuguaguacuguugcauaauauuuucuuaaugaaaaagaaagguugcugugaggaugaaaguuccucagguggcugaguauucaguuauauccaaaaacaaagaugagcccuuuuucuguuugaaguguuggucuuguaaagaagucaaagguuauucacaguucagugaagaccaaaaaucaaacauaauggacuuucugcuguacacagacagagauguaugcaggaccaaaaugcucauccuugaacuuaaagaacagcauuucucugccccaagaaaccucugaaagauuaaagaaaaaugcauagagauuaagagaaugugucaaggggguaagggaaauuuccaaaaauauaacacagaaaugaagaagaaaaauccugggguaggcuggaggggugcagaugacaggagaggcaggacagaagggaaaagggggaaaaagaaaaaauaaguuaacuauaguccagagaaaugagcauuauguagaauauaauguuuuaauggguuucaacagacugaaugauaauaaugaaauauuauaaaugcuuuaauuuacuaacaggagaguuuucaauuaauuuuaaaauucucacuuacagaaauuguacuaucugcugacauuaagaaagaagucacuauaaauaaauacugccagcuuuucaauguuuugaaaagauauuuuuaaaccaaauauuuuagacaauuuuccuauauuauaucagaguauaauucauuauuuauuuaaaaaagaaugacauuucuugaauuacuuucauaaaaauuaugaaacacccuacaguaacaucagugaaauauuaucuguacacacaaacauuucgagccagaguuguuauugguuuuuauuuguaaaauagcauuuuucucauuuaauagguaaaaccgcuuauaaaaguguaagggcugguaguggauaaaauggcagaaaaauaaguuacuuaagacaccaauucugaauuaaauguuccuguucuuugcuuauaaugaaucuuuaaacaaaaauaagccaaguaacucaacaccuucuauucugaggggaaaaaagauuucaaaaguuuuuguuugaaaacauuugaacggacagacaagaguugaagugcuuuuaaggcuagaguugggggacauagacagcugagcaaaggcuugcagacaugaaaguaggugaaaucccacaugagaagcagagugauuuuaaagggaugaaauaaaaguaugaaucugggaacauaaauuagaguagauugaggaagacuuucaaugauggagcaaacauggguuuaguuuggauggcauguaggauuucauauacaaguaagaauuucauagugugaaaauuauaugaccuaccagugauuuaggaaaacugaucuaaaauagggaccuauaaggaauugauuacaguaguuuagggggacuacauuuauggcaauuguaguuagaauggaaauuauuacgauuaucugaaucuuauauggugcaaugugacugacaguguuucuugugccuuauaaauacuaguucauuaaauccacacaaccaucuaugagauaggaauaaucacuuuccccauuuuacagugaaaggaacugaggcaccggaaauucaugggacuuaggauauuuacuauauccaaaguaagagacguaauuugaacuuagguguccuaaccagaaucuucaucuuuaacuccuguauaagacugaaaauuugcagaucacauaugaaaagaauuauaggcugggcauggugacucaugccuauaaucccaguauuuugggagguggaucaccugaggucagaaguucaagaccagccugcccaacauggugaaaccccuucuaauaaaacuaauaaaacuacaagaauaagucaggcaugguggcaggcaccuguagucccagguagucagaaagcugaggcaugagaauggcuugaacccaggaggcggagguugcagugagccgggaucgcuccacugcacucuagccagggugacagagugaaacucuaucuaucuaucugucuaucuaucuauccaucuaucuaucuaucuaucuaucuaucuaucuaucuaucuaucuaucuaucaucuaucuaucuaucuaugcagaauaaacaugaugugcuaccauuaugagugagaaaauuuaguagaaaauaaagagaaaucugagauuaauuauaaaauugucaacuugagauuggaaacucuggaguaaaagccaguuuacagugauuggagggauaaggaauuucauucuuacauggauugaguuguacucaguuacucaaguggcauaaucccucucuguuuugaagcuuugauuuagagauucagacauuucagugaugugacagcccuggaauugaaauguaggaugugcuugaagauacagagaugaacacugacaugcaugaagaaacagagauuagcacucauguugacccauaaagaaaaaugcagaaaggcauggcuguguaauuaacacauuucuauuuuucaucuucaguccuugugacacacaggacaauuugcuuuccuugaguuacacacaguugaccagugucuuuucuagaaaccucuuuuuacuugagcuggccuuacuagguaucucuccuuugccuuuaaaugggcauugacuaaaacacgauccaaagcagagaaaagaaaaucucaaaggaagaaaaggccuuuuaggaaaaugcuauugaaacugaguugaaagaagauggauuugauauauuauucuauauugaaauuuccuucaacuuuuaaaagaauauaaggauaguaauauccuucuauaaugagauuauggauucccuuucaagaucagaaaaaauauuauggaagguaauuuuauacuuaauuggauugauuauucuuauacugguaauaucaguuucagcauacuuauuaaguuugaaauauuuauaaauacaguaccaaugaauaagacuuaauuaugucgaaauguuacaugagaggaagaaucagaaacacuuuuuccuuucuuccucuucuccuauaacuucuuuucuccuuugugauuaucuuauuuucaauguuauuacacauaccauuaaacuauuucuuccuuuuccugaccuagagugggguaaaaggaaaucaugguaaacugaaauucauagauuuuauaagaaucucguauaacugcucuuccaccaaaacacuucacugaaaucacaggacggacugguuugagaaucaaacacccauuuauuuauuuuguccacuuuccaauauagguguuaaugaaugguaaaaguuuucaaagacagccagauuuaaagaaggggucuguaaaaugcccaaacuagaaaaaaaaaauguuacucauauguuuaaaguguguuuaaagacaucacugccgcugauauaaaacucacauuguguauaauuuuauuugucaaaaggcuaaacauggaaaacuuuuuaaaagucugacauaauuugaagaauccuuagaauaauuuaaguuuguuaauuaaguuaaauuauuuaaaugacacaaaagagcuaauauucccauuacacucuguaaugaucuaaaguugucauguucuaggguaacuugacuucucaaggccaguggagauaaaaaauuuggaaauguacuaugacagagauaacaaaaugauacugacuauaaauagucuggagagagacagcuagauaggagugaguauuugcuacucuuuuguucuucgaauaucuguuuuccuguuuuucuucaaaauaucaucuucuguucagcaauggaugauguugaauuauuaaagaaaaucauacuguguguuacggcgccugccuguaaucccagcacuuugggaggccaacaugggagaacugcuuagagccaggguucuagaccaaccugggcaacauagagauguuaacaauuaauaauagggauauuaaaaauuaauuuuuaagaaauuagcugacaugguggugcaugccauuagucuuagcuacugaggaggcugagguaggagaaucacuuaagccuaggaguucagugcugcagugagcuaugaucaugauacuguacuccagcaugagcaacagagugagauccugucucuaaaaauaaaaaauaaaaagggaaaaucagaggguaaugucaacaaguucuacuuuuuauaagcaaaaagucuguucaaguaaacugaaaucaaaauuuaaaaacauuaauuuuuuauuguuuuccaaaauuaaaauguaacuuagaaaauacauucagacuacauccauuuuuagauuaaauauguauucguuaccuagccaacacauaauagaugagauauuaaaacaaauggaaggacugcaacaaccaaggaaacagccuaaauuuuugugauuucugaauaucuaagacuuuuucuggggcgaauaagcuaaaaguuagcuuauucaccucagaaacaaguacuaucaucuccauagaacaaguacuaucaagugaccuaaggaacagacauucaauccaucugaaagagagcuuaugauauacaaguuaacuuuucucaaaagaagacauuuaugcagccaaaagacaugaaaaaauucucaccaucacuggccaucagaaaaaugcaaaucaaaaccacaaugagauaccaucucacaccaguuagaagggcgaucauuaaaaagucaggaaacuuuuaauuaacuuuuaaaaugugaaaaaugugcaauaugugcaaaaaacuuggccaaaaaugugcaaaaaccuuuccucaaaucaugucaucagaguaaaaaugaaacaaugagagaaacauuguagagauuagagaggaaacaauuaccgggaaauuaacaguuguagcugguauuuuggaggcaauacacugaaagagaagaaacuuccuacauuccagcucugaauagauuucuauaguauuaguuuagaaacaaaagccccaaaaauauugaaaugcauuaaaugaagaaaaauacucauuucucugaauuuuacauaaacaaaauauugagaauacccuauuuuguugaagaucuuauagaucuguaagagguaucuguuuauucuauaaauuuuggcauauauaauucaacauuugucauuuuacucuaauaguuaccuguuauugcaaugacuaauugaauaugcaacagaggaagguugguaaauagaaggugauauaaaccauaguauuccuauuagacguagcuuagccauagcugaauaaggacuuaugaaggagaacuaaaugacacauauagcuaaagucacagaauuguacuuaaauaaauuguuaguuguuguucacucuauaaaugaguauucuuaguagcuuguuuugguauuaagaucugagcuuaggaaccgcuuaaaaaaauugaaaugggcagacucuucuaucugacaaaaucgcauacacauaaucauaagauuccuuucuucuaugauuguauugagauguacuuuaaaaauguuaguauucacuucaguauuccugaucauacuuaaaaaguagcuuuuaccuaagacauugaauuauuuuaaucuugagacccuuuuacaaugaggauuuguaucaaaaaauuacuuuuagcuuuaugauucuauagggcaaacuguacaugccaauagucacguggaagcugcauuuaucauuauugaagagcuagauguccugaauguuugcuuucugccaacuaaaaugcauaauucuuaguacaaaaauguuuuuaauuaaaaauaugaguauaugaguaucucaaccaaacauauuguucuaugucugucuggaauguucucuccccacauccucucugucccucuccaagcaaccaucucucagcacauaccuuguuuugcuaaggcugauguauuuuagaauucuuucugaguauuccuguccacagugaucucuuccuucuauaaacuuuaccauauauaauucaacacuugucacuuuacucucuuuguaagagguggcccacuugggacuguuagaagaaaaacguugaaauguuuagggcccauaaacuggggcaguguuuagguuaauaguaaauuauaauuacauuccccaggauuuguugucuaagauggagagaagaguaaauauuuagaacuccuaaauggacaaaagccuaaguacguguuuguugcuaaugaggcauguuguuguauuugguaauggcauauuuuuguauuugguuaggacauucgauagguuaaaggaauaaauagguaagaauucaugaguauauccuuuugggaauugcugcucuuuaucuuuuuuagaacuguacgauuuuccuacugcuacugugcuauaacaaauuuuauaaaguuagcaucuuaaaacgauaaaaauuuauuaugcuauaucucaaaucagaauuccaaauucauuucauguggcuaaaaucaaaugucuuuagggcuguauuucuucuggagguucuagaucaaauuuguuucuugucuuuuccaacuuuuaaaugcuucuucugucauccacaggccuccuccaccuccaacaucaacaaucaaaucacuccaaaaucuguucucaguguuauaccuccuucuaugauucugaugcucuuaccuuucuauuuuccuuauaaagaucccugugauuacaaugagcccucucagacaaucuggggcaaucucuccauuuugauauccuuaauuugauuauauuugcuaaauccuuuugucauguaaguuaacauauuugcagguuccagagauuagaaaguggguaucuuugggggggcuuuuucugucuaccacgugaaccuuucuucagucauuuggaacuggucuuaagcuagaacuuuuucuuuaagaaauauuucuuucuaauuuuuaaauuuauaaauacuguuauguuuucaugugaccucaagauccaaacuuauauggcuucauugauuauuaguugagaacaaguacuaucaagugaccuaaggaacagacauucaauccaccugaaagagaucuuaugauauaaaauaaaaaaaagaagcuagugaguuucaugcaaauaaaauuuucuaggaaacauucauacaauugaaaaagaaguucaagagagucugaguagcacuuacaucagcuggaaacaauauaaauuuuaaguucaaagaguguaguuaauuaaaguuccuaaauaaaacuuaaaucuuuacguaaagaagauuauacuuuuauuuccuuuuguaagacaauaaacacaguaguccccaucccaucugcaguuuuguuuuucacaguuucagucaccugcugucaaccaugguuccaaaauagaugguuacaggacaauaagauacuuugagaaaccacauucacauaccuuuuauuacaguauauuguuauaauuguuguaucuuauuaguuguaugguuaucuuuuacuguguuuaauuuauaaauuaaacuuuaucuuaggcuucuauguauaagaaaaauauaauguauguaggauucgguagcauccauagcuucaggcauccacuagaggucucagaacauauuucuggcauauaaggaaaggaccacuguauuauuccauggaacauuaauaugagauuaauaucaaaaaggauuaauauuaaauuggauaauuauauguuaaaauguucaauacuaacauucuaaauagguaaaugaaauauaaccaucagguuaggugcaaugagucaugccuguaaucccagcauuuugggaggccaaggaagguggauugcuugagcccaagaguccaagaccagccugggcaacauggcaaaacuccuuuucuacaaaaaauacaaaaauuaauuggaugugaucguacaugccuguacucccagcuacuuggaggcugaguugagagggucacaugacccuugggaggacaaggcugcacugagccaugauugcaucacagcacuccaggcugagugacagaacaagacaugucuccagaaaaaaaaaaaagaaaaaaaaaacuaaaaaaaagaaauauaaccaucaauguacaauaauucauaguuaaaauacauauauuguaaaagaugaagaugaagagaaaaaauguucuaaauuuaaucacacauauauuacucauauucuuaauuccaguauucaugaaugucaaguuuccucuuuagaaauuucaccaaguaaaaaaaaguaaggcugggcgaggugguucaugccuguaaucccagaacuuuggaagccuguggcuggagggucacuugaggccaagaguucaagaccaacuugggcaacauagcaagaaccuaucuuuauaaaaaaggaaaauaaaauagugaggugugguggcaugcaccuguagucucagauucucaggaggcugagguggaaggaucacuugaauccaggaguuugaggccacagugagcaacacugcacuucauucagccugggugauagagcaagacccuaucuuaaaaaaaaaguaaaguaaagcaaagaaaauaaaaagaaaaaaauagagugaugcacauuuaaauuuauaaauauuaucuuaagaaaguuaaguaauuuaaauucaguucauuuauuuuuaaguguaaaauuaacauaauuuaaaauuuugaauacuuugaacuucuaagggcugauagaaacauguaaaaauaaauuacaaagcaacuguuuauuucauguuccuuugaaaaaaaucaaaacaacacugcaacaagacuggcucagaaauaagagcugcaaguuuaggauggagcuucuccuuggaugugguggauagaucuucccuuucacacauaauuggaagugaggaagaguuggagaaauuuugaucccccucugggcucccugcuccucugaagaauuuuugagggaguagaacaaucuguuugccuggaggauccuugcuguuccuccaucaacguucagauuuggcauucucaggcuuggugguagcuacaccaguaaucacaccaguuuuaaagggacagagccaggaucacagcccccaggaucuuacacuugauuuaacucagugauagcaaugucauuuucaaccccuugauugauaagugcuauggaauuguucuuggucucuuagaaauuguugagcaagaggaacagaugccaaacagauucuagcugagucccugcagccuugccagugagaugucuaguuuacacuaauuugcaugaauccccaugcaaaccagaggaaaacagaggcuuccuaaaauggcuaucuacuuauuuaacuccacacuucuuuucaguccuguccccugacuaccuccccaacccugucaucaacaccaacuagcucugacuccucgggagaggucacugaauagaauagacagcauuuccuggaauuagcuugggcagagacagagucugugagacucuucuagaccaaggccaaguauaaagguaacagaaaaagcuuuaaagguccaguuaaucaguuacagguuagaaucagaaaguuaguauggcccaaagauuagcagaaugggaagguuugcaggguuuuccauuuggauagaaaucagaaaacuuaauugaauuuaaaaugaaugugcugugauacaguagcaauguuuucucuugucucuuuacaccuaucaggaaucuuacuuaucuuacuaaaauaaacacacuggagagagagagagagaggaagacaugaagagggagcagaguguggguuuccugauuuaaaagcaaaucuuucaagucucuuuguggguaucuguuucuguuuuaaaaccaaucucauacauauaauuaaucauaaaguuucuuaguguuucacauuaaaaauuagcucuugauauaugucagucacuguacuaggccuuacagccacaaaauugggagaaaaauguacaacgacaaaugcaaaagcacacaaaacaacgucaacuccaaaauaaaggcuuaaucuauaaacuuauaauuuugggaaagacaagcauacauauaugaaaaagcuguauguucuccuguuucuguuagauagguagauagauagaaagauagacagauagaugaaaggaguaucacuaugucuauguuaauucuaagaaggaaugauaacaaccauuugaaaucuugguuaaaaggcugcagacugagcagucauauguaacucuguaauaauggcuggaauaaacaagggaacuagagucacuuaccacaauaaguggagucuaaucauguccaagcuaagacaauagagcccuacucuauuaacauuuaucacucuguaaugaaacuuuguuuucaugacaagugcugauuuaccugggaguucuuugaaugcaggugcuugucauauauuaucauuuuaacucuagcacauacuauguucacauauaguauacacucaguaaaagauuuguagagaaauuaaugaauacauauauuuuagaugauacugaaucaguaaccauacaauuuaaagucuguucauauaugcaauuaaaauuauucuuuaaaauuaaauauauacaaacauacacacaaugacagaacacuaaaaaaauuauacucacaauucucuagguccauuuucacauuuacuccugaugaaauuauuugcaaaauuuaaaugaaugggaugggguguugacuacaauauacuaaacauugcucauuucauguaugucacuguaaaguggauucuguugguccuuccaaaaaagcauuucaacuucuuuuaucuuccccauuuuuaaauaauuuuucuuuucuuauuaacagugauaagacuacauacccuaagaauuucuaaggcagugacauuuaaaaaaauuauagguaauuuaaaaaaugcaauuccacuacuacccaugcccuaugauuucaaacacuccuuucaauuuauaaaauugugauggucaaauaaucaaguugaaauaugacuauuaguuucuuuauaaagcucauucugaaaaugauugccuuauugggaaugaaagcacucaucuauugucuccuagguauugacaugcuuuuuacaagagaacaaaugugauaagaaaauguaguuuuccuaaaguuacucaauuuaauuaauaaauauuaguaaaucaguuuacccaaauucacccucuuuaauuauucacauuuaauagauaaaauaucauagauuacuacuuaggcuaacaccaaacaauacuauaacaaauuacaaaaucaguuugaagauaagugcaaauauacauuguguagaaauauacuuuaaaauaaagguauuguucaucuuuuuuaucaaauuuauaagcuucuucugaauacacuguauuucagaauuuucuuagauugccaagguucagaguagucagaauccugcuacuuuacuagguuguugcaaaaguaauugguaauugguauuagguauugguauuagguugccuugguacaaaaguaaucaugguuuuugccauauggcaauuacccgacaguagguuuucccaaaguugcuggucuugcuuuugaaaagaaaagaaagaaagaaagaaaaaaaaaaaucacuuauugucuaaaauuagcuagagucuaaguacauuauuuagucucuaaauucuauaaugaugaagagcuuuuaaacccucaaaguuguauuaaauguaaacaauagaugguuuuccuuuuaauuggaacuuuuucucagaguaaagcuaagacauccaauuacacaucaccugaaagcuuaaaccaccacauaaauuauaauuccuaaaguuggaaauuaguauuuuauuuacuugcaugccacaucucauccaauuuucacugcauucaaugauuuaaaugcuguaauucuauuuuuguauaauauauuaguauucaaacccaccuuuuuacucagugcaauuuuugauagauagaugaguuagauuucugaauaauuuacuaucuucugcaaagauuugaauuaacagcuuugugcucugauuuaacugauugcuuauucgcuugcaccagccaaaaccaaggcuuaucucuauuggcaccucaguauuauacaaacaucaauaaagaaucggggaacauuuucuucuguucuggugaaagaugccauguuauuauuacuuugggcuuguuuuagucuaaucacuaaaauauccugacaucucuucuagaugcaaaccuuuacucacuuagcauggacugaguaaaaauggcuuuaaauauauuucaaagcaaaugauuuauacaaguuugagaucauauuguaaauacauaaagaaaauggcuacaaaaugaagcugaauuuagcucuguuaaaauucauuaauuuuugugugccuaaucuaaguggaagaugaauccaguaacaugccauuccugguggggaaaacaaaaucaaugcagcuuuauuuuacuguucagugggugggugucaaaacaacuuuuccuguggagagaaaaaaacgaagcuuccuuuaaaaauagcugagaucaccauugcugugacaguuuugcuuucuaccuuuucuauguagugguuuaugcuuauaaucaauagacaauaugggguauuauagaaugcaaacauuguugaggaguauauuaucccaagugcuauggaaagaaaggaaaaauaaauaaaaagaaaaaucuuuaauaagaaauauaaacuggaguucuaugugauauaauuauuuugucuuaaaggacucaaagagaguuuagcaacuaauacaagagcuaagaaauaucuuuuuauguucaucuucauguggcauaaaugauaacacauauuauaauuccucauuauauuucuacauuucagcaauauaagcucuuaagaguaagaggcuuucucuuugcuugcuuuguuuucuuguuguuguuguuaccaauuuugagguuuuaguacaugggaaacccaaaacaauggcaugaaauucuacuauaaagaggauuuuuuuuuacuguuuuguuaaauuuuugcaauacuucaaggacucucuggcuacaaaaaacucagaucacauuugaaggugaaucacuguuuuggucucauacugauuagcagguaaacuagcuuacauuuuuuccccaugauguaugaagucagcuaacauuuucccaaagggucugcuggucaaaugaguuuuaaaaaugcaaaaaauugcauagaauuucugaaaauucugaacuucuaaaauccuuacgcuuuagcgcauuaaacaguacaagaaaugcuucaggaaaugccaaaacaaagcaaaacaugcuucuuaucccauagaagugacuuugaaauguuauuugagccacucaagcaguauucaaaaaauuaucaaucaaaaucaaaaauaaaaacuaaaaguaaggguggugaacauacacagguaauacuccaaaaaugauuucaauuaauuuucuauugccaauauaguuauauuggguauauauuauauuuagcacuuugcucaguguucugaggacacaaguggaguagauguccuagaucuuaccaaagaaacaaaaugauguguccaagugcauggugaagccaaugguuuauuguuuuucuuuuugcuuuuauuucuggaggucaaaaaaauauaguuuaacaugucagagauagaucauugagaaagguagucacugaaauauuuuuacugaauuugaauaacucuaggugaauaauauaagcaaggccagagguagcaugguaggcagccccuaagaaaaccccccaacaaucacugccuguugcauuauagaaugaauaccuaguugagguguauauuauccuaagcacuauggaauaaaaacaaaaauaaaaauaaaaaccuuuaauaggaaauauaaacuagaguucuauguaauucuuuuuugucucaaaggacuuaaggugaguuuagcaacaguagagcuaacaaauaucuuuguaugcucaucuucacguggcauaaaugauaacccauauuaucauuccucauauuucuguuucaacauuaugauaagcuccaaagaguaagaggcuauuucucugcuugcuuuguuuucuuggacuuggaaucauacagcuauggguguucacaagucugugcagugccuuccacuugaguuugggcuggacuuauugauucacuucuuacaaacagaauacagcaaagagauggaguguuacuuccaagaguaguuuacugaaagacuguggauuuugucuucaugugcucuuugacuuggucucauucucuuuuauauuccuuauacuaagucagcuaccugggucugagacagccccauggaagacccacguggugaaggacugaggauugucaacaaucacuugagcgagcuuacaaguagaucuccaauuucccacaugcccugugaaaccuucagaugaaaccacuugacugcaccuucuuaaaagacuuugaaucagacuuacccagauaaguuguuucuggguuucugacccacagcaauugugauauaauaaauauuuguuguuuucagcuguaacauuugggguaauuuguuacuagcaacagaagaguaaaagagaaggaaaugaguuauguagggaaguagaaaauuauaagagguucaaucacauuauacccucaagcaaaauauucaaugacucucacuaccaguaaaauacauuccuuucucaguuuuccaucuaaggauuuacaugaucuguuccaacuugucuuccuggucucaccacuccauucccuccccugucucuuaaucacaaauuaaaccaagaaaauucuauuucuugaacauguucuaaauuucccuacuucugcaugcuuugcucauaagcuuaauuaaauuuaaacgcuaaaccccaaauuugcaaagccguauauuggaaggggacuuagaaccauauagcucuggguucauauggaucagugaguaucaguuuuuuucauccauaaaauggagauacuaguaaucauaaauugcuuugucaaaucaacaggagaaugaaugcaaagaacugugcuuggugcauuuuauaaaugauagcuucucuucucuccuccaucaauuaccugcuccaguccaaguuguaaucuauauuguguuuucaucuauguucacauagcaauuuguauaaauuguuauaauugccaaguacacacaucacaauaucauuaaugugucacuacuguaacauauacaacacaaauauaugguauauacauuauugaugugcauauaaguauauaacacauacuuacuagaggauaaccaacccaaaggauaucagcaaacugggaugaagaaaauccuggcaggcccuuaaccaaaauaguaauauacuuaugauuugagggucaaaauuugguugacuugaagugaguguuacaacuugcauaaaguaguagccuuucuauuccuagagaauucuuuugguuugauuuguuuucuuaacagaaaauguuuuugcauaaauuuauaaauuuauauugagauuuauucuguuagcaaagaaacccagaaacacuuuaaaacaccauuuuguaaauuaagucuuuuuauuguauacgaacuuuuuuuacuuuuguuuaaaagggcuaugacuucacauuuaguaaguacaugauaaacauuaguugacugaaugucuguauauacaaauacauagggaauaagcuuuaauuggagagaaauucagauaaauauuugauaacuaagauauguuauuagauaacuagauaacugagaauguuauuugagauuugaagccuauguuuuccuacagaaaggaaagaaacccuuaguuaccaaaggugaugcuaauuucuuucauuuuuucccucaaugcaucagaacaacucucaagucuaauuuaugaugaccauuuuuuuuccuguaaaaucucuggggaaucaaaguugcaacuucauagucugauucugaagaaucaauacucagugauucuagacaggagcaccaaauuauuucgcuggagccgaaccaauguucugguacauagaauugauuuuuaaccugaguccuuucagcuuaaucgauauggauuaacugcuuuaguaacuuuaucaaaagaugggcuaucugacucaaucugcuuguuuucacaaacugcuuugugauuauaaaaauuaauuuuguuuaacugaaaccagcauauauauuuuuucacuacagcuucaaaauaagaaauauuuuaugguaagauaauuuucaaauauuucaucacuacuuucuguauauuacaaugcauaacaaaagaauuuuuaagguugcauuucuuuuauaccaauuaaaaaagcagcuacuuucauguauaguggugcaccacauaacaaaguuucaguuaacaaaagacuauauauaugacagaagucccaaaagauuauaaugaagcugaaaaauuccuauagucugagugacguugcagcugcggcaacacuacaguacaaugcauuacuuauguguuugugguaaggcugguguaauaaacuuaaugccugcacauaggauuuuauaaucuguagaagagaauauauuugagagaagaaacuaaagguuguuuaauuuaaaucccauuugucccucuccuaucuuaaauuuuaauuucaacucuuauccauauuuauuccauuucuuaguuccugguaaacaggcaaaauggaaguaaaauacaagaugaguagaucucuuuucucucucaucuaugauucaagcaauaaacuuaacuuugccuuguuuuucuagaacaugcauaauauaaagcacaauuuauguuguacucaauauuuucaccuaugccuuuuuccauguuuuagaguuucucucaguuuucuuacaauuuauucuucauuuugugcuuacuuccgcuuuuuauauguucugcuauaaaagcuaagcccaacagaaagcuuuaucucuauauaacugcauuaauuuauuagauguauguuugcuuucucauuaggaaaucugugaggcuauaauaaaacuuucauuuuuuaaagcuuucagcauuugagcacagcuaucuuugucaugaacucacuuuguucagaagauuuucuuaaaaucuagggaauauauuagacucuacaaagcauuuauuuccuuggcuuuauggcaccuuagacgauacgaacaucucccaagauuccugucacuuccauuuuacaaacugacgcuuccuugacaaaauaagaucuaaaaugaagcccuuacucaacuuucugaaaagcagaguuuucaguaagguaaaaauuaucagauguucugcuuuuaacugaaugagacuucaaguagauaccuagauauaguaguuaauauuuacaguuuaauccaacuuguuccauuguaaauuuagaauuaugugcaacuauucuccauagccccuuugugaaaacugaaauaauaaggauguuagacucuccaauuuauccaacuuacuuagacuucuaacuccuuauucccuuauucugagacaguguugcucugucaccaaggcuggaguauaguggcgcaaucucagcucacugcaaccucccuccaccucccaguucaagugauucuugugucucagccucccaaguagcuaggauuacaggcaugugccaacacacugggcuaauuuucauauuuuugguagagacgggguuucgccauguugcccagaguugucucgaacucccagccucaagugauccaccccucucggccuccuaaaaugcugggauuacagacaugaaccaccgcgcccagcccccuaacuccuuauucuuaauaaacggugguaauaguugugguucacucuuggcuacugucaaucaugucuaccuaggauauauagaguuaugugcaauuuuaacaaagcaaauuggaauuuaaaacuuuguucuucaaauucuauaacuuauuuuaaaauuucauucuagaaucaugaauucuuaaugagagcuaguauuuccaugguacuuauuguuuuaauuacucuaaauacuucgugcauauuaguuuauguauucuucacagcauuccuugauuucagguaucauuauuacccuuauuuuagaaauaagaaaauugaggcacaugagguuaaguaacuuguucaagguguuacaguuaauagugguagaaguagacaccacauuugugcuuuugucuauuacaugacuauagucaaagaaauaccugcacagaaaaaguacaauagucauacaauuuuacauuugguuaguucacgugguggaugcuauaaaucuaguccccaugugcauuuaaggagcauagauuuugauuucagacuccaagugcaacuuuuuuuaaaaauaguuuuaaaauguuacucaguccuagaauaagagugagaugaacaugauagagcugcaguaugcuaaccuaggcguauucaggaucugcagaguuguaacagugaugcuucuaacuaugguggugaguggggaguggacgcugaaggaugggaaagugguggugaaagagauuuguggcauggaaauauuuuauucucagaccaggcugcucuuaacacauagacacuguaugacugcaugaauuuaucuuauguuggcagcagaagguaccgccuuuuugaauaucauugaggccaucuucucaugauuuguaagacuacuuuaaaaagaaugucuuauaguaccauguaccauuagggugucaaauuaauuuuaauugauaaacccuccuguauauugauacagauuuuugcuaucugacuaaaaugcagugagcuuaguuuggaauuaauaauauaucuaauucacaguggaaaaaagaaaaagucccuaugaacauuuaauacgaaaaaaaucauuuugaauaauuaugauuuuaauagcuauuuugaauaugcucauuuaaucauauuuacaaacaagagguaauaggaagagaaguagccgacuuuguuguaaugugagaggcaugaggccauaaugauuuuuaagggauuaguccuaaaucaaagucuguagaaggcuuugagccaucucuccuauuucuuauauuagcagaaccagggaaaguggcuacauccuggccauucuucauuauaugaacaauuuuaucauaauagacuguaauucugcaagaaacagcaauucugaaaggcuaaugcuucuuuuuaaaauaaagaaguaacuaccuaaugccucaaaguacagauugauuagauauuaaagacaggaaaggugauuuuaaguuucaugaaaaaagacauauuucugucaaguuucugagcuguaggcaagauagauauuuaaguaaugauucaaagaaaacuaccuuuuuuuguucauuauucuuguucaaaugcugauacauuacacaacucuuacaacauauacugucaucaaacacaguuugacagauggacaaauuuuaacuguucauuaccaacgucuuaaaguguggcuggugcaagcuauacaaaguaauuuauugaaauuuuucugaaaguaaaagcacuucaaaucagcacuacuuuaagacaacaucuuaaauuccaauuuaaucaauacucaugucauacucugauuguucaaaggccauguuucuaaaauaauuacaacaaugugguuguccacuaagcuuuccuuuuguuucauguuuuaauaaaugaagauauuugggggucaaucacuaaggccuuauccauuauucauauuauaaaaucaaccucaaaaaaaaaaguacacaugcagagcuacaaguuguuugacuuauuucugaaagucuuucucacuggggcaacaaacaucuuugucuuuaaugauuguuuuuaauaguuacuuuaacaauucacaaaagauuuaggauuugaauauacagccuaaaguuugagauccuuuucuauuauuauuauaaauguucaauaagaacuaaucauaaucaucaacaggucauuauguuacaauugggaaaggguauuggaucuggaagcuagggacuuuucucuaaauaaucuuauguuucuuugagcaaaucaucccacuucucuaaccccagcagacacuaaauucuaggguguuauuuuuccaaauuaauagagucacuuggcgucaucuaaaggagugguucccagauggguauagcagauuuaauauguaaacagucauaagucucugguauacuaaauugaaacuuuccuuauuucuuguuaacugggccacacuuaguuaauaucuucuuuuucucuuuccccuugucauguuucuuuaauuaccuccaguacacaauaguuucuuuugguuaaauguucaguuauauucuggauugccaccccacccguuccccuuuuccucauucucaggaguaagauaaauucuagggcauuuuauuuuuuuucuugguucagagaaagaacaugagguaaggcucccacucugcuuuucucugggcucugcugaaaugauuggugcugccucacguuccaguaugagcuuuucuccuugccucauacucuucuaaaguguuuguagcaugcacuccaugauggcuggccaucaguauccaugcuuucaguggcauucuucccaaauccagagaugccuucuucauucacuaccagcuucuacucauccaccagucccccucugaugucucucacggacuacacugcaucugauuuagccauugccaguccacuguccagaaaccauuuugguugcugaguaucucuaugaaucuuuugaucacucaggcuaccaccuuucauucugggaguccucucagguuuaaauaauuuucuuagguucugaccugcaggugauagagauacaaggauucaacccaguuuguauuagaccuucaaauucuugacucuauccugcuggucaaugauauguuuauuucauuuuaggaacaaagaugacuuguggcauuaaauguguucaccauauaguuuagggcauaaaugucauccaguucuuuagccuucugcucuugauguuaaagcuuaacuuuucuacuuccacaaagauguuccuucugaaaauuucuaagaguuuauuuuaggaaagaagaggcagccacaaaauauuuacagaaaaagguauucuuacagaggacaugcuauaauuuucaauuggauaagauccuuuuauuggcauuuuuuaaugcuauaauucugucuacuccuuauauaguugauuuagaugguuugaaaaguacugucuuuuuaguacuuuucucuugcuaucuuaugauacuuucuagauaguauuugcuaaauuucauucaguuauuucuuauuuagaauaauauauuauuuucccuauuguuucacuaugcuuuauuuauaaauuacaacaaauuuagagaauaaauucagaaaacugaaauuucauguaguuaauaccaccaaugauuuauuuggauucauguacuaaucacauugauguuuucaccaacuuuuuauugugguaaaauaaaauauacauaaaauuucccauuuuaaccacuuuuagguguacagcuuagugacauuaagcauauucacauuuuauaacagccucuuucuccagagcuuauuccuucaucuuuccaaacugaaauucucuguccauugaacacuaacuucccauuugucccacccugaacccuuggcaacuaccauuuuaccucgugucucuauaaauuugacuagucuaggugucucauauaguagaaucauacaauauuuguccuuuugucacugacuuauuucacuuagcauaauaacuguaagauucauuuauacugcaguaugaugugucagaauggucuuccuucuuaaggcucaagaauauuccauuauauuuauaccacauuuuguuuguucauuuuugugucaauuaacauuugggcuauuuacauguuuugucuauuguaaauaaugcugcuaugaacacaaguguacaaauaucuguucaagucccugcugccaauguuuauggguauauacccagaggguaguugccaucaucaauuuuugaauagugauggcuuguacucagaagaugguucugaaaaaaguaguacauaucauauauuuuccauauauauuagguuauuauaaagagauauuuuuucaguuccuuuuauauugauccuaaauuguaauguuucugcauauuuaaagauacacaacuuuguuaauaaucacaugguauagacaaaucaauauauuugcuuauaggacaagaguuuuauuauuuauuuauuuauuuauuugagauggagucucgcaaagagcuuuuuuuaauuaguguacaauaccaggauucugaaaucccugagcuuuauucccaaagguaguauuuggcugaauuucugaauccauuuaacucaucugaguaugaauuucuuaauguuuuaaauagucuaccaaacguauuuuaaagaauuacuguaacaaucacauauuuuaaaagaaaacuguagaccaccucaucaauuuagacuaaggauaaauugcacacauagugaagugaaaauucaaauaauuuuucucaauuuuaccuguguaauuuucuuuuauccuauuaggaugcuuggaaagauguccagaacaucuuuuguucuuaaaaaaaaugcugaaaauuaauguacaguaaaauauaauuugacuuaaaaagaaauaugaacauccuaugaaauguucuggagacaguacaugcaaaaccuuaguaauaugaauuugaaagcugaagaaucaauucuuaauauauguauuuauguuaucacuuaauucaucauaauacuugccauuuuuuauagcuaagaaaauuauucuaagguggaaaauccuuaaauaauaaaaccguauuaucuuacuaggagaagaagcagaacaccuaucuauugcuaguauccuugacuuagaacauccuuagaggaaaauaugcuacuucaagaauuggcucauucucugaucaaaagacugaaaguucucuacaaacauacauuaagagccuucacuucuugaauuacauguccuauuuuacuucgucaucuuuucuucccccuauucuccccccuguaguucucauuuguaccauuucucuagaucaacaucuuugacguccucuuuguuuagaaaccuuaucugcauuacuccucuggcucaugcaaguucauagauccaaccacauuuuucuaccuuuuaguagcauuucucuaccuuuuaguagcauuugucaacuuucuguucuuuugaaauuuugaaauaguugcuauuaagcaauguuguuuuuuaauguuuuggucuaaacauaauguaccuucaaauaaagaugaggaugaaagaguaacgaucauuaauuaaaccauuguagcauuuaauauuuacaagaaaaucaccguacaaggaaccauuagagauaaauggacaaauaugcuuucuauaaacauaugguuauagcauuuguuaaaaguguuuuauaacuucauaaguaguccuguuaagaaccugucuuuuggccaggcacagugacucaugccuguaaucccagcacuuugggagacugaggcgaguggaucaucucaguucaggaguucgagaccaacuuacccaacaugaugaaauccugucucuacuaaaauacaaaaaauuagcuaggcaugguggugggcaccugcaaucccagauacuuggguggcugagacaggagaauaguuugaaccccgaaggcagagguugaagugagcugagauugugccucuguacugcaaccugggugacagagcgagacuccaucuuaaaaaaaaaaaaaucugucuuuugauauuuucaucaagaaacugggucacaaaauuuauccuaagugaaagagauuuaaaaaaguaagauugcaauaaauuguuuguuuuguagauuuuaaucuuuaauaaaaauucuuuaaguucagaagauaauaaauaauaaagagaguaaaagauuauuccuguuuccacuaucuuaucacuuaagaguauucuggcuuuuuuuuuuuuuuuuuuuuuuggacagggucuuacucuguugccuaggcugaagggcaguggugcuaucauggcucauugcagccucaaucaccuggguucaagcaaucuuccugccugagccuccugaucaucuauggcuacaggcaugcaacaucaugucuagcuguuuaaaaaaaaauugcagagacggggucucucuauguugccuaagcuggucuugagcuccuggccucaaauaaucguccugccucagccucccaaauugggauuauaggcauuagccaccauuccuggccugaaauuuuuaaaaauauauacuuuuauauaauaaaugugugcaucuauaaauaaacuauauuuaaaauuuuguaucuuuuaaaauuuacagcugaagcaaaaggaguuuucuguauuuccauaauuacccuuuuacuggcaaaacaccauguaaacaaguacacaguucauaauuucuucaaauuuuccaauauuuuuggauauuuaggucauuucucagcuuuuuccuauguuucuucacauuugcuauuauagaguuaucuaaacuauauaauuuuuuccugauuuggggaauauuuucuugcaaaauagucucaaauuuuuccuuaugagauuguauuugugggcacauuuaagguugauuacacaugugauuaaaaucuuuucaauuuauacugccaugcauacuguaacaaauuuucucacagguuuucuacaaaugaguaauauauauuuuuagacaaacauaaauuuaguaaauauacuauaauuuuguaugaaaaaugggauccuuauauuucucuauaaaaauuuaauguuaaaacaaucauucauuguauuuaauauuuuguaaauuaucuaugucauuugucacauagaaacauugggauauuuugcuuuuuggaaaacaaguguaauucuggagcauggcagcaacacucuggaaguaugugaaugaaugaauugugccauauuagaagucaauuugcuugauuagugguuauucaauaaaacacuauuuucuuguaguucaauucauugaacaagaaaauacauuuuguuuuaaugacaacugcauauucuuuuuaaugcaguuacaucugugacuuuaagugaacacauuugauccaaaauacauuuauuacauuacucaaaaaaugugugcuucauuuaaguauagacauacuguguuuacuuuaacauauauuaacugaacaaaguuaaacaaaucaucaagguccauauggugcuuuaacuaaauggguuagcauauuaaauaugcuuuauagcucgucaaacaucauuuucuugacaggcaccugucagccuguuguacucuacaaaccuaccuguagaauguaagauaacuaauuuucugucauuauugcuuaacauuucuuuggcacuguugccaagaauuucuggcuauuaagguuuauucuugccuuugaaauacaaguggcccuugggagcaugaagaggcuguuuuccuucuagcuuuacauauaccuuggaaguauugccuuaugauagucucaggucagaaaaguacguaagauuuucucagggcauuuucaaguguccauaaagaagaauggagauagguuguuguucugccucugccucucuuuacccuccccucauucacauugccaugcauucaacaacugcguauuaaguggucauugcacuccagacauugugcuggguaccaaugcugcaauggggcagcauccuuugaggaguuuugaauuuaggaacuaagucauggagcuauuuaccacaaaaauaguagaauauuuaugauucuugucaucuccucacuuccacuuuugcucuggagauauuuagauugcuuugcugauaucaggucagaaucgaaaaucaaaauauaacacaagauguaaaauuauuuuuccucaaugaaaaaucuccaggacucccagauuuuaaacauuuaagugaauacauuucaacaacacaaaugauuuucucccaggcaaucauggaugaacugacucaaagcguauaauaggauuuccucaggagagcaaaccacuaaggcaacucccuaugugaugcuguaaugucaaauaauauggaagggucccagugcugugggaagcaguacauaaaacacagacagcugaacaagccuucauuuauauuagauuguaguaauaaaagaccaucaaaaugaucauucuucauugaauaacaagagauuaggggaagugagggucuuauaucaccaaagccuucaguuuuccuuuacaacguacuauccaaauuuacuguucuaugccuuaauucauaauuacaacaucucaaagccuuuuaaggcaggggacaugaccacuacagggccagacagcuuugcauuaaugcacaguauuccugcuaaugauaucaugagcaugucaaagcucaaaacuuccucuguuuuguucuuuucacugaggaaauuggcuaaaaaaugaaagucuuugcagaaagucaaagggcaagauagaagaaagcaauggaaggaucuaacuuucaugaaacaaucuuaaaaucuauuauuggaauuuugacucgugaaagaaaauguguuguauucauuuagugaauucaaaugugacucaacccacuaaugugaaaaugcagauuuaugaccuacucauccuugcuaaugacuaugucauuuacauguguuugccacauuaauagggaauaaaugaagauuuuuauaaaggagucauuugauucugcucagaugucuaaugacagaaaacaucucaaguagaaaaccauuaaauuuuuucauucuauagcaguuucuucauaaaugcauuucuuucucaauauccacuccauaucaguaaaagucaauuguuugauuauaguuaaaauucaacuuacugauauuuuaguaggcuaucugauaugguuuggcuguguccccauacaaaucucaucuuacuccuacaauuuccacguguugugggagggaccuagugauacguaugugaaucacugggccaguuuuuuuccaugcuauucuugugauagugaauaaaucucagaucugaugguuuuauaaaaggguaguuucccugcacucgcucucuucacucgucugccaccacgugagauguaccuuucaucuucuuccaccaugauuguaaggccuccucagccauguggaacuguaaguccauuaaaccucuuuuuuuuuguaaauugcccagucuuggguaugucuuuaucagcaguguaaaaaggaauaauacaguaaauugauagcagggguggggugcugcugaaaagacaccugaaaauguggaagcgacuuuggaacugggugacaggcagaaguuagaaccguuuggagggcucagaagaaggcaggaaaaugugggaguguuuggaauucccuaaagucguguugaauggcuuugaccaaaaugcugauaaugauauggacaaugaaauccaggcuaagguggucucagacagacaugaagaacuuguuggaaaauggagaaaagguggcucuuguuauguuuuaagcagacagacugauggcauuuugccccuguccuagaaauguguggaacuuugagagagaugauuuaggguaucugguggaagaaauuucuaagcagcacagcaaaagaggcgacuugggugcuauuaaaggcauucaaugucauaagggaaagagagcauaaaaguuuggaaaauucgcaaccugacaauaugauagaaaagaaaaucccauuuucugaggagaaauucaaguuggcugcagaagugugcauaaguaacuaggagccaaauguuaaucgccaagacaauggggaaaaugccuccagggcaugucagagaccuuugcagcagcuccucccaucacaggcagggagagcuaggagaaaaaaaugguuucacgggcugggcccaggaucccucugcugugugcucuagggacuuggugcccuguguccuagccacuccagcugugauuaaaagggaccaagguccagcucaagcuguggcuuguggcuuuagagggugcaagccccaagccuuggcagccuccauguggcauugagccugugggugcauagaagucaagaacugagguuugggaaccuuugccuagauuucagaggauguauggaaaugccuagaugucuaggcagaaguuuguggcaggcauaaggcucucauagagaaccucuacuagggcaguggggaagggaaaugugggguugaagcccccacacagaguccccacuggggcacugccuaguggagcugugagaagagggcuaccauucuccagaccccagaaugguagaccacugacagcuugcauaaugugccuggaaaagcugcagucacuaaacgccagccugugaaaacaccugagagggaggcuguaccaugugaagacacagagguggcagcccccaagacugugggaacccacuucuugcaucagcgugaccuggaugugagacauggagucaaaggagauaauuuuggagcuuuaaaaguugacugccucacuggauuuuggacguacauggggccucuagccccuuuguuuuggcccauuucucccauuucaaauggcucuauuuacccaaugccuguaccuccauuguaucuaggaaguaacuaauuuacuuuugauauuacaggcugauagguggaagggacuugcuuugucucagaugagauguuggacuguggacuuuugaguuaauauuauaauguguuaagacuuugggggacuguugggaaggcaugauugguuuugaaaugugaagacaugagauuugggaggggcaagggguagaaugauaugguuuggcuguguccccacccaaaucucaucuugaauuguaacucccauaauuccuaaguguuaugggagggaccuggugggagguaauuguaucaugggggcaggucuuuccugugcuaauuucaugauagugaauaagucucaugagaucugaugguuuuauaaaaggggaauuuuuagcacaaacuuucuucacuugucugccaucacaugaaaugugccuuucaccuucugccauaauugugaggccuccccagccacauggagcuguagguccauuaaaccucuuucuuuugcaaauugcccagugucaaguaugucuuuaucagcagcaugaaaacagacuaauccagcaugaaaacacuauccaagaccuaauuuugguaauauauauauauauauauauauauauauauauauauauauauguauauguauauguaaauauauguaaacugucuauguuaacuaauuuuuuuaaauuuuauucuugguuauauaacccacucagagagagaacaagucuaaaaaaguacugaaauauuggccauucucuuauuuuuuccuauuacuaacauaaguuuacuauauuccgguaaguuagaauauuuuagcucuuauuuugucauuuuauguguuaaaaaguacacaaaagaaagaugugaaaacacuaccaaaucuuguuagaaaaagucaagucauuguucaauucccaccuaugaacaucacauaccggggccuguugugggguggggggagcggggagggauagcauuuggagauauaccuaauguuaaaugaugaguuagugggugcagcacaccaacauggcacauguauacauauguaacuaaucugcacguugugcacauguacccuaaaacuuaaaguauaauaaaaaaaaaaaagaaaaaagaaaaagucaagucaaaugcaaauccaaaauaucaucaauaauuugacucuggguuugaacuuucaacauuccucuaucccugaguuaccccugaguuacauacaguagcuagaucucaaauauuaacauuuauuuuuaauauucaagggaauuauugaugguaauucaugugaagcuaaauaaucuauuuguauacauuuaccuaaagaaauguguaacacagaaauauuaaugauuaccuaaauucaauccauuaugacauuugcauauuucauuuaacauauuaacauauuaaauaagagaauccugcaaacuauagcaauauuagcaaauucuguaauguauuauuugaaagauguauugguaaauaaaaaacacccauucuuccuaauauagccauaaguauauuucaagauuuaauauucuauauacuauauauggaaguaggggaaugcugaucuacuggaauuucgcuauaauuagaaaccauaauuguuaauauacagcauaauaaauagcaacuuggaguguugcuauggcaucaacugguaaaagugcuaaugugauacaagugcaaacucuuagaaauaauaauaccaacacagcaucccaguuuaauuuauuggaaaaauaaaacuaauuuuuuaaaaaauuguucacuaaaguauaaauaccuuaauauuaaaaauaauaauguagaacauagcuaaaugaaauaccuucaaagauuaacauaaaaaauaaccgauuguaaauacaaaauacauauaccaauuagcaauaugaauaacucauuuuuuuagcauauuuaaaagaaaggaauuuuguaaaauacaauuuacucagagaaacucuuauauacuuuaugaauuaauuuuucguguugaucagauuaguaugguagacuaaauucuaauacggccgucaugaucacucuccucucaauguuacuucuauaacuauguuaccuuauaagaaaagaguauuugcagauggacuaugaaucaguugaacuuaagauaaagacaucaucuggauugacuuaacaaaaccacaugaacucuuuauuucauuuuuauuuuuucaaagacaggguuucucucuguuacccaaacuggaaugcaguggcaggaucauagcucacugcagccucaaccuucuggguucaagugauccuccugccuaagcuuccugaguagcugagacuacaggugucugccaccaggccuggcuaauuuuuguauuuuuuguaaagacagaguuuuacuauguugcccaggcuguucucaaacuccugggcucaagugauccuccugucuugacuucccaaagugcuuggauuacaggcgugagucaccccaucaggccuacaugaacucuuuaaaagcauaguuuucuccagcugguagcagaauacagauguuugaagugugagaaggauuugaggaaacaguuacucuauugcagaaauggaugggaccacaaggcaaagccugagaguggccuuuagaagcagacaguagcucuugguugacaaccaacaaaaacuggggacuucaguucuacuuucacaaagaaauggauucugcuaauauccuaaaguaaauauuuucuuagucaagcccccaggucggacugcagugagaugagauguugauuucagccuaugaaacucuggggagaggacccaguuaaaacacauucaacuaauaaguaggucugcuuagcaggcuuacuuuaauaagcaguaaggaaugaauugccauuagcaugucucuaaagggucugaauacauacuucauuuuaaaauuuuacuuuuggaauaauuuguaccuaugcaaucaaccccaaauagcauuuuuuaaaaaaauaguacaaaguauaaguuacauuaacuuagaaauaaauacuuuaauagugggauuaccacuaaauaguauucugauuuuuuaaccuccagggaaaauuaaaauuuauagauaagauuuauaaauaauaaauaaccgguccuauaagguuuauucuuuauccuuaauacuuuagauuaauaauuaaaaaaaaaacacugaaucugaaugcuaguuuuuucaucaugguuauuuaaguugcaagcaauuuauuauuaauaguaauauaaguuuauuauggaaguuuacaaauuauuguguuugggugugagaguaaauauuauguccauaauaagguuacucuuauuuacuuacagucuguaugcuuucugucuucucaaaugaauaucauauugaaaaccuagagguaaccuuggaaugugagucuagaagaacaaaagauaucaaggguguaucaaggaaauaaagaguaauaaaacauuggcuucaaacauacgaaagccauucucucaauaaggauagcacagaaguacaguagcccagggauuucaaguguagucgucaccaggacauggcacaaaagcuaagagagggccuggcaaaaguugagagcauuccucuuacguuugcuuuuaguuuaucugauagaagaaaaauuacauacauagcacauuggaaaauauaccugauggagccacugcuuauaacucaagcugcuaaaugaauuauaagacuuugguuaucuuuaaaugcacccacaaacuauaaauaaucaaaauaagauucaaguuuuuaauuauuucauuuaucuaaaaauuguuuauuuaguacuuacuauuuucuucucuuuuagcaauuacaaauaaaauauuaaauaacauacacaaaaaguuuuguccauaucaguugcacauugaaguggcuggaaaucuaucaaaacaauaaacacuugauaauugguauggcaucaagaaaagaacaguuuuuuuuccuaucaaaggcaaauuuuaauaaaaguaaugauguucauuuaaaacuaauaaaacaaguaauauaaacuguaugucaaacauauaaaaauauuagagcaauuuaaauuaaaauuaauuuacuuucaaauuuuagauaaucaaauuuguauuuuuccaaacugcaguuggaaaaagacaaccuguuacauauacugaaaauucuauuagaauaauaguacuuuuuggagaccuuaaauuuugcucagauguuugagaauaggcaucaagaaaucuaauagauacaucuguagucuugauccaacucugaaucugagaaaggaaauauauuugaccuuuguaacguuagaucagguucacucuaaccugauucguuaucacucuacagucagacaaaauggcaucuugcuaagcuuaugucuuaaggaaaagacuuaauacaauuuccauaaaauuuaacucuuauauuuugccacuuccccucuaauucagaagcaaauauauggagaaugaucaaauuacauauauauauauauauauauuuuuuuuuuuuuuuuuucucuacacuauuuugaggaaccucacaauggcaaauuucaguaaggacauuacuugccagacacaaacguuccuaguuuuucucuuaacucuccacuuuguagaucauuugaaaaauugcaacaaacugcgaauagcguaucauuacacuguaauuuugagacaagaacuuuuuauaugcagcugauuuaucuuaaucaucuucguaucaccaguauaaagcacaguggcaggcagaauguuguuauuaaauauuuacuuaacaaauagaugacuuuuucaaccuacuuauuuaauaauuacuauuaaauuuuagugaaugucuucuaugagucaaguauugguuuacacauauuuucuaacuuauucauugauaaguugggcauugcuuaaucuguaugugagagaaaauucaaaagaauguuaauaagauaauuuguuuuuucucuagcuuauaagaaacguaaaaguggacacuccagggcugguauaauggcccaugauguacaggacucaggcuccuucuauuuugcugauccaccaacucucagccugugaguucuauuuccuggcccaagaagcaccaaacaucacauucuauccuggagggcacaauucagauacacaaaauauuucccccuuuauuuauuuauuuagagacggaguuucacucuuguugccgaggcuagacugcaauggugugaucucagcucacugcaaccuccgccgccuggauacuccugugucagccuaccaaguagcugcgauuacaggcaugcaccaccaugccuggcuaauuuuuugcguuuaguagaaacgggauuucaccauguuagucuggcugguccucuuaaaagacauucgcuacaaacaugucugagaaaaguagggauuauuccaaguauucaacugaaaaucagaaauuuuauuacuaaauaaaaaugaagaaccaauaccaauauggugauaaucugucacauuuccaaaaaaauuagacacaauuuuuauugcagaugagauaaauaagugacagagagguuaaguguuuuucccagguccacaauaaugugugggagcuaagauacaaacccaugcugcccaauuccagagcggugcuaccaaaaccuuaacucaugaaccaguacuggucuguaaauacaguauuaccaucccccaggaaauaacgacagaaauugaagcaguugcauugcugugacacugagguacaugauuuuuuauuuuuagaaagcauuagucugugacugauugaugggagaaacuugaauugguuuggaguuugcaagguaauaacuauucugacuugcuggauauuuuuaauucuccaccuuuggaauuauucuuuccuuuaaaauuuaaguaaaacugccuucauucccuucgcuuaaacugugggaaguccagugcuucccuggacuauguggacuccuagaauacuacauuuucaugggcaccuuucuucccaauuccauuaucucuuaacuuuccucuguuuuacuuccauagccuucucugucucucaccauugccaaaaccaagaucacaucuaccuaccuuccuccauugguucucauucccucauucauucucucuaggaauucccuuggaacuccaaauuaaguuuguucguugguuuuuuaauucugcagaauaauucugauuuuucuuucucucacagaauucaucacucuauucuuccaagaaacccaucagggaccaucaaauguuuucuguuacaacacagucgaacuuccuucaaacacagaaccaucugagaaaaguuuucuugcuguuauuuucuuguuuaaaaugguauuuuauuuuugucucuuuccuugcaauguuauuuucgcacaauauuuuaggcacucuacaacauacgccauagcauagcucaaaagcuacaucucauaccaggcuuccucucaaaugccucuuucauucuuuuauagaacuguauaaaauaaaucuuuccacguuaacauugcauuagcauucuuuagauauuuuucugucucucccacuagaauaucaacucucuagaggagugaauuauuucauauuugucuuugucauccaagcauuuaucaaggugucuugcauaaugaggcauuuaauauauuuguauuugaacugcuugaagagaaucuauuaugccaacuuuagaauuuauuuucagaucuuuaugucaaaauuuugcuauccauuuauaggucugaaugugucaagaguguuuucagaaucuauauauuucuaccaaagaaaugugcccaccguuuggauacagcauuugugcuuggcucuauagucaaaaagccagaccucccauauauguaaaucaauaauuucaaauuucagaagacucagauucuuuuuauaauguacuuuuuauuuuccuuuuacuauuugagauucagcuuauagacauguaacuuagcugauuuuuuaaaaaaucaauauaacucccuaucuaacauuuacagaagaauuaagaggaaaguaauucuagcguaaguauuuagauuuuuaauucuguguaaaauuaagugguccuauguuuguaaauguauaaucaccaugaaugugauggcuauaaaaaugauauaguaugucgaauuggugacuaaaaaugaugacuggaauuaguaauauaguucuuuaaaaugguacaacacuguuggcaaacuuucagacaaaauaaagcaucauuuuauuucacuuuagacaguaguuguaauuauagagaauuuaaucugaauuuaaucuguauuuaaaccacaccaaauguaugcuggguuuauauuuacauguaagauagaauuugggucuagguucugauaaucaaacagguuuuccuauugagcucugaaacaggaauuuuuccuggaggcagaacaauucuuuauuuugcauguauucuacuaucucugcccacuaaacacuaauagcacccuccacauugugauaaccaaaauuuaccccacauauaaccaaaacaccccuagaggacagcaucauucccauggauaaccacuauuugagugguuauccacaucuguagauaauauaugugugacucauacauuuggauauggauauccauauggauuucauauagauuaguacaaacuuuacuugaugauaccucuccauacacaugacauuuauuaaaauaacaaacaucaguauuuauuaaucacugcuuaaauaaaaaacuuuaaaaauaggugagcuuuucuaguaucauuaaaccguugacaaucuuuuuuuagaauaacccugauauuuacaacuauagccaauaagaaaucucaucuugaacuguaacaucuuuccacaucuucaagugcauacguagcuuugacucuugacuguagaauuucagaggccuaugaguuuauuauugucuuaaaacguaugaugcucccccguuuuucuuagguuuuggucuggaaucacauguucagaacccaucaagaccuugauguuuuuaaaacugcgccuuuacuucaggcugcaagccagcaggcugaugaggugucuagaccaucauaccucauuugucacuaacguuucacucuaauaaugagaaugcuggaguucagggaccuggagucacauuuuugauagacuuccugaacaacuaauugaacugcccaaauccaagguccuagccauauagauuuucauuaucuguaccucugcugggaaggugauacagcaggacaaagaccauccaauaagauacuauaauaaguuacugacagcauucuaauacauacaauagaaaaaccaacuuugaggcaaccucuuccagacugcuucugcuggguagaaauaagcugauugaaaauguaauagcugaaggcaguugcaagaaagaggcauuaugaaauaggcaaauuaaauuccccugagcaaccagaguguagguaggacaauaaaaguggcauugacuuuuccuaguccaguccgguuuucuuuuuauuucuaacauucaacaagcuucuacagaguacaauucugauacuuuaaacuucaaaaggaagccaacaaacacuaguuaagggaguaugccccagagugucaaaagguaacuuuuucugccugaauauguuucuucagugcaggucuccuuuguccacucauauuucuuaagcacuuucaacaaugccuggcguguaguauguucucaauaaauaaaugucgaaagaauaauuacaugaauguucuuuauuguaagucuggugauaugcaaguauugauaaaaaugaauagaauaagugucagaaauagauuauauuagcugcuucuuuucaagauuauuugauggauuuuuuucuuuugguuuagaauaauaaauucagagcaauauuaaauauaaaaaguuaauguuauuagaaaauacucuuauuacagguauauucucuuaucuuucauauaacugcauaggccuugcuguuuuccugaagaacuuaaaauguuauuacugucugguaacauucauccaaaguaaagaaaaaagaggaaauauuaaagacuauccccuauguccaagguacuuugcacuuauuaccuugaaaugcuuacaaaaacuggauagcauuuuauagaauaauuaagauauagaaauaggugacacuuagaauuuauauacaagugaaucuaauagccacuugucauuucugcucuuaucacguuaccaaugcaguugaagagguggggagaaagaaggcagggagaaaagagggaaggggagggccccagagagggagggagggagggaggggcagagagggagagagggagggagagagagagagagagagagaaagagagagagagagagagagauugauugauugauuggggagaaaagaaaucuuccaguguggacugugcugugcccaagcaauucuacacguaaagaaaggucuccaucaucuauacaaucacuguuauccauucuaugauaauuuuaaagacaaauauuuaaaaaauguuuccuuucaucuaucuguuauguaaaauaauggauagacuugaguaugcagucaauggagauaugugguucccuugccuuuuuucaugcaacauguacagaaaauguguucucauuuuaacaaaacaaaaugacaaaugauuaaugugggguaauaacucaaaacaacccauaacaacuagggaaguaaugaauuaaaucucucaauaccaaauucuuccuuaaauucaucuaucucagaucauacaagucauauaauucuauuauuaucauuuugagauggagucuugcucugucgcccaggcuggagugcaguggcgcgaucucggcucacugcaagcuccgccucccggauucaugccauucuccugccucaaccuccugaguagcugggacuacaggcgcccgccgcgacgcccagcuaauuuuuuguauuuuuuaaguagagacgggguuuuaccguguuagccaggauggugucgaucuccugaccucgugaucuauccgccuuggccuccaaaagugcugggauucacaggcgugagcaacugcgcccggccaauucucuuauuuuuaauucugcaaacaucuacgaaguauuuaaugagaguugggcucucaauuuucaggcauugaauggugaauggucagaguaucauugucuuuuauuuuuguuuccauuucucuaccaauagauauauacaaaaguaaaagugcuagaagcccaguuugaguaaauuauuuguuugaugcaauuagaagaauguaaccaguuaauauauucuguagaaauagcucucaauuauuguuauuuaauaccaauagcuaucaauuaauggaaugcaucaugugcuaggcaauauacaaaguaauuuacauacauuaauuuuacaggagucucaugauuuuauauauauauauauauauauauauauaauguuuuuccucauuuuauuaaugaagagucuuagagacuuggaaauauacacaggaucacacagcuaauaaaugcagaagugcuauuuuaaagagguucacugucuccaaagcccauucucuucuaggaggucacaaggacauuaaaaaaguucuuuaaaggcaguuccuucaucauaaacugaaccuucucuaaagcccuaauaguucauauaucuuagguuucuuuaaagucaguauuuuuaaauaauaacuauuuuauguucuuucccuuugaacucuuuccaauuuccaaaaccuugcuuucaacagugguccuaaaucugggccuugauuugcaggggcaggcuccaugucauugucacaggcacuguuaagcacaaaauagauauaugucuuucucguauucagauuacauuuauuuauuaccauguuuuucuucuauguaucauuugucauugaacuuucauauauaaaauaguuauuuccaccuugauuguucuacaaggcagucuuccuugcuaagcuuaauucuauucauauaugguaauuuuuucaaacuggugaaugcacagccauggcaauucaaacagagaccaaauaguuggggacuacuuaagcaagcuuaaugguuguaggucaguugaaaaaccauccaccugagagugcuaaagaacugggagaugaacuuucacagccauuacuauuuuauagauaagcacuuaugggagaguacuugaauuuuagaugacuagaaaagacuccuucuuaccaauuuguagaaggcacauaaaaaaguacuugggaauuacaagcuagugaccuaccuauaauacccaaaaagguauuauggugauacauuaaaaaaauaaauucacaguauacugugaauauuauuguauaccauuauacaauaauauuaauauauaauaaugcuaaacuauauaauaguauaguauacuaugaauaaauaggaggcugaaauuaaaauuaagggauuugguuuaggcagugggguucauaagaaaagggcaauagaaagggcuaggguuggagcaauaguguaaaggguaacaguagaugaugaggguuuuagggucucuuuagugaaaaguuuuauugcaucagcaaaugguugaaauaguccauaggggccuaaaauauuggauccuuugcauaguuguauguagccuagaauuuuucauucaaugaguguagggaauguuacggcagccagaguagauauaaguaguaggagguugauuauaggcauguuguuaagaagauucauugaaccucugauuauaaaguuuuacauuuuaugcaauuaccgggcuucugccaccuuaacaaacccuacuuuuggguaagauaugaggugauuuguuagcuuaagauaauaucaucuauagggcgagggcgcuuuaugaagugggcccuguuucucucguccuuucauacugggagaaaaauaaaauagauagaaacugaccuggauugcuccggucugaacucagaucauguaggacuuuaaucauugaacaaacaaacccuugauagcagcuacaccauuaggauguccugauccaacaucgagguuguaaacccuauugucaauauggacucuagaauaggauugcgcuguuauccuaggguaacuuauucuguugaucaaauuauugggucaguauauguauaauaauuugcuuaaacugguuuagucuuagcauagguugcucagagguuagauuaugccccgaggucgcccuaaccaaaaauuuuaaugcaggguuuccauguagauuaacaauauugcaguguuaccuaggaggaaacauggaauugucagaaaucauaugccaaaagucuaauuuuugauuugauagugcuauauaauugaggcaagaaaauauguccuggcuuuauuaaagagggcuuuuuuuauucuuuauaugguauuuccuaauauauuuauugacaaacuuguuucauuugucgguggaaauguuaacaucacacaucguagauagaacacuuuuaaaacaaauaaaaguucuuccuuaucaucguggcuaaacauuugaauuauucaacugcuuugaguuaccuagauuuuccuguggucuauaauucauuucuaaccauugccaauacaaacacaauauuggagagcuuaacacuaugaguacuuugucucauuuuaaaauuuuuauuauauuagcaucauuuugcuuaaacaugucacuuguauacacaauacaaguuaacauauuugcagugauuaaaauugaaaacuuuggagugaaagugcuuggauaaucauaccaaggguuaguagaguucuaggaacgauuuaagggcuaaaaaauauuagguuuuuauuaugcauuagacacaaagcuaaaaaguacuacgaauuaucucauuuaauucucacaacaacccuaugagauuaucuucauuucauagaugagaaagucuacgauaaggaagguuaauucaccuccccaagguuaaaucugguaaauguuaaagcauuuacacacaguaagguugcucacuacugauuuuauuuuguucaacccuucuaucuguaauguaugugucuuuuuuuuuuuuuuuuugagauggagucucgcucugucgcccaggcuggagugcaguggcacagucucugcucacugcaagcuccaccucccggguucacgccauucuccugccucucagccucccgcguagcugggacuacaggcgccugccaccucgcccggcuaauuuuuuguauuuguagcagagacgggguuucacuguguuaacaaggauggucuccaucuccugaccucgugauucacccaccucggucucccaaagugcugggauuacaggcgugagccaccgcgcccagccugaaauguauguuuuuguuaacuauacuaugaaauucaaaugaugccucauccgcauccauaaaauauuccuuaaacccgugucuucccuggucuagacuuccauauuuguaccuaguaggugcuuacucauuuugaguaaauuaaugaauaagugaacaaguggaaauaaauuaacggaaaaacuaagggaaaggagaauuagguuuuaaaaugccuacuaugcacauuucccccuaugauuuaggcaaucuucucaagacaaaucucuuguguccauuguaccccuaggauagucuuagaauauaugagauauuuuaggugucugguaguagaaguuucagcaugguuaaagaugagaauugugagcaaucaaugauaccaauguuucucaaccuaugaccuagccaaaugacaaggagagaccuaugaaugcauacauuggguugcuucaauauaucguuaucaaaggagaguguauaaaaauugugagaaaauaacagaccagaauauuuccugagacagaccacuuucccaagacuugucuguugagaggaaaacuccuaacccagcugaguuucgauuuguggaugcuucaaguauuuuuuuccauguauuauuuuuuacacuaaaagaccugauagucaccaaaaaccucagguccuggcuuauuaccaacagaaaacuuguugaaaaauuaaguaauuuugcuuuaucuuaaaguacacauuaaagacaucuauauuuuaauagauacauuuacauuguguuugauuauauuuacaaguauacuuaacaaaaucauguguguauucauauaacacagauuuuuguaaaucagaucuaaaagggcuuuuauuaauccaaaaauaacagaauuuuauaaaucugagaagauaauauggcaauauaauaaugagggucuuccaggacuuacagaagaaagagaacacugaagacagaagucauugucuuauaaaacauauauaaagaugaguagagguuucuuagccaugcaugcuucuacagauaaaauagauaaaaauugugcuugauuuugugcucauguuauucagcuauacaacagcaacgaaaauuauuuucaaaacaagagaaguuuacuaaugaaagcaucuaacucuauaguaaaaaauuguggucagugauaaagccucccuuugagaaauaucugccauuuaaugaucauuacucuguccuauuuuucaaauguaccucauuuaaucacaucugagcaguagagacuuagagagguuacaacaggcaugccaaacaucauucagcuauuuaaauggcagaugcaagacuaauaggccuaucuguccucaaaauugagcuuuuaacugcccuuuugcacucacuagggaaauguacuggaauauuuaaaauuaauaucauuauagcauuaucaguuuauuuccuuucccagugagaaaugaauccaacuggccagucugauccagcaacucacccaacauccuucaagcuaaauaacuuagagcaaagaauacacagaaauugguuucaacaguuuggcaguauuaauguagcugauaacuauuuuuuagauagaacauuuuggaaugucuaauaaccaugaaauuacuguuuuuuuucuuauuuauaaagugcuuugaggcuauaauaaaacaguaauagaaaagaaaaauagugaauuucaguugugcaaaauaagaaaacaacugguugagaagaaaaaaauaucaggguccgaaugaaccacaaaauauguguugucaguacugaaugagcaauuuuaugauauuaaguuuuucuauauucuguacguaguuuuuguuaaugcaauuuugcgucgggacaauauucacuuuuugucuuuuaauagauacacauggcuuaugaugaauauaagaaacacuucucuuuuuaaucauauuuuagcaauuucuacauuuucacuugccacuucagagacauuuuaaaauaggcaauugucuuauuuuuaaaauaauauauuuaugaauuauuucaaagaagcuucuuuguauuucuacuuuuccauucuuuuuuuuuuaaaggcaagaucagcuucuauaucagaaauacuaaaauaagauggacauuucuaaaaguauaaaaauuagauuagaaauccauaaagagcauauauuauauacaguuaagucauaauaugacccuccagcuauauuauaauccaguaguuuauuuacuauuuuuauuaauuuuuuucuuauuuucuaguggguuauuaauagugacaugucagugacugaaacagguaacaucauuacccccauuuuagguagggcagacagaaagagagagagauuauaaacacuuuuacaacaaauaaguuuuccauucagaucaagagagcugcuuuaguggacuuuacuucuuuaccauuucugugaaaaugauaauaugugauuaugaacagaaccuaaaccauugcugaaaucagaacauuaauuucauuuauuauggcacucguuacucugcuugucacauaugccaagccaaggaucuuaggcagcauuuagacagaaagacaaccaaacuaagcaaagucacacaguuguuaucucugucgugcacaauagcuccaacuucaggaagcugagguuuguuacuaugcauuucuuuacacaguaacuuuuuucagaaugaguugauguauuuaauugauguuguacaacuccuuaucaaaaauuaaaauggcaaacaacaaaaaaagacucaacuaccuaccucuguuuuaauuuuuccaauauuuuuucaccuuagacuucucucaugcuaucucaguuuauauuuuaauuucuuccugauacacuccauugaugguuuuguuucaaauggugcaaccugaccucaucauccuucaacccaaccugucucugacuucucuauaucaauuaagagugugcuguuucccagauaccuauacucacaauucgcauuauuuuacuuagucuuuuuuucuauuuuuuugccuuuccaaauuguaagacuauccuuaccuauggcuauuuguauugacuuuucugucaaaaaagcucacauauaucccuuuaucucacgggcacuaccacaacauaggcugauauuacuacaaaagacucccaguuaguauuuggacccuguugcuuuggucaugccaguuaucucuucuuaauuuucccuggccccuaaaggguaaaauucaaacuacauaguuugcugugcagagucuuuugcaauuaagaaucaaaaccaauucuuguuauaacccuacucaauuuucuacucaaacccuuagcuugaauaaauguguuagguguuuaguguuaaccccuuguacuuuuguacauuggacuuuugcuuguaugaagguaucaucaggaacagccuccgcuucauuuccucuguuauguaagggguuuugcaaacuccaccuacuccaaaaagccuuccauggucauuaagacaacaagacauuuacucuuagccaagauauaagcagccaggaucagaaacaggaaaaguaaaguucaguggaagacaaagcugaaaauaaacuggcaaggaggauauauguguuauaaacaaauauuuaaaagcuugcucauuuaaggcucaugccacuguaagcguucaaauguaggaagugcacacaaacacuaaaauucauuucacaagggucauugagagaaagguacaaggcuuuagagaaaaugaauauuccaugugcugcugaaucagcuauaugaaauuccuuguucauguuuagaaguguggagucuauuagaagaaugucaaauaaaaucaaagauuuuuuauuguuguacccugcugcaagguaacaagaggcucagcuucacaguaguagaauauccuaucaucuauuaugacacacacauuaaugucucuuucaauuacaggucuaaacucuuacuuaauuuuggaaauauuuuuucacucuuaaaucauaccccucucuacagccuuucuaaucuaaagugucauugcaaauggguagauuagauuuauuguaauuaguguucugcgguuguucacagcaauauggauauacgauucuggcucaaauuugggugacuuuagcaugaauauaguuugguugggauaaaagauuuuugucuuucuucaaaaacucaggcaacuauauauuuacuaagucaauuauauguaauuacaguaaauuaucugggaguuaacaaauaaaaggaaaauuaacuccugucaaaauuaaaauagaaauauuugggagcaagauuugaugaaaauuuauguauacagcauuaagccuauuuaagcaaugauauauauucgcguuuuacccuucaacauauuaacaugugaauaucugauuuaugcuuauuuaaaauagucugaacagauuagaaagcacaaauaaugcucugugucuuauuauuccccauauuaugcuccaaggcucugaaauaaguugaaacuagggcaguaucugguguccuuaucuuagacuguaaugggguuuauaucaagagaagaaaaggaaaauugauuucuuuaaaagacggaaagaaauccacuuuaaaaucuauguuaaauuuuauguacuuuuuccugaacauauacuauaaauuaacuaacaagucuuagaacuaauaacaaaaacaguauuauuuagugaagcauauguauuucauuuaggcuaggaccugccccaucaugucugaauuuuuaucugugcaagauauagauuucaaauaaaaaauaaauuguuuaauauaucguacacuaaaucaucugaaaaguaaggcuuaucaaacuuacaggguaugauuucagauuuuuuugauucguauuuuuuuaauucacgaacuauuugagacaucuguccuucuggguaaauggcaggauaauagcaagccaguuccccuaauguaauauuuuacgugaaagaaaaguaagcuaguggcacuggucauuuccaaugaacauaggaaaagaggagauuacaaaacaaaaaguaauagauacaguauagacaauggcaguaugcuauccaaaucuaagauauuagcauuuguuccucagaugcuacuuuaucuuuuauuuuuuuuucacauuaucacacacuaaaucucccauaacuaguucauugaguuaaguuaaauuuuggaacucuuuacaguuguucugguaaauuugcaagcauuguaaaaauuauucagauaaaauaugaauuucuuucauuuucauucugguaaggaaugaauaguuuucuuacgguuuacgguaucauuguauuccuuuuguuguguuucuauuuuacugcaauaagaaagaauaagaagaauaaaaagaggagauauaaaaaaaacuaaaauuaaaugaguucucuaaaucuuauuuuuaaauuuuaaaauuuaaaauaucuggccaggcacgguggcuuacaccuguaauccaagcacuuugggaggcugaggcaggugugucgcuuaagcccaggaguucgagaccagacggggcaauauagugaaacccugucucuacaaaaauauaaaaauuagcuaggugugguagugugcaccuguauucccagcuacuaggaaggcuaaggugggaggaucacuugaguccgggaaguagggguugcagugagccgagauugcaccacugcacuccagccugggugacagagugagacuccaucccaaaaaacaaaacaaaaugaaaucugauaaaaugacuagaaugcagaguaucaaagcauuuagucagcuauauuaagcauuaggucugauuauuugguaaauuauaaacauuaggugauuuacugaauguuugacagacgugagagacuuugcuggaaauuccagcaucacugaaauacaucugaggaaccucacuucugaauuaagaaaguagccaauuaaaauaagauaugcacaaguuucacauauuuugguaacuauuugaauuuaugaacaggacuguaccaguuccaaagcaagaugucaacuugugcuuauguuuacauuuaugagaaaaagucagauuaauaagacauacacagagcaaaauugaaaauaaugaaacuaauuaucaaaccacccuucaaaaaauuuacaaaaguaauacuccacuuauaaucugaauauaugugaucucaacagaaaugaaaauuauaggguugaggacacagacuggagaggcagcccaccaggguccagucucaguucugcuaauuguuuagcccuguagcgcugaacacagauggaaggacaaaacuuuagucuuccagauaguucugguggauguggcucuagguggcuuucucccaucuuccuuuuggagcuugguagggagcaggcucaggagaccucaauuagcucccuggaagagcugcaguguuccuuuaccuucuuuccuaauuuccucuugucaugucccuuuucuaacaaggccauuuucacaagcacaaggauuccaaccaggugcuuccugcuccuuucccaauccgauaauaaaugcaaaguggccuuucuucuucagucuagcuuuguccagcuuagcauuuuacacuuuucgaguuuuaagauagcacauuuguauguugcuguuuuguaugcuuguauucuuucauccccuucacuaucuccuccccacacaaauccucaaucugucaaaaggauaguccacaucugcugcuucaaaggccuuaccucucccuuauuucuuaaccccuaaauucugguuauuaucacaacucucuguuaaaaaaauauuuucacacagguuagcaauguccuuauaacguguaauaucauauauuuucuuaucuucucauacauuuuaaucuauccuauauaacugcuuuacuuaacagaguauuuuaacauaguaagcauuuaauaacuauaauuuaaguuccaugaaauugauuugaaaaauauguuaagcaccauuuucucucuucuugugagucuguuaggguccagcagggcccggcuauaaauccugaguuuuagauguaauuccacucaauuuguaacuucagucccuaaaugucugugagucucaguauucucuaacuuaagaugggaauauagucauuuccuguucaucucacaguacuguguuaaagauuaaaugagugaaugguaaaauuugugacaaacugcaaagcaguaacaaguuauuacgugagaaaauauuuuuguucaaacauuauuuuuaguauguaaaccauuucccaacaaaguggaaaacuggaaaaacagaugcaaaacugcacaaaugaaauguauauauagagugcaugagaauauuuaugucuacaggauuuuuaauuuagaaaucacuacaguucuaagauucgggguaacaguuaagaaauuuuauaaauuuuauuuucaaguugauuuauaaaaucaagaacgacagaaauauaaaucaggaaaggucacuggaugaaauucucuacauucacauuugagauuacuagaacguuguuuccauuuugaagucuauuaaaaauuauauaagcauaaagggggaaagauuuaaauuuagaaaaagaaggaacugcauuacuauagauuuuuaaauauaauauauuguauauauuucuacaccacauucugcauuucuuucuuuucuuuucuuuuuuuuuuuuugagacaguuucgcucuaucgcccaggcuggaauacaauggcaugaucucagcucacugccaccucugcccccaggacucaagauauucucuugccccagccucccgaguagcuaggauuacaggcaugcaccaccaugccuggcuaauuuuuguauuuuuaguagagaugggguuucgccauguuggccaggcuggucuggaacuccugaccucaagugauucacccaccucugccucccaaagugcugggauuacaggugugagccacugugucuggcaacauucugcauuucuauaugcuuggccacacagucuaguucuaaaauaccaaaauuccaucuuccaauuucucucaccacuuuaccccaaauauacuguaaacauuacaauaucaaagcauucccaauacugguuuaaaacuguaguaacauauuaaaaaaucuaaguuacuauauuuugacuaaggcuuuaaaaaagcauggaaaaagcuauauuauuaaguauacuuagauggaucuuaaagugcaaagugauucugauaaguuaauaaaugauacagaggauauaaauaucuauuuuaaacauaagagcauuuaauuucccauaauccuuacuugaaagaacauuauggcuauucugugaaauggacuauauaaaagauaaaauauauuuuauaaugccuaauuuuuugauaacaaaguaagacauauauuaaaaugacaaggugcuacaguguaguacuuguagcagaaauauuccaaagcccaacaaaauagaacuuaaacagaagucauuccuuacacucaaauccuugaaacucauuugucuaauuuguuucuuacauguuguuaguuuuuaacuucacugggagaaacaggaaucuuaauuucaauagcuuaauuuugcuucaaaaauguugguagggggcucuaauauauuaaaauuggaauaguaaccaguauuuacaaguuaaaagaaauuuuggguggcuuuuugucucuaaguuauuuucauuauaauaaaaugaagcaacaguucuuuucccaucucacaaaagauuuuaaacuauuaaaacagagaaucaguauuuccauaaaauucuauauaauaaauguguuuguugaggaacaaauacuauuugccucaaaauauaaugguuauaaaaacccuauaaguacaugagggugguaaacucaggaaccuuggaaagugauacuuuuauagcaauaaugacucuggcauugguaugugugaugaugggaaccaaaaacagcuuagaauaaaaaguuucccaggaugacugccguuuuccaaacauggucuuguucugcaaaacacauuuauguggauuauuaaaguaagauuuugggccccagcccagagauuuugaaauauuacauuuacuuuaauaugucaguguauccucuuugaaauauauugauacagggcaaagagaguaucagugauuacuggauaccgcacaaugagcaaaaccacuuagcucugcuugcauacaucugaccaaugccaucgcucccuucagauuccaucccauggcuuuugcuccuuaaguuuagggacagucaagucucccacugugcuggcccuaagguuccccuugcccacuaauguguaaacagucccuucauucaauucucauugauuaucugcuuguguuauuuguuuccucuggagucucuucauaauaaaguagcaaaagccugcaaaguuacauauaaagaaauguaugaaaagguucagcaaaguaccauaauuuuuggauacgauauaaaauauaaaauaaaaauauccuguaaaaacuuuaaguaaaauaucauuucuucucaguaccaauuaaucagaccuuagaagaauaaggaggggauaugguugauaguucacuuugcugacacuaauuaucuccacccuaaugggaagaaauaaugaagacuaguuccuucaggcagaagagaauaaggccaggugauaauuuagaguccaaugauuuggaaauuauuugaaaauuuuuggaauguauuuugcucucuuuucaucauucuaaacuaacucuccuuccaacuauuuuuguuuccagacaaggcugaaaacacaauaaaaauaaaaauaagcuauguauuagcuccaugauuuggaagaauaugacuaaaucaacaaacuaagguuuuugguugguuuuuuuuuuaauugaauaaagccaguuaagaacauguuaaaaugaggguacuaagaaauauaaauucauuuuuauugaauuucucaugggguguauagcuuaauacaguaaagugccucaguuuucaggauauagaucacugaauuuuuauauacagguauaauuuguuugauugcacuuugcuuuauugcaugccacggauauuguuuuuugcaaacuaaaugugguggcaacccugcgucaagcaaaucuauuggcaccauuuuuccaacagugugugaucacuucaugacugugucacauuuugguaacucuugagauauuuccaaauuuuuacugcuuuauaucuguuauggugaucuguguucagugaucuugauguuacuacuguaauuguuuuagggcaacuuggacgacacucauauaagacagcaaacuuagacaauaaauguuguuuguguccugacagcuccacuuaccaacuguucccaugucucucucccucuccucagacuucucuaucacuuaggacacaacaguauggaaacuaggccaauugauaagccuacaacggccucuaaguguucaacugaagagucauauacuuuuuuucuuuuuuuuuuuuaaacuuucaguugaaagcuagaaaugauugagcuuagaaaggaagucauguugaaaucagagagaggccaaaacuaggccucaggugcccauuaagcaugcugugaaugcaaaggaaaagcuuaaaaaaauuuuuuuaagggugacuccaguaaacauaugaauaguaagaaaguaaaagggccuuauggcugauguagagaaaguuucagugaucuggaacaucacugaagaucaaaccaguuacaacagucccuuaagccaaagccuaauccagaguaaggcccuaacucucuucaauuacgugaaggcugagugagguaaggaagcuacagaagaaaaguuggaagcuaacagagguugguucaugaaguuuagccaaagaagcuaucuccauaaaaugaagguacaaggugaaacagcacaugcuccuguagaagcugcagcaaguuaucuguauagaacaaccacccccaauauuuuuggcaccagggacugguuuccuggaagacaauguuucuaaagaugggggugggggugguuucgaaaugaaacuguuuuaccucugaucaucaugaauuaguuggauucucauaaggagugcuuaaccuagcuccuuugcaugugcaguucacacaacaggauucaaacuuuuaugagaaucuaaugacgcugcugaugugacaggaggcugggcucagaugguaaugcuugcucgcaagucaccuucugcuguguggucgaguuccuaacuggccccgugguuggggaccccugauuuagaagagcuagcuaagaucauagaugaagguggcuacauuaaauaacagauucuaaauguagauaaaacagccuuauauuggaagaagacgccaucuaggacuuccauagcuagagaggagaagucagugccuggcuucaaaggacaggcucacuuccuuuuuagggggaaacauaaauuuaaguuggugucaaagcucauuuaccauuuugaaaauccuagcucuuaagaauuaugcuaaaucuauuuugccuauaaauggaacaaagccuggaugacagcacaucuauuuucaccaaugguuuauuaaauauuuuaggcccacuguugagauguagugcucauacaacaaaauauuagugcucauugauacuggucuugaucacccuagaacucuuauagagacguacaagauuuguaaaucuccuuguuuguguacuuuuuaacacaacacccauucugcagcccaugaaucaaaagaguaauuucaacuuucaagucuuauuauguaauaaauacacuuuguaaggcuauaacugccauaaauggugauuucuuugauagaccuuggcaaaauacacuggaaaccuucuagaaagauuucaccauucuagauaccauuaagaacguuaacaguucaugggaagaggucaaaauaucaacauuaaaagaaguuuggaggaaguuuauuccaauccacauggaugacuuugggaggcuuaagacuucaguguaggaaguaacugcagaugugguggaaacagcaagagaaguaaaauuagaagugaacccuaaagaugugacugaguagguuggugcagaauugugauuuuugccacuacauucagugacaaaaaaaggaaacaaugguuucuugauguggaaucuauuuuugguaaagauguugggaauacuguuuaaaugacaacaaagaauuuagaauauuccauaaauguaguugauacagcagcugcagaguuuaaggacuguaauuuugaaagguuuacuguggguaaaguuccaucagacagcauuauacgcuacagagaaaucuuuugugaaagaagaguuggccgggcgugguggcucacaccuguaaucccagcacuuugggagguugaggagggcagaucaccugaggucgggaguucgagaccagccuggccaaaauagugaaacccuguuacuacuaaaaaaaucaaaauuagcugggcgugguggcaggcaccugucaucucagcuacucaggaggcugaggcaggagaagcgcuugaacccaggagguggagguugcagugagccaacauggcaccacugugcuccagccugggcaacgagagcgaaacuccaucccaaaaaaaaaaaaaaaaaaaaaaaaaaaaagaagaagaagggucaaccaauguggcaaacaucauggcuaucucauuuuuaaaaauggccacagcauccccaaccuucagcaaccaccacugugaucagucagcagccaucaacaucgaggcaugacccuccaucagcaaaaagauucugacuuacugaaaguucacaugaucauuagccuuuuuuuagcaaaaagguuuuauuuuuuugagagggagucuugcuuugucgcccaggcuggagugcaguggugcaaucuuggcucacugcaagcuccgccuccuggguucaagugauucuucugccucagccuccugaguagcugcgauuauaggcgcgggccacaacgcccagcuaauuuuuuguauuuuuaguagagaugggguuucaccguguuagccaggauggucucgaucuccucaccucaugauccgcccaccucggccuccccaagugcugggauuacaggcuugagccaccaugcccggccccaauaagguauuuuuaaauaauauaucuacauuuuauuuggacacaaugcuagugcacacuuaauagacuacaguaucacauaaacauaaguguuauuuucacuuggaagcuaaaaacagugugugaauugcuuuauugcaauaguuacuuuauuguggugguauggaaucaaaucuucaauauuuccaaucuauauaucuacauauauauacagguuaucuguguauauauauuucugguaagaauuauagucaacaguaucuucauugaguuggugugcuucaaaaagagcagguuugcacaagaaaugacuagaagagcaauugcaaguacacgggccucuuuccugaaaaaaaaaaaaaaucaaaaaaauccguaucuugugaaaaaucaaugaauguuugguucaauuuugcuuaaaucucaaaaggcaugguaacuccagaaaauggaagauuugcaaaugaugcuguaguuaauuuaugacuuauuugaaguuugugagauaucagccuuacaugaaauaaauaaaaguggaacaaaaucuaacuuauaaugacaagacagagaaggaaauuucaaaaaacauucaaauaauuuaaaaccuagcuuaacagguucaaacuuuauaaaauugcugaaacacauauuuuuugaaaaacucuagauauuaaaccugugaucuacuuuuuaauuuaaaguaguuuacucauuucugaauacaaaaugcuuugacaagaggacuugucuuucauaucacaauuaguaucccuuagaaauaacauugcuaauuuuuuaaauaaauuacuaauucuuauaaaauaauuuuaaagaauaaaaauaauauuaucaaauuauuuugacuuguauccaaacugaguaggaacacaaauauuaacagguauauuuaucuuaacuugaugaaugguuuagugaaugaucaguuguuuuuacagcucugagaaaggucacugauuugaauccagcaagcguuuuauuaaauucucagaauccaagaauucaacuuaacaagaacaacgaaaccaagauuuguugucaaggcaacacaacccaagagauugcuuuugauacaugauagaccugacauuugauaacauuggagauauauaaaaaugucuacuaagcaaggauauuuaauuguaacauccaaaaaacuagaaaauucccacauaacagaaauagcauuuaaaauuuuauuauuauuuauuuuuugucauuaccaauuaagauauauuccugaagguugauaccaucuuuaaguaauacucauggugaugugcuuucucuauggggccaauuuaauuuuaaguaguuugaggcuuuaaaugcuugaauuuaagcaggaaugaaauucccuccagcuaacuaaauggguuacaauguuaaucuuacuguuaaucuuuaagcaaugaaugaagggacuucaucaagaugaaaggaaaacuuuacagagagagucauucagcuucuuuuuucuccagaauguaaauugauuuuuuucauaccuauuuaguucuaauuauaagauaccaaugaugcagcaagaagcacugaaaguaacguuaaacugagaguaaagaaaaugugauucaaauuuucuuaaaauuuuguggcauauuguacaaaaucauacucacuuuacugaagggguuggacuguuuugaaaauagauuagcauuuucaaaaauguguugaauagagacuauaguuccaaggacugccuaaaucaggaugauagaacagguagagaauauaaagaugagagauucuaagcugagggaauucugcauccucacucccaucauucuuuaggguuggcaacaucuuggauauuaaaauuauauggucauauauuuguauuuauccacaucauaugaguguacugucauuuaauaaaaucagugaacucuaugaaaauaugugcagauaguuaaaaauucauuacuaugaaaguauuauauccauuuaaauuucuaggcauguuaacucauaugagauuaaguuuucuaaaacuuuugucuauuuuuuaacuuaucuguaauaugccacuucccuuuuuccugaugaguucucacucaucugucaggauuccagcacaaaugucacuucauccuucccugauucuuccaggaaguaaaccccauuucucuacuauauuuuuuauuguagcaucuuucacuuguauuuaccugucucccuuaccugggcacgggaaauuccuaagagcaucaagacuaucuuaugcaucuuuacaacugauuucucaaucccucuccucucuagcuacuauacaguucagaacaauguuuucacagaguagacacaugacaaaaguaaguagaacauuucuauaaugauaaaauauuuagauuugaaaaauuaaauuuuaacaauuauucauuaaucuauuuaauagcugccucgaguaagauuuaguaaaauaaauuuacgaguuaacaaaggaaauaaguaagcauuauaugguuuauuauugauauuucaguaacuagauauauaauuggguuuaacuacauucacuuugagaguauuaguaguaauuagaaagcugaagacauucaugucagacacuaucauucuaaauaaaauacugcaagacuuaauauaaauuagcacagaagauaaauccaagaacuuucuucugauauguauuaaaaauauaaaaugcuugauucgggauauuucauaagucuaaaaaucaucugacaaccacaaacauuauguuauccuuauuuccuuggcuucauuauauacgucaccugcuuuagaguagauaaaacugcuuuacaaauaccuucagguaauguguggcaauauacaugucuuguucacagacauuaguaguuaaauccuggcucauaauuuuaacucuguucaugaaaaaguuuucucuaaauacaaauaauuggaauuacuaucugccuguuuguaauacaauuugaucauuguaauucacaaauacagacccauuaaauuuaaaauaauccuaacaugauguucuuguuaggaaagacagaacaagaaaugaggggcagaggagaaagagaaugucacauucucauuuacagaaauuuauacuuacuguaaauaauuguagguauauugaaguaauaaaauuacacuguacaaccuuauuuccauuauaguaaaauuauguuuaacuaauaguaaaaaaaaauccaagaaaucaaaugugaguuuuaccucuauuuuucccacuggcccccuguguaaccaaggauaaucacucugcacuuuaagcacuucaaacauaacccaccucugaaauuagauauuaaaauuucauucccacacaaaauauuguacuuuuauauaugauaguauaaauuacauaugauuguuuuucauauuuuuaaaauuuacauaaugguauucuacuuuauuuacuugcuaguacaucaaauuuucuaaaccuuuuauauuuauuuuaaaagaauuuauuuuauccauugauugcauuauacucuacaaaucuauuuauuugagguaauauuuuuggcuaaguuaaucacagccuaauuguguuuuugaucauuuuuuaaagagagauauguuaaaaaucuuccagugaugcaaauuucuugauuucuccuuauaaucauaucaacauuuguucuauauguuuuaacuauugcuucuauauguauacauauuuaaaaauuaagaaagauuauuuuauuauguaacugaauuuauuuuugcuuuaaaugacauuugucuuauaauaaaauagcuaaauuuguuuucaugcauuuguauuuuucuauccuuuuauuuuuaaucuuuuuuguuuugcuuugauguauuuuuuuaauauaaaauaauuuaaauauacaaaaacuaaagauaacuauauaaugaaauucauauucaucauuauucaaggauuauaaaaauguaaguauauuuucuucaucauccucauuuuccuucuuuuuauauugcuuuuuuauuccaggcaaauuaaauccuaaugguaagguauuuguggaauuaggcugcucaaguuugccaaaaacaccacuucucuugauaauaaugacuugguaaauaucuugauaucugguuucagauugugcacuucugucuaggcaaagaugaugcugauaugcucauauuuguugauuaaaacauuuauugauaaaggcauacaaaauuuauacuauuaacuacaauuuuuuuuuucugauauggagucucacucuuucacccaggcuggagugcaggggcgcgaucuccacucacugcaagcuccgccuucuggauucacgagauucuccugccucagccucccgaguagcugggacuacaggcgcccgccaccacgcccagcuaaguuuugguauuuuuaguagaggcaagguuucaccguguuagccaggauggucuugauccccugaccuugugauccgcccgccuuggccucccaaagugcugggauuacaggugugagccaccgcaccuagccuauuaacuagaauauuuuuaaaggaaggaagaugcuggagaauguaacagaaccaauuuguuauuuuucauaucaguuuugaugccuguggcuacaagcauaagaugccacaauuaauaguggccuaaucaaugagaucauuuauuaacuuacuaguaauuuaccagauacagacaguuuuaaguuuacuaaauuuuagugacauaaggauguccucaauaacccaggugccuuccaaguuuucauuccaccauaugcaacauaucggcuauuauguuuauguuuccuccccaaggugaagagugugugugugugugugugugugugugugugugcccugcgauuuuaauaucucauccacauaugaccaauccaaaagcagaaaaggcugauugccccugggugucucuucucagaaagaaaucguucaccaauaacaaacagcaaucuucccaguuuuuuuccuuggcuggguuugaaugguauacucauguguaaucacaaagauaugaaauggaaguauacuuucaggcuuagaccaguaguucucaaagcuuacuguagaucaaaaucgcaucaaaggcuuuuuaaaaacacagaucucugggcuuaccaaauucccaggugauggugcuguugcuggucuacggaccauacagagagccauugguuuagaccaaucaacacuugcacuuugggacucauaagagggcagggcauuugggagguuaagaaaccugaauauuuggacucuauuaauaagaaaggugucuuagaccuggcuaaacaagauuuugcuauaguuccaucucaaauuccagugaacaaucuuuuaacaagauucauguugaagugaugaucccuuaaaaugauucuaucuauauucauucucuauuccuuuugcccucuuuuaaguauauuaaaaaaaaaaagacucuuucucucuuuccguuaccuccaauggccucaaagauuuucuuuauuaauuauuuacucuccuuugaauauguauguucuuuuuuaaccucuauaaaagacaucuccaaguuuccucucuuuaaauaaccuuucuuuaaucaacugagguauguccugaagcuaccuucuuuuuuuuucuucuuaacugggaaacguuuugaaaacagaaugcauauggcuuccauuucuuuaccauauacccuucaucuuccacauucugaauauacauuuuuaaaucaacaaaccaaugacucuauuguuuuucucuuuuucuguuacuuaauuuuuagaaaaauuuacaauugguaaaaucacucuuucuuguguacaauuccguggguuuuuuuaaauuauacuuuaaguucuaggguacaugugcacaaugugcagguuuguuacauauguauacaugugccauguuggugugcugcacccauuaacucaucauuuaacauuagguauaucucuuaaugcuaucccucccccuucuccccaccccacaauaggccccaguguguaauguuccccuuccugugcagccauaaaaaaugaugaguucaugcccuuuguagggacguggaagaagcuagaaaccaucauucucagcaaacuaucgcaaggacaaaaaaccaaacaccacauguucucacucauaggugggaauugaacaaugaguucuauggguuuugaacagugcauagguucaugauccacacccacaauauugauaaagaacaguuucaucaauucaaaaaucaccuuaugcuuucccuuugucuucaacaauuacccucacccacagucgcuggcaaucacugauguguucccugucccuguaguuuuaucuuuucuauagccucauauaaauccauauauagaauauguagcuuuuguaagcugcaaccaaucuuaauguacaguaucaauaauccuuuuauuugaaauucuuuuuaaagguuucuguggugcuauucucuccuggauuguuuccaauuucucuucauucucaaauuucuuuuauucuuuaaauauagguauuucuuaagaaaauuacuuuaaucuucuuuuucuuucuauauuguuuucuuagcaaaaucaguaacucuugacccuuggacaguuaccuucagauuugaguucaugcuuuacauuuccaaucaccuaaguaauucuggcacagaaauugccaccuaaguaucucugggacagaaaucucauuuuucuuuugugauucucuuugugcugcaaaugcauaugccuuguacacuugccauuccucaugucugggauuaaacugugcauuuucauuagugacuuuaccuaaggguucucccuugucauguauucuuccaugacuacagcucugacccugugauuauuguucuaaaauaacaacgaaucuguuguuuucauuauucuuuaugcuguucaucuacuuaguugccuuuaucaaacuguucaagauucaguuuaguugcuacuucucccuaaagcuuccgcagcugaugaaaauuacccccuuucuuuuacugcuuguuuuugggggagaccucuuuuaaaaauauaucauuuucuacuuuguguuuaaauauuugugcacacuuaacaugugaucacaauuuaauuuucagggccuaauccuugacuaauuugauucacauuuguauuccuacaguucacugaagaguacauuucugaauguacacuuauuaaaugugugaaugguaaaauuaaguuguuagguucuuuaauguaaguuauagcuauauauuuaagguaaauuuuggauucgaauuugucuugugucuauucuuucauaucgcauccaccaugguaaaaaaacuuacacuaaaugauuucccuaaaaugcccucuguuuacauucacaauuugcuagacucauagcugcauccuucauuauucuauuaccuucuaaaacuccaguaaagaguucuuccugaccucuuaucauugggacucaccggucaggccaaacauuaacccuuuuccccuaagccaggaaaguugaauugagucacucacagagcuauauaaauaucaaauacagugaacccuccaucccugcaacauacaucugcuucuuugauauguuuuuuuuuuucagucaauuuaacaucuaggaaguuuuagcacuugcaauuacguaucagaagaaagaaaucaauuauaugucuaaauuuugccauuccaauuuucuuauuuucuauuagugguacuaaugacacuaaugacagacauagcuguaaauaacuucauuaugagaauauuuuucccaagcugaaugaugacaguuuucacauacuauucagacgcaauuaacagaucuaaauaaauuugaguauaaaaugaaaaacaagugcuaguuuauaaaaaugaaccuguucaguugugaaagauguauauuaaugaagauaccuuacuuccuuaacaauaugcuuuuucaagaaaucagguauuaaaaauaaauaguugagguguuaaaaauagguugaauaucagagaauaauuauuuauuuuuaguaccugauuucuugaaauagguauagugaaaaacaucugaaaaguaagauggaagauuucagggugauagaaguagacagaggguaaugguucuguaugcaggaagaaauggugacuaagaaaaaaaugcugcucugcuauuaacagcaacaaggaauagacuucuaggaaacagcagggugugucugauguguauuuacaagcuagaaagauguucucugugcacagauuaaaacugcaaaaaauaaaagaacuaaagacaaacaaaaauccaauaaaacuuaaaaagaccauacugguugaaucaguacaacgauuuuaauuuucaaggcuugaccaaagacuuaugaaaagaaggaaauagauccuuccaugguuuaacagagaagaguucugaaaauagauguuuaggaauugaagcuacauuuaaaacugaucacauuuauuucugcuaauauuuaauuaauuuccaagggacacauguucucuacuauaagauacugggaggauuaaaaaaaaaaaaaaaagcuauuugcagucggagagaugucacaagguaugccaacucuacaaguuacucauuuuaugggauuugacaaaugauucuuauucuauaauccucaaguuucacuuuugaaaauaugccaauagaaauacacacuuuguagugcauugauuagaacugaauaaaauagcaugugaaaaugauaucuaaagggcccaggagaguauccgauacauagcaaacguuucauaaaugcuuacacucucugauaacucauuuauuuuuaauacugucaucaaagcauacauuaucaguauuagucccugaaucuaagguuuuuuuuuuuaaggugcucaucaauuuauuuuaaaaaaaguaacaccaacuacaugggaucuugcagagcuaauuccaaaugcaauagacggugcuacaugacccacacuaaucuucuuuccauacccaaguagcagacaccagugacuaacguauugaauuacuucagacuuugagugagauuucuugcuucuacgauaguaauuuuacccauuaggccuuuaacauacuccuuagucauaaaguaaagguauguuauuauucauuuaacuuaaaaaauguugggugguuuacuacaugcuaugaauuguuuuagacaucaaacagagaaaaaauccugcccuuaucgaauuuauaauugaauaugggaauaccaauaaauaaaacacagaaguaacauaguaugugagaugcugauaaauauuacuaagaaaaguacagcagagaaggcugauagauacgcagggggaggaaaucgcaauaaaaaauauucagugaagaccuaauuaaaaagguaaaauuugaauaaagaucuaaagagaguagaaaguaagcaaauuagucaugaaacucauauuugagggcaaacaguuauaggacaggacauaaugagugcaaagccccuaaggugguaagguacuugguuuauuugaauaaaaugaggucaauguggcauggguggagugacuaaggaaugacuggauuucauuaaaaguagaaagggaaucaaaugaauuuucaguagugaaggagcaugaucugauuuacguaacauaacuucccuggaugauguagggaaaauagccuuucaccaaggaagaaaauaaugaaaucagguagaaagcuauuaaacaaacaaacaaaagcuugccaccuagaaaggaagucacuuuggaacaggguagaagugaucuaauccuggauaauagaaaauagaaccuguaaauuuucuuguacgacuggauauaucaugagagagaaagggaaaaugccuccaacauuuuggcaugaucaaucagaaugauggaguugucacccacugagacggaauguaaugcagcaagagcagcuuuuugugguguuuuauaaaggagaucaagaguucaauuuggggcaugaauuagaaaaacuuuuuucacaugcaaggagaaaugagaaagaggccaguggauauaccaguaauaagaauuaauacauagacacagggucauuuucuuaccaccuaagaguuauuaaauuuaaccauuucaguagcagaauccuuuucauaagguuccugccaaguugucuuauuccucugaucuuuugucuaacuuacuagccaagaaccuacugaacuauauuauuuuuuaaucucuuuuuuaugugguaaaauacauauaacuuaaaauuugcucuuuaauccauuucuaagugugcaacauuguggaauuaaguacauucacacuguguguaaucaucaccaccauccaucuucagaacuguuccaucuuccccuacugaaacuguacacauuaaacauuauuuccccaaccuccucucuucccaaccccuggcagccaccaaucuguuuugucucuaugaauuuguacacuuuagguaccucauauaaguagaaacauauaauauuugucuuucugugauuuuuuuuuauuuagcauaaugucuucaagauuaauucguauuuuagcaugugucagaauuuccucacuuuuuaagcuggauaauauugcauuauaugcauauagcacauuuugcuuguccagucaucugcugauugacacugggguugcuuccaccuuuugguuauugagaauagugcugcucugaacacagguguauaagcaucuauuugaggccaugauuucacuuauuuuggcuguauagccagaagugaaauugcugaaucacaugguacuuuuuuuuugaggaauugcuuuacuauuaagaaaauguaacaucucauuauacauaaauguauaaugaaaauuuugugaaaaauauguagggaauauggggaucuuaucuuacagaggacauggcaaugucuuggagcuuaaauuaaguccaugcuccauaugaaucaacagugaacuucaaggacauacaaagaaacaaauaaaaccaacaaauaaaaaagccaagaaacguacagaauuuacagguuaaaagaggcucagccgggcgugguggcucaugccuguaaucccagcacuuugggaggcugaggcaggcagaucaugaggucagaagaucgagaccauccuggcuaacacagugaaaccccgucuuuacuaaaaaauacaacaaauuagccgggcguuguggugggcaccuguagucccagcuacucgggaggcugaggcaggagaagggcaugaacccgggaggcggacuugcagugagccgagauagcgccacugcacuccagccugggcgacagagcgagacucugucucaacaacaaaaacaaccacaaaaaaaaaaggggggggggggggcuugacacgacaaugcaucauaacauaugaacugauuuaaauacugauucaaacaaaaaacuauuuuaaaaagugcuaguuauauuuaugacaaaauauugaguaucgaacucgccccucuuccaugaauaauuaggaaaauggauaaucaauaaaauaaaacucuucucaggcauuaaauaacauauagcguagggcuguauuuucuuuuucaauaagguaaacauauuaggugaccuccacuucagcuuggcuuucuaccuggggacgcuuccaaaccaccacuaaaaaaaugguagcucaggccaggcgugguagcucacgccuguaaucccagcacuuugggaggcugaggcggguggaucacgaguucaggagaucgaaaccauccuagcuaacauggugaaacccugucuuuacuaaaaauacaaaaacaaaauuagccaggcgucguggcggaccccuguagucccagcuacuugggaggcugaagcaggagaauugcaugacccugggaggcggagcuugcagugagccaagaucgugccucugcacuccagccugggugacagagcaggacucugucucaaaaaaaaaaaaaaaaauuguagcccaaacagagacugguguuucuuagugggcaaagagaauagugaagaauagugauuggaguuuggagucccuguggccuguggcagcugaaauuuaauguacagaguauuagagaggagggaaccagucacagaaaaagcuccaaaauucugaagagaaauuuuuggauagugauuauuuuugaauuuugaauuguuggccaauuucagucagaaaccauaggcaugacagacaagagcuacuggaggcugugagccaaacagcuauuccaaaagccaaagugcugaggaacaguggaguucugauuaaccugagucaggaaucuuugaugaauaccccaggcauucagacccuagaagugccacacuuagaagcagaguuauauaguaauagugcucuaacaaaguaaaagccaagccucaaaagaucaaguuguuggaccaguaaguuaacuacuugucagaacaaaauccaaccauuuuaaaaggaggaaauaagucuggcugcucaccaacauggccccaacaaugugugauauaaauuauaaagaaaauauacuagacauaugaagaagcaaaaauaugaccauaagaaaaagaaaauagucaauacaaacagauacagaggggaccagagguuuugaaaguaauaggaaaaaaaucaauaaaacagcuauuacauguauguuugagaauuuacaauaaaaaauaaacacaggccgggagcaguggcucaugccuguaauccuagcacuuuuggacuuugggaggccgaagcggguggaucacgaggucaagaguucaagaccagccuggccaagauggugaaaccccaucucuacuaaaaauacaaaaaauuagcugggcauggugguaggugccuguaaucccagcuacuugggaggcugaggcagagaauugcuugaaccugggaggcggagguugcagugagcugagaucgugccacuguacuccagccugggcaacagagcaagacuccaucuaaaauaaaaaauaguaauaauaaauaaacaaauggguaaagagaugaaaauuucaucagauaaaauaaaaaccauauaaguugaaacuguaaaaauaaauuaucugaaauuaagaaagcuauaggguggacuuaacagcuauugaauacuagagaauaaagaaugagugaacuugaagacagaccaaucuauugaacugaaguauagaaaggaaaaaaauaaauacauaaauaaacagagacuuugagauccauggaacaauaaagcagucauacaugcucguaaugaaguccuagaggaaggagagagaaaauaagguucaaaaacauuugaagaguuaaugcuaaauuuuuguuuuuacuuaauuugaugaaaaauaucaacugaaggccuaagaaacucaauucauuuuaaacaggauaaauccaaugaaaaagcacucaauucaacacaauaagauuacuaaaaaucaaauauaaaguagcuuguaauaaacaguguauuauauacagaagaaaaauaaaaggaaugucaacugccuucuuuuuuuauuuauuuuuuauuuuuauuauacuuuaaguucuaggguacaugugcacaaugugcagguuuguuacaaauguauacaugugccauguuggugugcugcacccguuaacucgucauucacauuagguauaucuccuaaugcuaucccuccccccuuccuccccaccccaugacaggcccuggugugugauguuccccacccuguguccaaguguucucauuguucaauucccaaacuuucacaaggacagaaaagucaacugucuucuuaucaggaacaaugccagccagaauucaauagaucaaaauuuuaagaugcugaaagaacacagaaauaaaguaaaucugucuuagaauuucauaugcagggaaaauaucuuuaaaaaaaucagugaaaauaaaagugguuucaccuaaaaaaacagaauauuuccuuagcggacaugcaguacaagaaauauuuuaaaaacuccuuaagcguagagggaaauaacuuaaaagaaacacagaucuucaugaaggagcaugguugauauguuaaauauuuuauuaaauuuuaaaaguguuguuuccucauuuaucuaaacaacaacucaauauuuaaaacacacaauguauuuaaaaaauagcguauguagaaaugaaguggauguccacaauugcacaacagugcauacagacauaaaugggaauacacugcuacaguagucuuauagcauagaugaugugguauauuuauccaaaagauugaauauaguaagugaaagauaaauuuuguaaacacuagaguaaccaucaaauauauauauauaaaauaaagauacacacaucuaucuagaugucauuaaaaaucaaauaguaaaacaguaagaaauaaaaaagaagacuugauuaauuuaaauaagccaaucccacaaagacacauauugcacguucucacuuauuugugggagcuaaaauguaaaucuuacgaagauaagagaguaaacuggugguuccagaaacuuggaagaguaaggggaauugggggauaaagugugguuaaugggcuuaaauacacacuuaguagaagaacugagaacuggugcuugauagauugguaggaugacuauaguuaauauuauuucauuguacauuucaaaauaguucaaagagaacaauuaaauauuccugccacaaagaaacaauaaauauuuaaggugauagauauccuaauuacccugacuugauuauaucaauguaucauauuauaaacaugugcccccuaaauauuuacauguauuauguaugaauaaauaaaugaagaaaaaauguaaugaagaauagaugggaaaauggaaaacaaauggcaauauguuagacuaaauacauccaugccaauaaguacauuaaauauaaauggacugagcaaacacucuuauuaaguuagaaacuguuggacugaguaaaagacaagaccccauuauuagcuauacaccagaaauucacuuuaaauguagaaguacaaauaaguugaaaguaaaagacuggagaaagcuguaaaaauauuaaucauaaaauauuacuagacuauuacauguauuuuaacauuggguauucauauuaaggaaugauuguaaauucagauguaguaaugguauuagagcugaaaauuuaaaguucaugacugucagagacacauguuaaauauuuguugaaaacaagaugucuggaguuuacuucaaaauaaucuugagcagaagaaaggaacaggugagaaaugaauaaggauauaggugaaacaagaucagacauguaaugauaauuuuugaaggugggugauggacacauggaaauauacuauacgauucucucucauuugaauauguuugaaauuuccuaugauaaaaacaaaaucaauaaaaaacugaauucaaucuuuuaugauauaauauuaaaaaguuuaaauaauaaaaaucucacuguauuucaaacuguugguuaagcuauuuuuuaauaguuaaucuaauucuaagccucaauuuaacaaccaguuucaagcaaucaguauguaagaguauccugaaaccauauggucugacagcauuugauacauucaaggaaagguucuggaaagauauuacaguuguuagcaaaaguuauuuuucaaauaucugagaacugauaugacucaugggaggagagcuacauuauaaagaucaaagguaaagggaaaaagaauauauuaucuuccuauuuggacacuuuuucucucucaaaacccuccuugcuucucacuauccaguacauuguacauuugccucccuagacuacuuuuacgcaacacuuccaacaauuaacuccucuggguccacagcugacaaaaaucuauuccuuauuucuuauacuugacuccugaauccucugucaaaggccaaaggaggaaaaacugucuguuuggaacuugguaggauuuggagauggucacuauuucaacugccaguucaguaacaugauuuaaaaaaugaaggcugaaaauggaagccugaauguaguuucccauauaauaugauguuugauacaauaugaaucuaacaaggcuugaaucuagaguggguauuggcuagagauaugguuuggcucucuguccccaccaaaaucucauguugaauugugaucccaaguguuggcgguggggcuuggugggagguguuuggaucaugggauuucccccuuguuguucucaugauagugaguaaguuuucaugagaucugauuguuuaaguggauagcacuucccccuuagcucuuucucuccugucugccaugguaagacauguuugcuucccuuucaccuucgaccaugauuuuaaguuuccugaggccuccaagccaugcuuccuguacagucuguggaacuaugagucaauuaaaucucuuuucuucauaaauuaugcagccucagguaguucuuuauagcaaugugagaacagacuaauacaguuaguaugcauuuuuuauauuugauauauacauuuuggguuccaaacaucagugucacaaaugaguauuuuauaauauccuauuuuguucaauacugcuggcagagaguuuuaaaguacaguaauugacaggacagauuuugaaguugaacagucucagguccaaaccucaagcugaccuuggaccaacuacuuauccucucuaagccccgguuuucucauuuguaauguagaaauaacaauacuaccuacuucaaagaaugcuuauauuaugcaagucaaacaauuaagauaugcaaagcauuuagaacuuuuccugccaccuuguagcucuacauauguuacauauuaaauuaguaguuuuaacauuuacugaaauuuuacauuuauuguuagcaauaauaaaauagcugagguuaauugaaaucuuacucuauauguauuaauaauuuacauaaaaccuuauaaaguaaguaguaucaugaagccaauguuuaccuaauguucauaagcauaaaaaugaacucaaaauaguaaauaccuuaccaaguguucauccacaaauaggaauaaugagaugaaauaacugugaaagaagaugauggaaucuuaucauuaaaucaguuuaaaaaaaaguucccaaagccacugcaagcucccaaaaaugauaacaaaucugugguccaaauuugcugcuuuaaugaucaguuugcuaaaugcuaccuaaugacaacauaauaguaugcggaacguuuaauaaauguaaaaugaauuguguuucaaauaauauucuaauugaaaauuccauuaacaaagaauauugcaauagugguagauuauagauuaaucaaaggcuacuacaacucucuccuguggugcuaaugauuuauuguucuuucaguauacagccuaguaaaguccuuuauguuauucacauuauuuuacaguagcgagaaugaagaaaacacuuuugcaaguuuuggugcaaccagccuccucaucaacugugaagauauuucaucaccuuugcaaaucaaggccggcauaaugaggaauagcucaauuaccuacaguacagaauauaucuggaaguucucuuuaguugauuagaaugcaagaaaucaugauagucaauugaagcucagauauuuaauaauuguuauuggaagguggcuuggcuuacgauaagauuuugaauacaaaauugaaagggauaauagauuaaauaaaauuuccaaaugguauauaauuucucuaucauaaguaaaauuauauuccuuauggucugaucacuaguugauagcugccuuuauucaagaaaaucuaaaggaaagggcgcuauuaguuucaacaguuggccccacauggaauagguguauaauggcuuuugauuugcaacucuggcggcuguucacaaguuucauuugcuuuaugguccuauauauucaccccugaaaccaacuguuacauguugguuugcucugucagcugcuguuucccagcaagucagagauaugucaugcuguugaagcuuuuuaucagcaaguuccuuuaaaaagauaucuucugccugcaguuacucuguuucagcucuccauaggaucgcugcucagguacccuaccacgcugacagaauuuuauaauauacaaagcuuuccaguugauguauuuguuauauuuuaggguuguuaguaguuacauaccuacccugucuggcagugaguauuauaaggcauagaguagcaacagagaagucguauucaaugucuuuaaguuucuauguuuaauuaaauguaccacucuccuagacuaauaauauaaaaaugaauagaacuuuaacucuuauuuuuuugcccuuuaauuucauucuuguauauauucaaaacauuuuuucaaugacuuuuucaaaggcagaaaauguuuaggagagguaaauuuuaauuuuuuaaaaccguaucaauauaugcaauaaaugacaucgcaagagugaagaaacaaagucaugaaagaaauuuuuaaucucuuaaugaugaccaaauacuaucaagcuauacuaccaugcuaaaaucuuuucccaaguaacaaggcccaauauauuccucuuuuggucaccaccaugucuaucuguuuauacuuaauguugucaaucuaguaaauauguuaauuauaaauacugacuacuuggcaaggggacuauaauauuuaugcauaaguaagcagaguggaggaagcaaaaaugugagcuauuuaacuuucuggaguaguaaaagugauuuuaugaagagaacagcauaucccaaugacagauggguaagucaugcuaaagguguacuacaucugucucuacuacauuuaaucagauauaugccaauucugcugacuuguauaaacuguuuugugauagaagcaggaaucuagauugcucaacuaaaaucuaccuaguuggcucacacaaguuugucagcaggauuccacuaaaauuuaagguaaggguauggguuuuaaaugaagcauuaauagaugccucaauauauauuacuucucagcuuagagucuauauuaugaacuaaacucaguauggguaugagagguacauaaagagaauaaaaaaauccaaucacaguguauaguagcuuaaauaaccucauaggucuuuuacauuucuaacuucuauaaaccauuauuauuuguuaaaacuaugauuauaggaaaagauugaggaagauaacauuaaaaaguauggacauucauuucaccuuaagccaaaaaagcuggaaauaacccuacaucaaucucauucuuaagagacagaauuauacucaauuaauuuuaauuaaauugcuccauuagcuugauuuuccuugacacuguggaaucugaccuccuguauucuacagagcaguaccaacagccuccaucuuaacaaacugcuucacuuaagcuuuaucacugaugacauuuaaugaucaggaaaggauaaggacagcauuucugcuuuuucaguuugaugauaccgguaguaccacaugcugaaagcucucaauuucuggugauacaaggaguacauuuagaaaaggucauaaucuuugaagagggcuacauuaauucuugaagugcaggaacuggaacuaaauauauuuuaacuauaucuuguugucuguuuuagaaacgcaaacaacuuauuuaauuugaacaucaauugaucaaaugucaauccaagcaagagaaugagauuuacuuuaauaaggaauuaaaaauuuuuauuccaacacuguauacaauuuuucacucuaggggguauuuuuuuuaauuuucuagauuugucuuaaaugaauucucauauguuugggugacuguccagcuaacaaaacuuuaugaauauauauagucuaggcaaaaauaaguaagaaguaugcauugaguagcgcauauggaggaccuuucuagagucuauguugcuauggauauuuauuuguucuuggauuguaaaugaacagaaaauaguaaauguagucauuaucuuuaaauuaaaaauaauguguaucuucuaauaauaagugaaacauauauuucagaggagggauuaaaccgucuaaauuuuauauuaugggacucaugaaaguauaauuacaauaaaaagucugcugacccacuucuacuuuuacccaguguuauauccuuuggaauuauuaggaagucuuugaaauucaaauauuauuaaaaacucaaaauaagagaauucugggaagacaguggaguaggaagcaccaauaauaaguuuucucacucagacaauaauuacacaagcaaaaaucuuucccauguaacuuauuuagaaugcuauaaaggcuuguaucuucuaggggaaggcuuuagugguaaacugaagaagauuuugguuaguaucacuucuuaacucgacagcagccaccuuucacacuaacaaacucuauggcagguaguuguacacauguuacuagagcaguuuucauacaacucaugggaggcagggugggcaguaaggacacuguucucuaacauuggggcuguguguucugaucauuaauugcuguauuugaucaaggagggacaaacacaaaggcaggcacccacucuugcuacaucucccccuuauuguuccaaguagcauuuucuuuggcugaagugacuuccagaguauauaaagcucaagugagguuuuuuuuaaucuuaauuuuuucuuuuucucauuuuugugaaccagagauuaaagacuaaaacauucacagcaccugaaaauacgggaaaauuagaaaguuuucaggaaugcccagggagaaaugcaggcucagaaaagaucugaaaaaaaaaaaaaaaaaaaacaacccuuaaguuuacacaucagccuaauccuuggcauagagauagccuacagcauuccaaacaaaacaaaccaaaucaaaauaaaagcagcauauccaggugaaggagugaaauaugaguuccaaauuugccauauuauuggauuaaaauauacaguuuucaacacaaaaaucacaaggcauacgaagaaacaguaaaguauguuccauucaguggaagguaauaaaccaacagaaauuguccuugagaaaguccugauaguagaucuacuagaaaaugacuuuaaaacaacugucuucaagaugcucaaagaacugaaggaaggcacaggggaaguaagaaauauauauguaugaacaaaaugaaaauauaaauagaguauuuuaaaaauaacuaaaaggaaggucuggaacagggaaguauaauaacugaaaugaaaaaugcauuauacuguuugaaagguaguuuugaauaggcagaaaaagaaucagugcauuuggauauaggacaauggaauuuauugaaucugagggauggaaauaaaaaaugacugaagaaagugaaaacuaaagguauaaaacacaaucaugaagaccaauauacacauuauaguagucuccgaaggagaagaaaaugaaagaggcagagaaaauauuuaaauaguuucugaaaauuuccaaaauuugaggaaagacaggaauauaaacauucaagaacuuuaaugaauucgauauugugaacucaaagauacacacacugagacacauuuuaaucaaacugugggaagccaaaggcaaauaaauaaucuggaaaucauaaauagaaaaguaauuuauaauaugcaaccucaaugagacuaucaguagauuucucaucagaaacugcagucuagaaggcaauggacuauuauauuuaaauaacuacuagaaaaaaaaaacaugucaaccaagaauccuauaugugguaaaauuaucuuucaaaaguuagagaaaaauaaaaaaauucuaaaauaagcaaaagcugaguuuauaaccacuagauuggcccugaaagaaaugcuaaaaaacacucuugcaguuuaaaaugaaggaugcuagaugguagcucaaagguauaugaaaaaauaaagacugcaguaaaaauaaauacaugaaaaauuuaauguuagcauuauuguaacuuugguuuauaacuauacauauuguuuccacauaauuuaagguacuaaugcuuuaggaaaaauuauuacuuuacauuuuuggacacauaauacauaaaauguguuuuuguuacaucaacagcugaacuacugaacaggguggaaacuaagcugccaaggagcagagguuuuuuuuuuuuuuguuauugaaguuaaaauggcuuaaauucaaacuagaguguuaugacuugaggauguuaaauguaauuaccaugguaaccacacaaaaaagcucuaggauacacagaaaaggaaauaugaagggaauucaaauauuuuucuacaaaagaaaucaauuaaacacagaagacaguaaugcaaaaaaucaggacaaaaaauuuauaaugcuugcagaaaaaaauggcaaaaugacagaagauuuuccuuaucaguaauuacuuuaaacauaaguagauuaagcucugaaauuaaaaaaaaaaaaaagaauggcagaguggacuuuuaaaaucaaccaacaauaugcuguuuacuaaagauucacuuuggauccaaagacagaaauagguugaaaaugacagauuuaaaaaagauauuccauacaaauaguaaccaaaagagaucaggaguaacuauacuaaaaucagaaaauauggacauuaaauuuaaaaagguuacaagugacaaagaaggacauuauguauuaauaacagaaucaacacugcaugaagauauguaaacauucauguaccuaauaacagacaucaaauacaugaagcaaaaauuaacaguauuuaagggauagacaguucuauaaaaguaguuagagacugauaucucauucuuaauaaugaagagaacaaccagacagaagauaaguaaggaaagagaagaaacacaauaagcuaacuaggucuaacagacauauaaagaacaugauacccaacaacaauagaauacccauucuucuuaacugcacaugagaccuaagucccaauauauauauauuuuuaaauggaagucauaaaagaaaaucuucuccaaccacaacaggaugaauuuagaaaucgauaauagaagaaaagcuagaaagugaacaaauuaauggaaauuuaaaaacauagucuuacacaaccaauugaucgaaagagaaauaagggaaacuagaaaauagaaucaaaagaaaacaaaaaugcaacaaaccaaaaccuaugggaugcagcaaaacagugcuaagaagaaaauuuugagauacauuuuaaaauaaucaaaaggaaaaucuggagcugggaaguauaauaacugaaaugaaauuucauuuucauuuacuuagaauuuaaaagaaaaaaagaucucaaaucgauagucucuccauacaacuuauggaccuguaacaagacaaacagacaaaacccagagguagaagaaggaaggaaauaauaaacguuagagcaaagauaaguaaaauggaggauacgauuccaucuuaaauagaggaaauauucugacauaugcuacaacauggacgaaucuugaugacauuaagugaagugaaauacacagaucacaacaggacaaaucaugcaugauuccacuuauaugagguacucagcguagccaaaauuauaaugucagaaaggagaaugccaguugccaggugcugcagggacaggaggauagagauuuaguuuaaugggauagaguuucaguuuuccaagaugaaaagaguucugcagacagaugguggugauggaugcacaacauuaauguguuuaagaccacugaacuguacacuuaaaaauagauaagauggcaaauuuuauaccauuuguacuuaccaaaauaagaauuggaaaaaaagguaaaccacaaaauaagcaaacaaaaaagauauguuugugaaauugaugcuuccaaaaaaugacacaauauuaggcaacaacuuugucuguauacuagacaacuaauuuuaguaauugugauaauucacuuauaguauaugcauauuccuacagaaagaaugacccuaaaaaccaaaagauguucaaugaauuucccaguuacuuccugacuaguauauuaagcuuuuaaaacaauauuaucucuaaccuuuuuugauuucuugugaccuucaucaauuuacacaagugaacuuugaagcccauuuuauuuuuccaguguuuauuaaugcccuaauccuuauuagcaaagaugauacuauuaguaaauauuaugguuaauuuacuuggagcuacuugaaauuacucuugucauuucauauuuuuguccaucaagaggcugguguuucuuuuuagaguaucaagucacuucacuuguaucaaggcugagcaguuuggcuuuuuauauguguaguggccugaagacacaggcuccagccucuagcauaugaauugcaugaugauaaucaaucucaguguguuugacugauaaauauauauuaauuauuuuuaaugagcucaaaagcacaguaucauucucuagcaaacuuaaaauagcaaguaacuucuuaguuuugacuucacaauuagaggacaguuuaaaauuucuguauuuaaauauauugaugaauuacauacuuuuuauuaaauaauauaguauacauucuuuuauaaucagaaaccugauauaaggacuccagaaaacuccaauauuguucauugauuuaaaugcauuuacaaaaccaugucaggaaauaacuuagaaaacaauugauuuggaauauauguuccagauaauccauaaauucaucucuccucuacuuuucccaguuuguaugcucuguuucaugccaugcugccugcagcaaaaacgauucacaauaauaucccaauaauucacuucaaaguuuaccuuuuuuuuuuauucuuuaucccugguuugcaaaguagugucuggagaaguuaggaauacuauauaguagagacaaugauucaaaguaacuuuuuugcuuggauaugauucaucauauauccauuuuuauugaacaauuuuaugcauguauauguuaaaaauacauuuccugaauuuuucuuauugucuucagccucaaguuacaagauaacauagcucaguauuugauagcuacaauuauccuaagaauccuuuuggucauuuuuggagcgccaccauaauaaaauuaugacgcaguaaauauaugcuuccuucuacuuagaggcccguuaauagcaauguauaagauucaauuuuuaccccuuguagaaguuuccuuugaaaauauguaacaacaaaauugguuguaauaguuccugucugauuuggcuaucuauugcauuacuuaauaaugauuuacuuuuucauacacagaaaggaaaccugugugaggaugagaagggcuuagggcuucauugagauuuacguggcagaauaaaauaugaaaauucauauccauuaucaacuaagacauaaacugugggcauccucagcuuaaaguaaccugaaacuuuuuucuuuucuuuguaugaaaauagauacuauauaaagaaauaugaugccauaguaacuagcauuuuuaguuauucaaaauuaagcucauugacuaaagcuauaaagaauuagaaauaugcauuuacccuuggacauuagccaaagauaacucuauuuaaaaugcuuacacuuaccaguauuucccucuuuuuaauugacacaauuuauuguguaauuucccacauuauuucaguugagaaauuaaacauauacaucaucauuaagacaacagaaaaauuaucuaguuaucaauaacaauaaaauuuaaauggcugauauuaaauuuaaaauauuccaaaguuggguaaucaaucagguaugauuuguaaauugaaggagcaaauauauauuugggaauuuaacaaauauuccuuuucccauuucagaauauuuauauaauuuucauuugcaucaauaaauguucauuaagaaaugaggcacauagcucauucucaccccgaaacccaaccaagaaugacauuaauaggaaucauuccacacuaaaacuuaugguaaagcuguuucauuuaaagauauuuuuuaauguauuggccacaaaauauuuaggcccucauaaauguaaggauuuuuaaauuuaggaaaaugaaaucuuacauuagauguuagauuuuuugauacuuuuaaacagggugacuuuuuaauguuauuugucauaauuauaauuagauauaacuuuugucacauuucagaauuuucuuagaacaccucuuuauuaguuuuuaaauguucuaacuucaucaugaagaaaauuaaaagaaugguuuuaaaaaaauucuccauucucccuuucugcuuguguuguuagcaaugcgaauaacgccuccauacugucauguuagcugauaaugauacacucugcccacgguuauuuuaaagauuuauccacuugacaaaguccuacaauaguggaaauagaaauauuuuuaucucagaaguuauaaaugaaaauaauuaguagccuccaaaaagguuagccaaaaugguccgauaauagcuauuauuucuaaucauaaaaugacuaacuugaaggcauagguuuaucuuaaugaacaaaauauucaaauuauuuuucuuggcacaaaugcuacaaugaaaucaucccuuguuuuaugcaacauauauuuuaauuuaaaucuaguucaauagaagaaaucacaguuuucauaggaaggcaaagagguuuuauuggguauaugcaagggaaaugaauguauuuauauauaaguaugaggugauauaaaguugaagaaaaaaauggaaugaaggaguaggugucuaugagcaaguaaggaauuaccuuuuaaaguagcugguaaacucuugauugugcauaugguuccuucucuguucuagaaguauaaaacguaagacucuucuaaguaauacacuaccgaauuuugcuaaucgcuugguaaggaacuaaggaaacauggaaaagcuguguucauuuacucauguaucauuucuuugcacuuuuuguccuguuuauguaaauccaagcaagagcaaacuugaaccuucucuuagucaucguuuuggacaguuuguaaacuggaaccagccuuuuauaaucugacccagcuaaaagacucauaaguaauaaaagacaaauacauuagggauagcagcuugaaaaaucuguucuuauucuuuguaucuuccuauaauaauggguaauuacugaguccuagcacaucuuuaugaauaaaacacaucacuuuugaaaucuuggcccaacucuggccucuuccacauauacuugcaugauuagccauuaaaaaugaauauugcaugcaugauuucuacauuaaggcaucuuagaauuuucaguaugaaugggggaagaaugauauuuucguggauauucucuaccaucugaaaaaauaacaaaauaauuuucaugaaaauaugcuguuacaaaauuucggaaaacagaagagguacacagugaacguuaacguucaguguuagaauuguuuauaagaaaggaugugcaucuaucuaacagauuuuauugcacguuauccgaggaaagaauguacuaacuaaagaaaaacuagucuuuccacaugcugcuuacaaaaauggaaauguaaagguugagaauucaacaguaucagaaagcauuuuccaggaguguuaaugaaucuggaaaaugugggguaccagagagcauuggauguagcacaggaauggauuuauucuuucacacuucaaucucaguggacuauuauuuuguauaacuuacuuuccccccacauccuugucccaaaauauuuucuauuuuuucauuauguuuucuaaaguauugaucaggaagaguacaucuuagaaaacaaaaauauuaugguaaaugcauaagaauacuguauuaugauuuuuguuuauauaucauuucaugcaacaaucuugaagugagugcacuuaaauaaaauuaucuuugagugcucuaucugaaacauucuaaagucgagaucugaaaagugagagaucaguuuguguugauuccccaccaaagugauguaauugcuacuacaugaggcucugucuaagcaaucaacuggauuuccuguguauuuacccagcuuucccuucucuaauuccucuccuuuaaaugcaggcucuaagcauuacuguaaaguguuguuuguaaaaaacauguaaauggcaauaacuaaaugaaaacuacuuuagcauaguggcuuugaaggugcuaacacucauuuggcuuuauaugauuuagaugcuauauuacuuuauuuuuagaagauauaauuuuguuuuauacauaacuuuaguauuuuauuugcacucuguguuccuuauaauauaaccaucuuuauuucugcaucuacaugacauuguaaucuauuggggcacagaaaguccuguagaaacaacuagaguguagaaaauaacacuacaguacuccuuuaauuuucucuuuggucaaagaguccuuucugguggaauuuucuggaaaggaaaugcacauacacacauauaugucuacaugcaaauguguguauguguguacauaaauauauauauacacauauaauaaaugugauacauauacacauacaaugaaugugauuguguguguguauauauauauauauauauauauauacacacacacacacauacaugcaaacacauucauuguaguucaaaauuaagcauucuaauaaaaggaaugguguaaaugaguaagcauucuuuuugcuuugaggcuaaaaucgugauuauuuuugcuucaguuccuuuugcuuccuuuccaauggcccagugaccugggugggcuuguauaauguacagauaaaaaagaaaaugucugucuucucucugacaucaggaccuuucaccaaagaaaauuguaagcauuaauuaaugugauuugcuuagcucuuccaaacacaaaugcugucugggccagaccuaauggggcuucagcuaugccuuuaccagcguggcuaaucuaauucccugugcaauccuuuuuucuugcuucacuguuugcucaguagacacacucacuuucucugaacauuucuuucugaaguuauauauacuguggauucacauuuuaaugagaugaaauauuuuaauagaaguauuuaauagagaaauuagaauaauucaucacuauucagcuaccaguguaacuggaauaaggaguaccguaucuaaacuguuugaaauaaugaguaaaucuacuuugaauggaucauuuauuauauucccauaaggucaugauaugccuuauaaauauauuugacaacauuuuuuaccauaguaaaguauauuuaauuguuuuaauauuucuuacuuauaagggcugaagcuccauuucauguaaaaaaguggagaacaguaaauaauuacccuaauaacucaaugauaucauaaacaaucacaauauauuagcaaaguccauagucauugggagauaaaauuuacagaaauugugucuucuuucuccuaccacuguauuucacaugucugaacaaagauacacaucuacauguuauuucaauuugccacagcaugcacagauauugagauacagauuucaacuaauuauauucugaauagaaggacaauguucugaaugacaagggaaacuccauuaucaaaggcuguauuaugaaagggaaaugucuaaggauuuuuucaauaaaaaauaaaaacaaaauuaaaauaaacuaauccugcauaacuaaacugaggaaaacaaauagagcauuuauuaguguuuuuuuaauuuuguuuuuugcuuuuuguuuuuccucuuucagauacugauaaaguuaacucuggcaucgaaaugacacacgcuuaauucuaaauguuuuacuuuuaaaaauaaaaauaaauaaauauccagugguauaauuuaagcugguuccaugugaaccaaaaauacauauuuguaaaacauuaaaaugaucuaggacgcuaucugcuugaauaauuucauagcacgaguauacgcauauuugguguaacagaaaaauaaugaaaaauauuaauuaggaaaacauaccaucaaauucagcuugaauuuaagaaacaacaagaauaaauauaaguguagaggcugacaaauaauaaagaaaguaaagugacaguucagacacuaugaagucacaaauaaguacaauaagaauccaaguaaaugauucacacagauuaugugaugguauauugauaaaaguaguaagugaugcccuggagccuucuuucaccaccaacuuuucaaaugccccugaauaaucacucuuucuuccccaaaauauauaucuuaauuaaaagaaagccuuuucuuauuguacuauuugaaagcaacaguaaaaguauuaagauacugcagcuaauuuccugacauuuauuuuaugauuggaaauuccauacuguaagcugacaaaccaaugguuuauagaaaaaaaaauaaaugcaauaugggcacuucuguuuuagcauccucuauauuccuuugcuucagaacauauuuugacauaauguuuaccuuucuaaaaauuuguauauaccaacuuuggucuguuuuccuaccuuaauuacgucacaucuuauaaaauuacucuaauugcuaaaaaauguucuuuaaaacacaaguuaauuccucauguuaauauucucucaagaagcagcacauuucucagggauucagcaugagauuuauuaauuuucauugcaugggagagcucacaggaaauugccuuccauagagggugacagagcaauuguagguuuagagucauaugugguauuagaacuacuuucuaugauuagauugugaugauuuuaaaguuuuaguacauuuugaaacauuucuguaauuguuaaccaugugccauuauacagaccaauuucacaaacuuuucauggccuguuacugugugaaaugauuagaaaaguguuuuuuuuuuuaauuuuucuuucaugguggcuagguaaggaacuugcuagaauguacuguucucagcauuguuguuaacuuugugaguuagaccuuuacacuugcaaaaaguauauggagaacaauggauagcagcuuuucagcaauuucaaacacuaucugguaaugacaucaaaaagagauguuuauuaucaucagagaauuacaaauuaaagccauaauaagauaucaccucauaccuuguuacaaauuuccauuaucaaaaaauaaaaaauacaaaagcuagucagugugaggauguacagauaaggaaacccuuguauacucuugcuaggcaaaccaguuaguacagcaauuauaaaaaauaguauggaaguuccucaaaaaaauaaaaauagaacuacuacucugcaagauaaaauguucaacaaacucggcauagaaggaccacaucucaaaauaauaaagacuauauaugagaaacccacagcuaacauaauacugaauggggaaaaguugaaagccuuuccucaaauaccuugaacaagacaaggaugucuauuuucaacacuauuauuaaacuugguacuggaaaucuuagccagugcaaucaggaaagaaaaaaagaaaaaagaaaacacaauaauugguguccaaacuggaaaagagggagucaaauuaucccucuuuguagaugacaugaucuuauauggggaaaaucugaagacuuagaacugauacauuugguaacuuacaggauacaaaaucacauacaaacucaguaauauuucuagccaucaauaaugaaguagaugaaaaaaaaucaagaagucaaucccauuuagaguggcuacaaaaaaaaagaauacuuagaaaugaauuuaaccaaagaagugaaagaucucugcaaggaaaacuauaaaacaccagugaaagaaauuaaaaaggacacauagaaauggaaagacaacccaugcucacagaucaaaauaauuaaaaugaccacauuacucaaaguaaucugcagauccaauccaauccuugucaaaacacaaaaguuauuuuucauaaaaacaaagaagaaagcaauccaaaaauuaguauagaacaacacaaaaggcucaaauagccaaagcaacucugaguaaaaaggacacagcugggacaucauacuaccuaacugcgaaauauaagacaaggcuauaguaaccaaaacagaacauauugguauaaaguuugacaaaugggacagaauagagaacccagaaauaaacccacauauuuacgccaacucgucuuugacaaagucaccaagaacaaacauuggaaaaagaacaccuucuucaauaaauggugcuuggaaaacugcauaaccacaugcagaagaaugagacuggaccccuauuucucaccacuuacaaugucaacuaaagauggguuaaagacuuccaauaaaaccuaaauuuauaaaauuacuauaagaaaccguaaaaaaacaaacacucuucaggacaucaggcuaagcaaagauuuuauggcuaagaccucaaaagcacaggcaaaauuuuaaugagacauauucaacuaaaaagcuucuucaaagcaaaagaaacaaucaacagaaugaagagacaacaucuucaaugggagaaaauacuuggaaauuauucaucugacaagggacuaacauccagaauauaaggaguucaaacacuucaacaauuuuuuuuuaaaauuccauuugaaaauaggcaaaagacacaaauagcaauagaagacauacagguagccaacagagauaugaaaaaaaugcuuaacauuguuaaucaucagggaaaugcaaaucaaaaccacaaugaaauaucacuucacccaagucagaauagcuauuauuaaauaaacaaacaauaacagauacuggcaaggaugcagagaaaaggaaacucuuauugacucaaauuggcucaaacugcuccucuacauaacuacuugucaccuucuucaaauuuuuauaaugccacucaugaguuugaaaucuucaguguaugggcaguguuauggauugaaucuuuguaucuccuugaaauccauguugauauccugacugcuagugugaugguauuagaagguguggcuuuggggagguaauuugguuaaaugaccucaugagaaugaaguccugugaugagauuagugccuucuuaagggaggaagagacaucagagcuuguucuuucugccaugugaggauaggagagucaggaagugggcccucaccaagacugaaucugccauuuccuuaaccuuggauuucugggucugcagaacugugaaaaauaaauuguugcuuaagccacacagucugugguguuuuguuauagccacccaagaucacuaaaacauacagcauuuacccuuuggaguaaugguccagcaauaucacaaacuauauaaacuuucuggauaauucugccccuaagaaugucagccauccucuuuccacauaugaaguguauuuuacuauuccuuaaaauuaguucucauguauguuugugacauaggauaucuaagcuacagagguuaaccauccuaauagccaaaaaguauucaagaauuuaugaccacauaagaugucacaaauauauuacaaagggcagcuuucauaauaugcuugggcaugagcccacacugauaauuuuaggaacuguaagaauggaagcuaugccccuagugacuugucugaaauagugaagauguuguucccacccaaaucugcuggcucacuauuguuuuauagcuguggaacauccagcaaguacagcauacaauagguccucauuaaaaucaaugaacauuuaaauucauuuuuuaguuuuaccaaaauauauuugauagaaaaguaagacauaguuuaacacaauaauaacagauucucuauuuucauggggcuuaaaggaaaugugcccaagauaauaggggaaaaccagacgaugaacaaaaguagaaacuagugguacagaaguuuaccauauuucaugauaaauucauugcaguuacucagaaaaaagauaagugaauguuuguguguauguaaccgaaauuucucuagcuccugaaaacaauuacaaacacacaaacacacacacacacacacacagacacauguguguguguguguguaauuuuggccaggcgcgauggcucacaccuguaauccuagcacuuugggaggccgagcggggcuggaucacgagaucaggaguucaagaccagccuggccaagauggugacaccccaucucuacuaaaaauacaaaaaaauuagccgggugugguggcaagugccuguaaucccagcuacuugagaggcugaggcagagaauugcuugaaccugggagguggagguugcagugaucgugccacuggacuggagugacagagugagacgccaacuuagaaaaaaaaaaguauauauauguauuuauauauauuuauauauauuuauauguauuuauaaauauguuuauauauauuuauaaauauauguuuauauauauuuauauguauuuauaaauauauauuuauauguauuuauaaauauauuuuuauauauuuauauguauuuauauauuauauauauauuuauaaauuuauauauauuuauauauauauauauauuuuuuuuuucaccaucuuggccaggcuggucuugaacuccugaucuugugauccaccccccaacccccccagccucccaaagugcugggauuacaggagugagccaccgcgcccggccaaaauuacauauuuuuaagacaguguuccacucugucacucaguuuggagggaaugacagcucacugcagccucaacuuuccaggcucaagcaauccucuugcuucagccuccuggguagcugagacuacaggcaugugucaccaugccuggcuaacuuuuaauuuuuuuuuuuguagagacagggucauaaaauggugcccaggcaagccucaaacuccuggccucuagcauuccuccugacuuauccucccaaaguucugggaauauuuauauaugagccaucgugcuuggcuauauuugauuuuuaaguaaagacugugaugguuaauuuuaugugucaacuugacuaggcuacaggaugcccagguggcugguaaaacauuauuucugucugugaauauaugggaguuucuggauagauuaacauaugaaucaguagaccgaguaaagaagaucugcccucaccagugugggcaggcaucauccaauacauugacaaucugaauagaacaaaaaggcaggggaaaauccaucuuguucugcccauaauaaacugaguguuaucugacucaccacaccauaaaguugugcaugcacugcaucuucaaauggaaaugguacguaugugauugauccugaggaggcccugaaugcacaaguaaguacaugaagaagugguccaaacagccaugguccccacuccugacacaugccuucuuuuucccagccugcaccucuagccucauggggaguguucuaugaaaguugacagagaaaaagaaaacuuuggccuuguuuacagaggguucugcacaauaugcagacaugaccugaaaguggacagcugcaguacuacaaccccacucugggacauagcugaaugacaguuguaacaggaaauccucucaaugggcagaacuucaggcagugcaccuguuuugaauuugcuuggaaggagaaauggccagaugugugauuauauaucaauucaugggcuguagccaaugauuuggcuggcuauucugggacuuggaaggaacaugauuggaaaauuggugacaaagaaauuuggggaggaaguauguggacugaccucucagaaugaaaaauaauaauauuugagucccaugugaauacuuaucaaagggugaccuagcuaguggagaauuuuaauaaucaaguggauaguaugaccuauuauauagauaccagucagucucuuuccccaggcacuccuaucgucauccaauagguuuaugaacaaaguggccacggaggcagggauggaaguuaggcaugguaugagcaacacagacuuccacucaucaaggcugaccaggcuaugaccacuguuguauacgcaaucugccagcagcagagacccacacugagucccugauguggcaccauuccccagagugaucagccagcuaccugguggcaaguugauugcaucggacuguuuccaucauggaaggggcaguguuuuaucuuuauugcaauagacauuuauucuggauacagguuuuccuuuccggcauacaauguuucugccaaaacuaccaucuaugcacuuauagaauuccuugauugcuguuaugauauucuacacagcauuguuucugaucaaugaaccacuuugacagacaaauaaaugcagucaugggcuaugcucauggaauucacugguacaacuauguuucccaucauccugaggcagcugccuugacagaacagugaaaugaccuuuuuaagacucaaguuccaauuccagcaaggugauaauaccuugugggguugggucaggguccuacagaagacuguauaggcucugaaucagcauccacuauaugugguucuguuucucugauagccaggauuuauggguccaggaaccaagcaaaagaaaugggagugguaccacucagcauuaccucuagugacucacuaucuacauuugugcucccuguuucuauaacuuuauacucugcuggccuacaggucucauuuccagaaagaagagugcuuccaccaagagacacaaugauaauuccacugaacugggagucaaggcugccacucagauaccuuguacuucucauguaucugaaucaacaggcaaagaagggaauuauugcacuggcuagggugauuaauccuuauuaccaaagggaaauuggacuaauauuucucaauguagauacgaaugaauaugucuggaauacagaagauaucuuagaacuucucuuaguaauaucacgcccugugauuaaggugauugaaaacuacaacaacccaaacuaagcaggacuaacaauaguccaggcuauucagauaugaagaucugggucacccuaccaaauaaagaaccaugaccaguggaagugauuguugaaggcaaagggaauaugaaauggguaguagaagaaggucguuauaaauaccagcuauaaccgaaugacuugcuaaaguaaugagaacugccaguaucaugaauauuuccuccuuauuuuguuauaaauauguugguaugcauauauacauauauuaagcaaaucuauuguuuuuccccucuccuauauuaugaaauguaauagauauugaccucauaacauuacauacaguccccagcuuaugaugguucaacuuaugauuuuucaaauguacaauggugugaaagugauaugcauucaauaugcuccucaacuuaugauggaguuaugucugauaaacccuuuguaaguugaacguauuaagucaaaugugaacuucugacuuaauaauauuuauaacuuaugaagaguuuacagagacauaagaucaccagucgaagagcaucucuacuuaguuauuguuaauuucacauccuaguuucuaaguuacgagauaucaagaguaaaaauuacuccaggauuuuaccuccacuucagaggaaagaauuaguuccauuuugguugcaggcaggauaguuguauaauguuaagcagaauuaugaucuuguuauugucuuuauuugguuauuaaguaugguucaaggaaauaccuauggguacccagugauggacuugugaugguuaauuuuacaugucaaccugauugggccaagcaaugcccagauagcugguaaaacauuacuuguaggugugccugugagaauguuucuggaagagauuaauauaggaaucaguagaugggguaaagaucugcccucaccaaugugggugggcaucauccaaucaguugagggucugaaaagaaaaaaaaaaggcagaagaagggcaaauucuaucauuucuccugguauuaggcaucagagcucaugguucuugugccuucacacucaggcuuggaguuacaacauugccucgucugguucucaagccuucaaacuuugaauuucaccaugagcuuucuugguuuuauagcuuauagaugguaaacuggugggaauucucuaccuccauagucauauggcaaauuuucauaaucuuucccucucucccguuaccucuuccucauauauaacuauauacauauauaguuaguauaguaguuaaguaguaaguaguagcuacaccuuguaguuaaguaguuacuauaguuaacuuuuaguaaagugguuaguuauauauauauuauauauauauauauauauuuguaaacuuguaacacuguuuguagacuuguaaacacugaaauaauuucuacauauucuauaucagcuaguucuacacauaaauaauugucucuaaagaaauaaugaaauauauuuaucauauuuauguaucugauaauauauauuuuauuuuaaaaaucaauuugacaacuuaauuuuuaucuuugcaucaugaaucaucauuuauuaauauggaauaaaugugaacugauauaguaaaugaaucaagugcaauaaucaaaugggaacuaaaguuuuaacucuaaaucauacuaaaaugguugugguauacuuccauaacucauuucaagcaaugcccuugcuuuacugggcacacuucuccuuuaucaaccgcuuguuugaccauugcaauuuauauacagucuuauuaauuacucuuaacauggcauuuuuauuauuuuuaaauuuucuacccagacagaauguaacuucagugaagggagaaacggcuguuucuuucaacccccagcauuaacagccaugcucgauacaugcuaagugcuugauaaauguauguuguuuauuaaauuaaacuacuucugauaugugucccauugugaaauaauguggagaggugacaaaauauuccaagaaauguaacuacuuuuacauaagauacugagaucaauaguauaauaaaaaugaggaggcuuauacugcugaaaacuuuuggugauuuacaguauuuggggaugcacccguaugcacacuaauaauuaccuaccucauuuauuuaaauguauucaaaauaaaaucaaaucuauaaauauuucuagcucuuuaagauaaagggacugaauuagacauugcuucaacuuucauugcugguacuauugaaucaaggcacugaaugcuacagaucucaaaaagaauuuuauugucauuauacaagguaaaacuugaauauuucaucaaaaauuucaggauaaaaaauguccccaaugagugaaacuucauuuuaugaaauuauuuuuaacaggguacaaaguaaaggggaucuguuuacuuccuuaaucuguauaacaaaaugagcagaauauuaucuuccaaaucgaacauaucauacaagagaauuuucacauaagugaaacuaggccauucugucuaauucaacuaauuucuauuuauagauaaggaacauuucaaauuauugguuccagagugaaacuggguucagacauacauguuaaauuuguuaaguauaaugaauuuccaaacuuguauauggaauguaacauauuuguuuaagaaaauaagauuucuuuuuauuuuccuuagucacauuuuucucuuaaaguucaaucaacuaaggaaaauuucauaacauauaaagugaucuaaaauuguugguaugcuauagaaauuuuuaacuauucugcagaaaauauguauuuuaucuucaaugucacuuuaccuaaauaaugagaaaccauuauggagccacaguuuuauaaaugcuuauaaagaguggcuuuauaguuuccuuauuuaaaacaaacaaaaaaaccauaauucaagccaugaucauuuugcaacaauucauuguccuaugguuggauaagguuuacuuguauaucuaauuagacugaacuucacacuguaucauuuauugguuagaauuuuuuauuguuuucucuuuguucaaaaaacaaaauuaucucagguccccuuacaaaaaaaaucuuacaauaguaauaguaaagcaauuauauaauuuuacugugugguugacaccauuccaaacacuuuacaaauguuaacauuaauuuaauccccauaacccuaucagcagacacuaucaugauuuuaucuuauaaacaaggagauacacaaggagauaaaguaaguuauacaggaucacaccauuauuaaauguuucugaaucccuccucuacauauugggaaacauugccucucagucccacucuaaccgaucauuguacauuuguuguggcuauuuagcuuuuuagggaacaaguuguacugcuacuaccgaaauuacaaaaacaguuggauacuuuccaaaaugucuaaauccaaguacaacaccugauauaggauaaaggcuugaggaaaaaguaaaaaaaaaaaaaaaaaaaaagaauucaaagacugugauuguauaaguuuguugauuauuaacagcauuuacuaauucaggagugauaauaaugauaaaugaaaacauaaauagaauacgaaauaauuucacaaaaugggugcaauuuuaaaauucccucaaggauacuuauguucaugaagauauugaauagacaccaugaaaauaguuuuugccucaauaaccuguuuuacauuuguuuacauuuuaauagucauaauaacaaaucaaaaggauuaaacuguuagccccagcagucaucauagacaaaaaauaauuccggauggguuauaaaucuaaauuuaaaagcuaaggcuauaaaagcuaaaacuauagcauuucuagaugaaaacauaaauauucaugauuucagagugaacaaguuuuuuuuuuuuagucaagauuuaaguguuaagaacaagaaaaaauauuaauagguaaaaguuuaucaguauuagaaacuacugcucuguacaggcagguuaauaauguaauauauuugacaauacacaaacugaacaagaaauuguaucuagaaaauaguuuugaaaauacccacaaauuauuacaagcgagagaaaauaacucaauuuuuaaaaauugggcuaaagacuuuaacaggcacuuuauaaaagaagauagcugaguggcacauaauaagaaaguaucuccauggcacauuauuaauuauagaugaacugcaaguuaaaacuucaaugagauagcccacccacccaaacguuccauuacgaaaacagacaauaacaagugaugccaagagugugguacgacgagaacucuccuacgaagccgguaggagucuaaaacagugcaaucaagauggaaaauucuuuuucaguugucauccuaugacccaccaauucuacuccuaggacauuugacugcaagaaaagugaaugcguuuuucacauaagaugacuucucuaaagauauuugcggcagcuuauucauaagagcccaaaauaaaaaaucccaucaauguucaucaacaggagacaggaaaaacaaccugugaucuaauucuuacggggaaauaauuugaugaaaaaauacuaucaauacuuuuaaaacaugggaaagucucaaaagccugagggaagaaagaagucagaugcaaaagaauacaugucaaguuaaggagcaguccauggugauaaaaaucauaguggucgcucauggggguagugagcagggagaugggggcuugucuggauaggagcaugaagaaacuuuguggaguaauagaaaucuauauccugaucuggauauuacuuacucagguacauagauguaucacaguucaugggacuguauauuuaauguuuaugcucaauauguaaaguacauaugaauaaaguacuguuaagaaaauuugagagacaaaccaguucuuccuauaacauaacuguaucaaaaugaaaccaaaacaaagucaauuaaauuuggccuucuuucauuucuugacuacaacuacaaauaaauagguaauauagggagaaaaggggaacauguuaaacaccauugcagugaugcaaucagacugaaacauacuguagaaaacuacaaaaacaaacuauucaguuucaguaacaaacacauuccaaggaaaaagaaaagacacacauggaauuaagccuaucaacuucuaacaauaugaaaauuuuauuuggauccuuuuaaaacaaaugcuucaaauuuaauauauauuuuauaaaauauagaacuuacaggaagauugaaaguuuaaauacuaaugaaauguuugaauauacuagaauauuuuuguuuaaguuugagauauaauugcaauuauguuuauguuagaagcuagaucuaaaauauuuauaagaauauauguuaaaaauauuccuuaauaaaagugaaguuuccaucaaaauguuuggaugacagcuguucuauaaugagaaaaaaaagagauaaagggaaauaauuacauaacauaucuguugcacauaaaucauaaauauuuuacuauguaaaauuugauguaguauuuugacuuauaugaauauaaacauuuauuugucuucuaauaaauuugagaaaguuuauuugaacuauacaacucuuauauuaucuuaaagaugaccucacaaaaagaguaaacauauuuuguccauuaucaauaaguauuugaaauauucuuaauuuuaaaaaucaauucuaaaaugacaaacaggaaacaaaaccuuuuaaagauguugaaggcaugugguaauuugcucauauaauuuguucaaggaacacaagucuagcuacucaccagacaaaaagcugaacgauuaacauaaaaauguaugacaucuauaaaaguuaauagccauaacaucaaaagcuggcaaauauaagagcugaauaaaaaugagagcuacagccugacaacuauuuacuucacaaucuagaaacaauuucuugagaggcuuugagguuuuguuccaaauucuucaucuuguuuauuuuagugagacuuaauuuauuacuuuggagaagcauauugauaucaaauaggaaaauuaauugaaauauguaugcauaaaucuauaaauacauuuuacuuauauguuguaucauuuaauaaaauauaauuuccuuaauuuuauguuguauccauuuacaucauggcuacaauacuuauagaauguuaaaucccuuuuuucaaugaaaaagauguuagaaaguaucaagcauuguugcagguuauucugccaacacuacccuuuuuuuauaagcaacacaaucuguuauuuuuuaaucaugucagucagaucuaguuguagauuuuugucucucaggauaacuaaucucuacuugcaauguaaauguaaucuuaauaaagcauucauaagacaaugaguuaaauaaauguguguauaguaauuuacuaauauagauauuauaauaugugauccuugagaaaauuacacuuugcaauugaaaaagacaauucugauuagauugaauuucucaucagaugaagagcucaaauuugcucauuuuucaccaaauguaaaauaucuucugaaaucaaggcauguaugacaguuaaacaaucaauuuuuuuuuaaauuuggccaggugcagaggcccauaccugugauuccuagcacuuugggaagccaagguaucacuucaggccagggguuugagaccaaccugaacaacauaaggagacccaguauauagaaauuuuuuauuuaauuagcuggcuaacuguauucauagauauuucauuuuuuuguagcuauuguaaaugagauugcguucuugauuugacucucagccuaaauguuauuaguauauaaaaaugcuagugaguuuuuguacauuuauuuuauauucugaaaacuuucaaaaguuguuuauaaguuccagcagccuuuuggcagagucuuugggguuuucuaacuauggaaucauagagaagagagauaguuugacuuauucuuuuucuauuuagaucccuuuauuuccuucucuugccugauugcucuggcuaagacuuccaguaguauguugaaagaucuccacaauaagaacuauaaaacacuggugaaauaaaucagacauaacaaaaauacauggaaaaacauuccauguucauggauuagaagaaucaauaucauugaaauggccacagcgcccaaagcaauguacauauucaauguuauaccuaucaaacuaccaaggucauucucacagaauuaaaaaaauaaaacuauucuaaaauucacauggaaccaaaaaagagcacaaauaaccaaaacaaucccaagcaagaagaauaaagcuagaugcaucacauuacuuaacgucaaacuauacuauaaggcuacaguaaccaaauagcaugguauugguacaaaaacaaacagaucaauagaucagaauaagaaacagaaauaaagccccacacccuauaaccaucugaucuucaacaaggcugagauaaacaagcaugcagaagaaugaaaguggacccuuaaauuuuaccauauacaaaaauuaacucaauguagauuaaagauuuaaguggaagaccucacacuauaaaaaacccuagaagaaaaccuaggaaauuuccuuaucaacauuggccuugacaaagaauuuuuggccaaguucccaaaagcaauugcaacaaaaccaaaaauugacaaaugggagcuaguuaaacuaaagagcuucugcauuuaaaaaaaacaacaaaaacaacaacaacaaaaagacuauaaacagaguaaacagacaaccuacggaacaagagaacauaucugcaaacuaugcaucugacaaaggucucaucuccggaaucaacgaagaacucaagucaacauguaaaaaacagauaacuccauuuaaaaaugggaaaaggacaucaacacuuuucaaaagaagacauacaaguagcccacaaacauaugaaaaaaugcuuaucaucacgaauuagagaaaugccaaucaaaaccacaaugagauaccaucucacaccagucagaauggcuacuauuaaguaaacuauaacagauguugaugaggguguggagaaagcugaaugcuuacauacuuuuggugggaaugaaaauuaguucagacacuguagauagcaauuuggagauuucucaaagaacuuaaaauagagccaccauucuaccuagcauucccauuacuaggcacauacucaaaggaaaacagauccuuauacaaaaagauacaugcacccaaauguucauugccauagcacugaacaugaaacaucacaagagcaaagauaaugaaaucaaccuaggcgccuaucaaugguagauuggauaaagaaaaugugguacauauacaacaucuaauacuacacagucauaaaagaaugaaauaaugccauuuguggcaaacuagauggagcuaggguucaucauuccaaagcaaauuaaugcaggaacagaaagcuaaauacugcauguucucauuuauaaguggaaggaaaacauugaacauacauagaccuaagaaugggaauagacacugaagacuacuggaggagggagaaggagggggcaugcaucguaaagcuaccuauuggguacuauacucacuaccugggugcaauauacccauguaaaaaaccugcacauguacccccuguauugaaaauaaaaguuggcauuuuuaaaauaauuuuaggacacuucaagcauauaugauuauuaacuauguuacgucaucauguuguacauuuccagaacuuacucauuuuauaccugcaaguuuuguaccuuuugaucaauaucuuccccuucucaucaucuaccuccugaauucugaugauuucuuuuucacaguuuuuauguuuaaauacauaaagucuauuucuaaaaaaaaaagaaaaaaaaauauuggccaggcucgguggcauguauguuccuguagucccagagacacagaggauugcuugagcccaggauuucgaggcuucaguaagccaugauugaguccagccugugcaaaagugcaagauccuguccuaaaaaaauuaaauuuaauaaaguaacaaaaaggaacaauguuccuuuuaauauaauaugaaauuuucauaauauauauauuuaggaugucuauaugucuaguaaaaaaauaaauugucauuaaaauugagagauucagguauguucaucuccuccauaccaggcacuggcuucacaucucuugauccaccaaagaaacuucugggaauaaauguggcacagaaaaaaagagcacaaaauuagaucagcuaugaaauauuugacaaguuuuuucuuuccuucccucucuucuuuugucguccuuauucuuccuuccuucuuuucuuccuauuacuagaugcacacacaccuuauauuaaaacagauaacuuaauagcauuuauaacauucuaauuuaagaguauuaaaguuauucacaaauaaaauguaucauguaauguguaaauauuuaaggaaaauauuggaagaauauacuuuuuguuuuuuuuauuuuauaugagaauuacaaguuuaagugcuugcaauaaccugguagaggcaauauagucuaaucccucauuuuauauauauuacgggacuuagauucaaaaagugcugggacagaaaaaucuuaacucuuuuucuucucaaaagaguacuugcuguguuucauucuuacuucuuccauauuuuauuuucaguugucuuuuucaucccuagcugccaaacuuaauuaccuaguuaucagaauuuauuuucuuccauucuguaaucuaagcagagauccuuucucuuuagucauauccugggcuuuagcuguuaauuguuuccaaacuagaucuauaguguuacauuucuguuugaccuaugauuuuacguuaauuuuucaugcauucuaacauuaccauuuaauaguuugcucaguggaacauuucuucaguagaauguugauaaauacaucuaaaaaugauucaaucaaaaauaaucuuaguagcuuuauguuugaaguaaaugucuaagguucuuuaaaacaggaauucuuagagcuuuuuauauaagauuaaaucucuauaaagguggcauaccacauguggcacuuucuuuucuuucauguaucucucucaacucacuccuuuaguuuuuaaauaaauaugugaucuacuguucugauagcccauuuuguguaaaacgguauuaaaagaaaaacaauauucuaaaaguagcuaauuuuauuugaggauuaugcacauuaugcacuaaauauauguguuuuauauuauauaugccauugccagguacucugcaaaaugucuaucucuaaguguuuuauggcauuucagccgaagugucuguguuagaaaucauaagauucaagaaggccucaauuuuacauaauacacauacgaacaugucuuuaguaguuaaaugccagauauuuauauaauuauuauugcaaaaacuguuaucagauacuguuccaagugcuuuacauauguaaucucauuuuauuucauauuuuguuagagugauauuuuauuuaaaauuuuuauuuguauaacuuuauaagguacaaguguaauuuuguuacauuacauaguggugaagucagggcuuuuaguauauauaucauggcaauaauccacgucguauccaugaagucauuucucaucauccaggccccccucauucccccauuucauaacaucuuaaugugauaguuguuaucacaacucuaugugauuaucuccacuuuguauaggagaaaacaaagcuucacagauacuaaacugcuuauucaaaaccucucagguuacaaguggcagaacagaacuugaagcuagaucuuuuuaagucuaacguuuauagcauuuuuuucauuaggcucuuucaaugcccuaugagaaaaccaaucaguuccuuaagcaagaacauagaaauauuaaacuaagucaauuaaucuucauuuguuuuuauauuaacuguagcaaauauuagauauaugagaccuaauguaucuuuuagacauacauaagaucuauauauaagauaaaaauuaagauauuaagagaaaucuuaaauauguucuuugaaaagcaguaacucuauccauauuuuagauaugcuauuuugguuaggcaacagaaauauaaauagauuccacuuuuaaaguauaacaaauaaagucuuucuagagagcacaaauuauugacacauucuaaagauacguuauuucuaaacaauuaugagggaagaguuucauuacagucugguuuacaaauugaaaauaccauuauaaaauaauacugaagcauggaaagugaaauaaauuaugcguacuuaucaaauaugacugcaaauuuccucauaaggauacuaaacaaauuuaaugauaaaguuauauuugaaaaucaaacacauuuuguaagaaauauccuauuuauaaaaacugaacaaauagaacaaaaacuaucauaugaaauauugagaauuuggauauuagauauuucaaagacaaauauuaaauuuucaaagacaaauauuaaaauuuuuaauauuaaaaauaaauuuguuauuaaaaauaacaaauaucccuuucaauagauucuaaauuucauuaaucuuuuauuuacaagaguucucaucuguuuuuccuuauauuacauauuucaauuaauuuguauuaucuuucacucuuauuucccuauuuauaagcacugugcaauuauuucacuuaguacucucgaauuucauuaucacauaaaagauucucaugauucauuaaugagucaauuggaagaauagcuaacauuuaccuacuguuaagugcuauauauauaaaauuuuauuuuauauauuauauauuauacauauauguauuuuauauauuauuuaauauuuuauauauauaauuuugucccuuguauguacuaguauuagucuuauuuaacaagagggaacugaggugcugauuguacaguaagcccaagguaacauggcauguagauacuaaagagggcaauggaagcuggguuucugguuacagaguuuguucucuggcucuucuacacugaguuagcauggucaaauuuaaaaugugagcaacagcaagggucucagauuuuacacucauguauuuauuuuaagagauuuuaaauaaauaaucccccuauucuauaaauuuuuaaagcaaaaauaaaauuagucacugcaaaaaaaucuagaaaugacugacacuaagcauuacaauaaaacaugaugugagcuauacaugucaggagauuauaguaaaaauaaaacuggagaguuuugauuuaaugucacuaaaacuugcuuugaaaugaagagcaguaaugucuauuuugaguuuccuaaauugcaaauuugcauucacauguuucuaacaacuucuauuccccacauuacccuagcuggaauagaaugauaauauuaccagauacuauucucuuuugaaaacauggacucuuguccaugacaaauaauuguaacauauaucaggaaggaaaaaagucugaacuagcaucauuauacaauucuuucuacuaauguuagaauaaaagcugcugucacaguuggaagccagcuggagggcuaauuucccuccaaagaacacgcaaauaaguucaaugauuaaaguuuuaaagauguauaggaguucaauauccuugcucucucuaccugguuuucuucagucacuaauccauaauccauuaagauuuaagagauccaacugaauuagucuuauuagaaauucacauuccuuuaaacuuauaucucaacaaaaagaaaaguucucagauacaaguuaugugguccuuuauaaggacacgaauauauucacaauacaacuccaaguauuuaauuuaaaaaguuaacuuagaagaagaccaagcauuguguuucauuaugccaaaaauauacauucuauuuugagcuaacaugccacuuuuaguuaacuuacucuacauacugcuuauaacuucuucccaucauuccuuuaauuuaugugauuaacccuguaaacacagucacagcaugcuucuuagaugaaaaugauauuuuaaaggcuacuaaaaaguagcaaauguaaauuuaaaaaaaucugcauaguaaauuuuuauuguagaugucuuccucuucuuaagucaagcauuuugaaaggcaauuauucaaaaacauuaugagaacaaacuaaaggcaauaauuccuuauuuguguaauauuaaagaauuauuuugaaaaauuacauuauauuuaaauuuaccugaaauuugaauaaauauaauguaauuuuaauaagaaauaaaaaauauuaggcugauuacuuugaugagggcauuucucagaaaauacguuugacaacugagaaaucauggaaguuugaacucaggcuuauaaacuaccaaauuucccuuacucuuacaaauaaaauuaaaaaaaacaaucuaagaagugauaagaaagcagauugcaaaagaagugaaaaguuaagcccagucagguuauauucaggcuuggcuuguucaacugugaugugugaagucaaauuugcaccuguccugggaucuguguguguuggcaggggacgcugggacccgagcucacacacuuuacagagcugcauuaucaaccaauaaugcaaccuuugacaugucaccauuucacaguauguugaagucugacgaaauggaaaccacuagaauguacaacugaauaauuuacaggacucaaaggccaaagucuuucucuuucccacacuguccccuaccaccaugugacugugaaauguaucaccaagugauggauggauagagggagaacaaaggauugugagcaaaaauauuggaacuuuuuuauuuuugaauuaacaugauucuuaacaaaaagcauauguacucaguuggucucaauaaaauaucugagaauuuuuuuuuccugaacauccucuaacuuuaaacuuggugauaaugcacacauuuuagaggcaguuauguucuuuugcagagaagccaaaaaggcuucuauacuaugucacccugcgacagaggaaugaacagaggaguccucagagugcugccuuggaauccugccacugugugauggcagcuggugauuaauaaucuucaacgaaauaguaauucaagcaggacucggcaggcccaccaacucuaggguucuaacaguaaaaucaguauccacuaauuuucaauaguccuuaaaauaugcagucauccuacaaucaguuguuuguauaauaccugauaaaagaccuaugcaagacaggcagccuguccaauuuaugauuuaucaggcaccaauuuuuaacauaauucuccaagcaugaauucauucuuaucaacccauuuuuuucagaaaacagaaggugcucaucacuuacucuacuaugauguacucaaaaaguucuuaugcaaauauaauauuguuaaauggauacuuacaugacaaaaccagaugcaauaaacucuaguaaauaaaaugacuuuucuaaggauuaauugguagcaacaugguguaccugaaaucauugaaauacugaagaucauuuucaaucacuaaaaauguauuucaaaaauguuaguuguauugaaauguucccuaauaaaaauuagcuuaaaauuguauauauuuuuguaaggauuuuuacccuggagauuauauaaaaguuuucaacguauuuucuuuccuaaagguauagagugaauuccacaagaauuugaaaaaauuccauaauuucccauagcucaauuaaaauacaaacaacgcagauuaaaaccccaaacuucaaauauuuaaggaaaaaaaaacuuuccgaauaacaccuaaaaucccaagaaacuuaugagaaauaacaaagagauguuccuauacuuaaauuugauuaagaaacaauaaagacauauauaaccucagaagagaagauacagcaaauauaucuaaguuacaaauaucgggagucuaagggcaacugagagcauaucuuuagucucaaggauacacauaaacaaacuagacugccuuccuuuagccaucacaauuuaaaaacaacagccgaaaucaaacucaaagugcugcuugcucaaagguccugcuuacuuugaggcaguagauacaaaguauuuuugugucuguggauuuuuaccacuguuuuuuaugucuggaaacuuuggcucggauaccaagcaaauauuguaguucaagacaauuaaguauucucacccagaacccuauuucucuacgucacaaaaucaccaugcacuuggcauuccuggcagcuuuuggcacagugacugugggucagagcugagaagaucuggcaaugcaguuuggggaaagcuucuuuauugcagcugcaaauacuucugucugacccagugaaucaacuuaaaucucucaauuucucucucucucucucucuuucucucucucucucucucugucucucugcaacgaaugcaugcgaauuaaaauucaauuuuagauauuacacugaaauacaaaaucagugacuuuucaguauggccugcaaugucugaaaaaaaaaaaaaaagaaaaaaaaaagaaauguuucuaauauauuuucccugucauuuaguuucuuccaucuuauuaaaaugcauuaacauaugugccccaaacacugcuuugacugcuuucauuuucuguccauaucuucaaaaauugguauuuauuuaaguaaugauuuagaauguuaaauguuaaucaguaauuugccucuuaguauuuuuuucuggaaguguguguuucuacaccuuccucuaugucuuugcagcauuauaaagugacaucuugguuguacgugaauaaaacacagauuuuguucaaaugcaaaagggcacaugugccaauaaccuugaguguuaagcaaaugcaguacuuuguggcagccauagcuguggaaguuuuaagagugcccuaggaacaauacaguuacaauauucagcucugacaugauucuguuguacaucaccuuggaaaacauuagaaguucaaauuuuuaaauuuguagagaauaaauaagacauaagacuccuauguccuuuuauaauacuguaggcccaccaaucacauguggcccaggacggcuuugaauguggcccaacauaaacucguaaacuuucuuacaacauuaugaguuuuguuuuuuguuguuuuuuuuuuugcaauuuuuguuuucuagcucauuaguauauuuuauauguggcccaagacaauucuucuuccaauguggcccacagaaucaaaaagauuggacaccccugcuauagacgaugguaaaaacagagagaagagagguaaacuugugcuuaucuauuucaguucugccgauuuccucucuuuugugaaaguaauaaucuugauggugauucauauagugaaaaugccaaauucuccagcaucagaaaaaaaaaaaaauaguagaaugcaguugacuuggcaaaaugaugauuucuguguauuuagagcaccuuuaguuaaguuuaggauaaacugguaauuuuguuuuuagcuuuuuaacaaauauggccauuaugcccuuaaguuuaaucuauggauauucugguccuuugaaaauguaaauacauuuagacacaagcuguaccccaaaaucauuauucaaucucuucaaaaccucaaaccugagauaaucagaaauccuuaccucauuuuuucuccaugacaucacaaauaaugauugacucaagaauaguggaaaacagaagacagagagaagguacgaauauauaaaccagguaguuaggaucuaggaauucguuauauguaguugaaugaaaaauuuguugcuaucuaacaaaaugaaaaucuucuucucccuuccaaccucuccaucuggcucuuuuguuuguucccuuuguugugucucccaggaguucuaaaaugcaccauuugcucuuuuagaggcagucuaauuuuccaaauuuaaguuguauuuucauaaagcuacugagaaacaaaguuuuuuuuucccuuucacauuauaggggaaauacuuauugagaugugucugcauacucaauauacuguguucuuggcaacaaacaucaaaucagaaaaauacaaugaaaaauugaacauacauuagcacuuauuauaugcucagaaugugugucaugcaccagaaagagcuuauggcccuggguucaaaguccaagccugucacuucacgucugugggacuugggugcugcauguucacugacaaagauuuaauuggcuuacuuauguaggggauuuggugcuacaucugucucaucaauucaagugcccuucuaaguuacuguuaauuuuucccauuguaucuuggcaguaaaugauuuuauauucuuauagauacuaggggauaaauuaaaauaugaaaugaaauaaugaaauccgaaauuauuuugccaugccauaaagagaaaacacuguaaaaauuguuaauuaacccaaucuacuuucaauguauaauuuguagucauggucuuuggcuauuucuucccuuccuucacuucuuccuucccuuccuucacuucuucccuuccuucccuuucuucacuccuucccuuccuucccuuucuucacuucuucccuuccuuuccuuucuucacuucuucccuuccuuuccuuucuuuucuuucuuucgagacagaaucucgcuccguggcucaggcuggagugcaguggugcgaucucggcucacuacaaacuccgucugcaggugcaaguaauucucaugucucagccuccagaguggcugggauuauaggugugugccacuaugaccagcucauuuuuguauuuuaguagagacaggguuuugcauuguugaccaggcuggucugaaacuccaggccucaagugacaugcuugcaucagccuccaaauucuugggauuacagguguaagccacugugcccggacuggucuuugaauuucuaagugcauaaaaaccauauaaaggaaugaaaauacaaaauuaaaaacuauuucaguggaaaaauagguaaacugaugcccuuuuaaagaauuauuuuaauaugugauaaaagugauaauagucuaauuccaaaaaacagcuaauuguacuuagcaaggaugcuaaaagauauaaauuuuaaggccauguucagauuuuaaagcgcaaagucuucaaauuuaaaugaccuuugaaauagugaauacaugaaguguuugaaauucugaacaucaaugaaauauauuuuagacagaacaaagcauucauuauuucuaauuauuauuaaaaacugagaaccuuucagccuuuuaaaugugaagacauuauuuguaguugauuacaguaacacaaaguguuuucuugggcagaaaaaaauugaacacaaaaucaagcauauccaauacccuugaaaagcuauuaaaacguucauuggggaaaguguucuuuuaucaacaguuucucuugcgacuaaaugaaauauccuauaucaauguagauaucagaguuuuggauuugauacaagauuugacaauauccuaaaaaucuauucaauauacuuuccaugcagaguugaagauaggcaaacagauaugaaaguaaaauuguuuaauguuaaaaacauguuuuguucagcugcaacccaaguuaaauaaaaacucuacuuaaaacaaaaaguuaaaacucuuauguacaaaugagacuucucuaucacaauuacaggauuucuaauuuaaaaaaauaauuuaaaaaaugaaaacaacauuugaaaguauuuaaaauuauuuuccuaauuagaaauccugugauuguaagagaaguaucauuuguacauaaauguuuuaaauuuuaaaaagauuuaaauuuuaaaaacacauaauagaaccuaaccuguuauuuacagguaaaauaacucaaggguuucauucaaguccugacuaacgauagauaauccuagagcucaguaaaccagcacuaagcccugggccuuugcuuuaugucacauucuaaauuaaggcuuaucuauccaucaucucaaaucagaguuuacuuucuacccuuccuucugguguuguauggacacugaucugaguucuauaguuuuuggaagauacauauuguuaucuaaagcaugauuuuuauuauguugacuuugagagccuuuagcagauaucugaauuuuggggcuuuagggaacauuacaaaacucauuacuucugaaagagaaacaggaaaaaaagagaagaacagagagauagaucucuuguuuuuuucuuuuuuuuuuucucauuauacucauuaauacucacuauaaaaaaagaaggaaauaguuccuuccuggaauaugauaacccuuuauacagaagcuuuguuauuuauuuuaguucacaauuucaaugcauagaauacauuaauuaaucccacacauggauguugucuacaauuggauuauaguuuaaaaccaucuaauuuaguaagcauuuauaguauaacuuacuaaucuuuccagccuccguaauguauuuucuuccuacuucacucuuaucaaugccuaauuccaucacaauaaaaugccucacuagaggaaacugacaaacuauuaauguuacaaauaccuacuuucgguuaagaauaaaaagaagacacaagccaugcucuaaagauguuuaggauuuagcgagcuaaaaccaagaaaaaggcugauuacaguauaggaaaauaguuccugcauuaagcauaggaugcuguggaagaacuaaagagaggaauccuuaggacaacacaucagguuaaggaaagcuuucauauguagcaaaggcuaagucccuaaagaaaaugacacuugagcaguuacuaaagagugagaagguuuucguggggcagaaaaggagagacuuguuauuucagugggaacuacaaguccacuuacaaguacaaauaacugagauauaagaaguugaaucuaaguacucuaacucauuauaugugcaacacagaauacacacggaguuugugaugaaguacaaggauggagaaauaagcuaugcaagcaucaggguagccauuuuuuauauucugcucccucaaaacacauaaucagagcaguagauaacggcuacaccauguucaacagugauuuccuuauagccuauuuuguaaaaugacagaugucuagacccgagauuucacagugggaacauagacaauauugagugcagaaauguuuccaaaaugaauaaaacaacauuuuaucacacuguuauaauuaucugagcucaggaauuauucuaacacuacuguccaaauggauuccuauaagcauugcauuuaaauuuuauaaauguuguuauauaauaauauaaaauauauaauuuauaauauaauuauauaauuuauaaauauguauuauauaauauaauuacugauuuuauuauauaauuacuuucauuguguuauugugaauaaaaccuacaauuuuaucuucccuguucuucccaguaaagaacaagaaaaaaaaaaaagaaaaaacauauuuuaaaauaugugcuucaguuauguuagugaucuaacauucagcuauuaaaauuuuaaaaaucuaauuuuuauacauguguagaacccauuuucccauauacacacuaacaggcuuaugccuuuuucuguucaucacuucuuuauauauuguuacaaacccuuaacacguuuucuggcuauuugaggaaaagaaauugugucugacagaaagaagcauguuauauccaauuccauuuuccaccucuuuccccuucacuuuugacaccuuucugcaaaccucagugcuuaauugaauaccuaggggagucgccugugaaacauuuugaaguaguucaauggggaugauuuauagcaauauauaagaugacagauguacugaggagguuugaaaugaucuuauaugguguccauacuaagauggagcaccugauaccaugguacuauuuauuaacauuccaaaauaauagaccuuauuaagauucucagacucugacaccuauaaauguugcauaucugaggacauaggacugaccuuuuucuuggcauacauacgagaaaaaaaaauucaauggguugauaaaguacacuuuaaaacaacaaauuauuauuucuacuguuuaaucugagguaacauauacaaagacaugauggaauauuuacuauuccguauuuuguaucguuuuuucacuauuaacuguaucuagugagcccugggauuaugaauauaagaaacaucaagugauauuucugauuaaauauugaaggacugauaccagcaauuauugcuuuuaccucuccagcagccaccugccaccccacaauuacuggcacaaaauaaaauucuaacacacaaagaaaaagugaaaggaaaaugauuaaaagaaaauaaaagauuucaagugauuuggagacgacaggaaucauagcaaccaauuuaggagaauggacaguuucauauuaaaugccuucaaugggaggaacaauaauaauagauccaauuugcccucagagaagcccagauuggaggcaugagucccuguggaaguuaugggugcaggcauggaugaaaacaaaaguauuugcugaaaguguguaaacagaacaguggggccuggcgcuauggcucacgccuguaauccuagcacuuugggaggccgaggcgggcagaucgccuuuccucaggaguucgagaccagccugggcaacacggugaaacccugucucuacuaaaauacaaaaaauuagcugggugugguggcugugccuguagucccagcuacucgggaggcugaggcaggagaauugcuugaaccugggagguggagguuguagugagccgagaucgcaccacugcacuccaguccagacucagucucaaacagaacagaacaaaacaaaacaacacaaaacaaaaagaacagggaggaauuuccagugcccuucuuaaucuuuuacugcugucaucuuuuucccucucccaugccacauaagaggagaaugcucucuggagaaaauaagugggagcugcuccgugaucauggacaccagaaggaaacaggcaccuucuccugcuggcuaaugagagcugauuguuguauccuuagaaaugugguaagcaauuguuaaacauaggcauuauuaauaauuaaauuauauaaacucucaauuauauuaaggacaaagaugauaaaauaaaaauucucaucuuccuaauuauuuuacuauuagcuaugcucucgaucauauuuugucuguaucuguauuaguaugguggaaauacuauacaauacuauauaaugaugugucacugcacaucuuuuaacucugcacucaguaaaaucacacugauagcucaaaugaaauuggccauagugucaauauuuacacacuuauggaaaucagcaaacacuacaaaucagagcuugauuuauuguuuuguuguuugucuagguuuaauaaaguaauagugaaaauauaaauaaugcaggcaaaccuaaaaguguguuguaucugcugcucaaggugauauuucaguuuaguaaauauacuuuuagaagaaugagaaauaguuuaacaguagaaaacauaucagaagaaauuuucauaauuuuauuguauaaagaauuagugggcugggaugcaucaccaauggccaaauuauuauuaaauugcacaaauauguuggcuauggauauaagaaguuagcaaaaaucagugaaagcauucugugagaaucaauuggcuauagagaauguacacucagcuaauaauuuacuaauaacaguaaaauauuauuuguuacacuucuuuuauauuagaaaaauuuacaauaaacacauauauauaacauauacaccuacauuuuaaguuauguuuuuguucagcgaaccaacauuaauuagcacaucacuggaaaacaggaacaaguagguaaaaacggagagauuuaaguuaaaaauagagaauguaagcuaaagucuacuaugaaauuggacccuuagcuuccuucauucucccugcuaccagaugcuaacauccacugccuccuaaaauacuguuuguugcccauuccauacguauacuauagaucucuagguccuugauaaucucucaugucuuauaaccuguaucuaauuuuuaaaguauguuuaaugcucuauuguugauucugcaaaaugucuucauaucagucuucugaucacuaugguucucuucagcugugcuuauucugcuaacuuuccagugaguuuuuaccuuaguuauuauauuuccuauuuccaguuguucucuguuuucuucauguguuuuguuuuauguuucccuuuucuccugauucuggcugguuguuugugaauguauuuugcuuuuauuaaugauuugacucugucuuauuuguuuaaacaaauuaaccauaccuauuuuauacuuugcuucucauuuuugucugcugucucucacccauggucccuugaucccuuguguauuugauaauuguuuugugauuuugcuuauguugugguaucuucucugugagaaucauaaaaugcauggguugaagauauaacacucaaggaagauuuuacauauguuuuuguaaaauacuugggaaagcccugaguccauuuuaaacuuaaucuagguuuauuuccucugcacuauacaaauaacaugugcuaaggcuccacuuccacaugacagccuucucauacaauaaauucucagaagagauuuuucuccacacuccaucuaaagucaaggcugagacaaauuucauacuccccacuuccccuuuaaucgcuauguuguuugguguuuuuguguuuuucguuuuaaacuuacuccuacugauaguccuuugugcauucaagauuacacaaccugagagaaaaccccaaccacccaugggcccaaaucucuuuuccauacgcauugcaaagguccaugaaaagcuuuacauuaacaauauuauacuuaaugauuaaaaccuuguuaaagguuacauuuugugugaugcucuuaccacaauauuuaaaaaucucuaggccacucagguucugauuauagauacccccaugcuaagugacaucuucaggauuaauacuaucuucauuugucauauggcuugguguuggacuuaaaugagugauugaguuacuuauuuugcugaaagcucaucaaugcaucaaaaauauuauuuuuguauuuuaugcaguauuuuagguauuuuguagcaagugaaaauuaggauaucuagacuucccugaugccaaaaaucagaucucuaaguauaauccuguaaaacagaauuuuaaaauguaagugaaaaagcaaaauguacacagaauaaaagauucaaauaaaaaaaucuugaaguacauggcuaaucguuuuagguauuaucaauuaucuauuuuauuucugauuuuuuguauuuuucaaacauuccuccaacagauuuauauugcauuggagaugagaaacagucgcaauuuuacaauaauauaggcuagcauaagaaucacuuuguaccagacaucguuguaaaugcuuuacauuuauuagcccacuugauugucacaauagacuccugagguaacuaauauuguuauuuucaauuuacagauaaaaaaucuagggcugaaaaauuuugucaaguucauaaaguuaauaagugauugguuggguuuuuuuaaaugcaggcuuucuugauauaaagccugugcccuaaccacuguguauuacuaucucauaguauaaaucgaaacacuauuucccugguuccaauucaaauaucccuuacuuagaggcaauagucugaagacucucuuucuacuuuugccucuaauuaucuacuugaucuucagugacucacauauuuucucagaccucauuuuccucaaguguaaaauuagugauuuaagcuagauuaaucucugaggaucuucuagcucuaagauuuugugauagcacaauccuauuagacaauuauuucuugaguaucaugaaauugcaaauuaaccauuuaauugaaaaauuaaugugaaaaacuuuuaaauuaaagaaaaaauuaauauagucaagcauucuaagauuuaauaauguaagcucucaggaaucaagauaacuuucaguauauaaaaauacugaauauuucucuccuaaaugauggcaggaacauuaaacaaaaauauacuuucaggcuuuuuagcauauaaagauauuaucacagugagaaaaugaauuacucuaaaaagguauaccaccaaaaauuuaaguuaacuugaaaaauuuagugacuuucuuagucugaacuauuaaggcgauaaaguaaccagaggaaaucacaauaugucuuuaucaaacugaauucuucuuaguauuaccucuuuuuuaaccuuucagauuguauuuauacucuucaaauuuuuuuccuuuuuaauaaaauaaucucauucauaguagguuucuguauguauaaaucaauauuuagucuguacuugaaaggugaaaauauucucuauuauugcugaaaacaagaguauggggauauuuuaaccuuuuuuuuccuuugguugaagauucuuaaaugguucacaguggccuuguuuucaaacauucgaauuuacugagagaaacucugaaaggaaaaguuuaaauguaauguuaucucauaugacuuccugauagcaaaucuauaccucaaaacuaauuuggaaaaaaauauuuugaugagaaauucaauacgagcauuccaucaagagauauuuggcuguuauagcuuguccaaucaaaagacacaacaugcuaaccacaaucacuuuacauccagugaucaaaacagaaucuuauacuauuuugucauuugagaaaacaccauggaucaauaacugcaaaugcuaugaacuaaaaguagauaauaaagcuaugagaaaucacucauagcauguuguugugagcgcagcuuuggagccagacugcccgaguuccucucuuauacuuaauaagauuguuugugccacuuuacuccaccucugugugccuuaaguuucuuguguauacuuuggauaauuaaaacacuacgucauaggacuguaaggauugaaugaguuaauacauaugaagaauguagaauaagacauggaacauaauuuauuuaauuaaugcugaauauugugaugauguugcugcugugcuaccuuauugaauugaaaguagaaaagaauaauuaucuacaguauguucugcagucuauaauaccacaaucaaugaugcuuaacauaguaaauucuaggaaguagcuuuaccggauauguuuaugucauuguguguauauguguguuagguguagggacugcagacuaaccuuuuauauagcauguuuugaaaaaacugccaaaaauuauaaucuuauagaauaugguauaaaauaucaguuacauucauaaaguuuuuuugaauaauacauucaaguaaaaacuugaguuccaacucaaugguucugccuuucacauaaacagaaggaacaugacuguggguguuagcggugccacagcuuuuacugugguaauuucuccaggauaaucauagcagaaauaaaaauaaauaaaucuugcuuacauuaacagaauaaauuucuucuucaagcuguuuugccaugaacacaugccacuacugucucugacuaccaagauacacacauuuuauuccacucaaauucuuauugcacacaugaucacagauggagaacuucauauuuucagaacuuagcucugugcuuacauauaguuuucaguuaauaauuaaguaaauauuauggcuuuguuucauguaucuuggaugaaucacuuuuauuagccaguccagagagugauuuuuuugaugguauuaaucuuuuuuuuuuuguacuuacuuauccuugugucgcaggguuacacugaggauaagcaggucauauauauauccuaagauuuauuuauuuauaguucagaugcuaguacagaacuuucuaaucauaugaagaauacaaaguacuuauucuauugaauacaauauuaauugaacauauugccuugauguacauaaacuaaugcaggugaauguuuuuuauaaaauaacuauuuuaaaauauuuuuauaaugaaagauaaucagccugaaaucuuugaaauuuuauuaguuuuuuauagaccaauuuaaaguugauuuaaauauuaauucuagaaaacaaguuuuucaucuucaaaagauucccaauagugaugaaccuuauuuaaacuaacaaaauguuuuuggaagacacagaagcuucagcuucagccuagcaugggccugcuuguugauaaauauggcauuuaaaaacaaaugccaugacuuaauaauucacauagacuuuccaaucuaucaccuauuggauauuacaauaaaccugugaagucauuuagguauuuuuauccccauuuuacagcucaggaauauguacuuagauaaauuuccuaagagucagaggcaggaaugaagcuaaugcuuuagacucaaaauuugaugcacucuccacuuuaccauuaagaugaugacgaugacugauccagaccaagugguaaauaauacacucuaucaaugcuaucugauaaauaaaaccucuuaaauaucuuuaggaaaucuuuuuuaaaaaugagggacugauguucacuuugaacaaguguauuuugggaaaucccaaggggaaaaaauaguauuauuccaaaaauguuaaaccacuuaauuuuccccucauucuuauuacucucuuguacagaaauauuaccaaaucucuuaaaauauccuccuaaaaucuccuuaacauauauuaggagagucgggaaagagcauccacuccaagagaauuuuuuucuuucugaagacucauucacucaagaguucuuaaaguuauaagaaaauucagaaaauaaugccuaaccaugaaaacaguaaagcaacauccauaucuaaaauugugaccuuuuuaguauuggcauuccuaauauuacaggaaaauaugaaaugguuauuauaaaaucucuuacagauucuugcuaugaaaucucagguuaauucuuacuaugacucagaaauauuauccaucaucucuaauugacucuccccaguagcauuuucaaaucuuuuucacucugcacuguacuuccacauugccucaauuauuacugagauuauuauaaccacuccacaugaauuuccauuuuccucuucacuaauaacaaacaugauuguucuauuagcucaauaguucaauguuuaacaaauuucuccucuuuagcuccuuucuaaaccaaacugucaucauaaucucucucucuucgaauuuuuucucuuucuucagaaaauuucuguguguuucauguuucaccaaacucuagcuauucuuauguauuuaccuucaucauuaucaaacuuugaagaaaaauucuacuuacaguauuuaauccuuuccauccacucacuccuuacugcugguacugcucuucuuuuaaaaccacuacuaccauaaugaaaauucucuccauaauuuaauuacuugguuccuuaucucuggaauuuauggauuuuuuuaagagaugaugucucgcuuuuugcccugcgcuaagugcagugauguaauauaguuuacugcauccuugaacucuuggggucauacaauccucccaccucagcuuccuauagcugggacuauagguaugcaccaacuauucaucuauggaguuuuuauacaccugauccaagcaacaucccaucacaguuaaaauaaccacaccaaaauaaucauuuuuccuuagagauaauauuuugcacugguucaucuuuuaauuuuaaacuuuuuuucccacaaaauguaaauaguugccaaugaguuucucuucucucauauguuuaucuuugacaaucuuguccaauaucacaauuuuaacuuuucacccucagacaauaaaaucuuaaaccaucacuucaucuuuccuuuucuaaauguguccugagaccuauauucagacagggguuaaaaucucagcucuaaucuaacaucaggaagaauagcuaauggaugcuggguuuaaaaucugagugaugggauggucugugcagcaauucaccaugacacauguuuaccuauguaacaagccugugcaucuugcacauguaccccucaacuuaaaagucagaaaaaaaucucagcucugaucugagaaugccuggguuaaaauucuuuuuuuuuuuuuuuuggcauucuuuauuuuguuccucuagcuaaugugucuucauuauuauuauuauuauuauacuuuaaguuuuaggguacaugugcacaauaugcagguuuguuacauauguauacaugugucauguugguaugcugcacccauuaacucaucauuuagcauuagguauaucuccuaaugcuaucccuccccacuccccccaccccacaacaguccccggugugugauguuccacuuccuguguccuaauacugucauauauuagcuauuuuauuuugguacaguugacuaaucuggcucccuuuguuuccuauuauaugcaaaguguuauguaaggaguaacuaauaauuuacauaaaacucauaacuauaucuaauuauaguaacaauucaauaaauaugaacuaccauuuacaauuauuucccuauaucugucuuuccuucuauguucuuuauuugugcuaauuguauacuuguccaguuaccaaaugccaaaugcuagaagcguucuuugagucucucuuuuacuggucccagauauauaauaaguuauucaaguccuucccaagaccuccuguaacauagcuucauaguagcuuacuuuuuucccuucugauaauaacuauccugagacuuuauuaguuuccauuuggacuauuacaagacugcugacugguuuuauuucaguuuuuugacccuuaauccaucacuuacauuguaggcagcuauuuucuuuucccugaagcacaucuauaaaucaugucauuccaucacucaaaccauuccacucuuugauauuaccuaaagauauuaauuuagaaaccuuaguuucacauucaaaaucuuuuacuagcucauuucaaucucccaugccagucuuaucugguccucaaaauagauaguauuccagacuaaccacacuauuggcuguuaucuacccauaauccacauuucugacauucuucuuuucaucagaauuaccaugaaaaguaaauuucauauauugccuauaauucaugaugcaccuacaaugacacuuauuccauaaaaacugaaucacauggucuaaauuucucuaucccuccugugggggaaaaaaaaaggcauguguaacuucgcaaauggccaaauaaggagcucagcaaaucuccuuaaaggcaaugauaaaacuaaauaaaacucaugugugaaacuauuuaaggauucuaaaaacaaacaaaaaaacaaagacauacaacaaauuggaaaucacuuauuuaauagcaaauacugaaaauacugaacaucacauaagaagagugugucugugucauuuuagcaugacacugaauuuuagcauggcauugaaagccauaaaaaccaacagcuuccaugccgggguugggaggggagcugauuugauuuggaaugguguguagagaaaacaauacucagggaauugccaaaaaugauaacaguuuugguauuuaaaaaaaucaaggaaggccaacaucucaacaaaccugagguugcaauacaagcuuggucaagcaacagauuagaauacuagucagaaauuuuacaagaucugaggaaugagacagcaacacagugguccuugauaaacucuauaagccccuccuggucugggaagcugcauauauuagcaaaguuaugcauaugcucaggaaauacuggagagggcucuagcugccuacauauugcuucuccaacauaagaccuugcacugucacagaagaaacacaaauagaauuaucaaaaugcaaagccaaggcaugccaacauagugccugaacuuuaaauaaguuucuccacugaccuaucagcaaagaguggaaaauuuacucauacuacguaaacacaagcucugaauaauccuuggcugaccauuaagcuauagugacucaaaagcaacuccuagauauccaggcuuaaaaaaacaaagacaaauucaaacaaaaacuaaacagagauaucagagagaaagcaauaaacggcauccaaauuggaaaggaggaagccauauuguccccacucucagaagacaggaucuagaaaaauguaaggacuacacaaaaucucucagaacugcuaaacaaauucaaaaaguuucaggauagaauaucaacauucaaaaaucaguagucuuucuguacacagacaauaaauuaccugaaaaauaaauaaaaaccauaaucccacuaacaggagauacaaaaguaauaaauuaccucggaauaguaaguauuuauucaaugaaguguauaguauuuggccaaggagaugaaugaucccuacaaagaaaacaacaaaaugcugaugaaagaaacccaaaauaacagaaacaaauggaaaagcaucccauacuuauggauaggaagaguuaauauugcuaaaaugaccauauuucccaaagcaaccuauagauucaaugcaacucuuauucaugacauucuucacagaauuggaaaaaaaucucuaaacuuuguaugaaaccacaaaaggaucuauauagccaaagcaaucuuaagcaaaaugaacaaagcugaaggugucacacuaucaaacuucaaaaugugcuacaaagcuguaguaaccaaaacagcagggugcuuucguaagaacagaaauauagaccaauuaaacagaaaagagaacccagaaauuaauccauacaucuacagccaacugauuuuugaaaaaggcauccagaacauacauuaaggcagagacaaucucuucaauaaauggugcuaggaaaacuggauauccauaggcagaaaaauaaaacuagauccuccaccuuucacacuaugcagaaauaaaauagaucaaagaucuaaauguaagacuagaaaauauauaauuuuuagaagaaaacauaagaaaaauauuucaggacauugauuugagaaaauauuuuaugaggaagacuucaaaacgccggcaacaacacaaaaauaaacaagugagauuaugucaaaccuaaaagcuucuacacugcaaaggaaacaauuaacagcauaaaaagacaaccuauagaauggaagaaaauauuugcacacuacucauucaacaggggauuaauaucuagacuauaaaagaaacucaaauuucucaacaacaacaacaacaacacaaaaucgucuaauuaagaaaagggcaaaugaccucaauagacauuucuucaaagaagacauauaaaugucuagcaaguauacaaaaaaaugcucacuaucacuaaucaucagggaaauuaaaaugaaaaccauaaugauguuguaucauacuguaguuuuaauggcuauuaucaaaauaacaaaaaauaaaaaaugcuggccgggauguagagaaaaggaaggaaaugaaacaaaccaaggaaucuagcaacagauuacuggauaaaaaaugugguacacaauacauuaccaugcagacauaacaaagaaugauauccugucauuuauagcaacauggaugaaacuagaggacauuaagugaaauaagccaagaacagaaguaaaacacugcauguucucacucauauaugaaagccaaaaauaauuuauauaauggaaguaaaaaguagcaucacacagcagggccugucggggaugggggacaaguggagggagagcauuaggacaaauaccuaauacaugcggggcuuaaaagcuagaugacggguugauaggugcagcaaaccaccauggcauauguauaccuauguaacaaaccugcacaaucuguacuugcaugcuagauccuuuaaaaaacaaaaguagaacugaggauacuagaggguaguaaggguacacagacacaaaauuagagcuagauaggaacaaauucuuguguacuauagcacuguaggauauauauaguuugaaacuauauauuauauaguuucaaauaacgagagagaggauauugaauguucccaacauaaacaaauaauaaaguuuugaaaugauggauaugcuaaucacccugaucuauacauuaguguauauaaucacuauacauuauauguaucacacaacacuacuagguaccccauaaauauaugccauuauuaugggccaaguuuaagcaucuuaaaagacugccaaaaaugcacaaaagauuuagcagagaaugauucucuagaaaaaaacagcaaucaaaaaagcaaacaaaaauauuaacaaauaucaaaggauugcaaaccuaauaugcuauaauauauuaucuaaauacucccagauaucaauaaauacaaggaagaaauucaaugucccuguagucaacaaauacaggaacacuguaugcuaagucuaacaacugguuuuuuucuuugaggaaaaaaacaaagaacaaaaacaaaacauauauaauaacaaaaacacacauauguaauaaugauguaauaagagucucugaaagaggggaaaaaucuaaagaaauuauggguaaaaauuuccccaaauuucaagaagcuaguauuaaauucauauauucaauaaguucaaugaaucuaguuagcagaaaccugaaggcauccauuccuagacagaucauagucaaacuacugacagacagggccaaagaaaaaaacuuaaaggaaacaagagaaauguaacucaucaguuacaaugaaaccauaauaaauuagcagcugauguuuuacaagaaacaaaggaggccagaaggcaguggaaagacacugcuuaaacaaauaaaaaaaaaaucugucaaccaagaauccuacauccaggaaaacuauccuucaaaauugaaggugaaaucacaauauuaccacauuuuaaaauacugagagaaucuauugcuagcagauuuuucuuccaauaaacacuacagcagcacucauucugaaaggaaaugaaaucagacacuaauuugaauccacucaaacaaaugaaagaaauggaaaagauaauuaugugggcaaauaugaagauaguguacauaguuuauuuucucuuuucuuuaacugauuuaaaagaaaugcauaaaucacaauuacaaaacuguguuguugaacauacaacauauaaagacaauaacagcauaauaacagugaguagaaauaacaacaguggguagaaguuauucgagcaauauuguauaucuuacuggaaucaaguuaauauuaaccugaaguagacugugauacauuaaggcacauauuguauaccuagcacaaauagaaaauaauucauaaauauauaguacaaaaacuaauaaggaauuaaaaugacacauuucaauuuauauauuuaacaaaaagaucacaguaaaaaagaauagccagaauaauaugaugagguauagcaauaaaaagcacaauucaggcaaaaauccaaugauaugaaauauuacaauaauauaaauaauuuaaacaccuauaguaaauggcauaaauuuugagacuggauuaagaaaaaagaucuaaucuuaugcugucuguaagagaaacacuuuaaaacacaaauacaaauagguggaugguauaacgaugaacugcaugcaaugguaaccauaaaagaauuaguguagcuacacugauauuaugaacugaauuguuuccucucaaauuuauauguugaagcccuaagcuucaaugugauggguuuuugaagauggugucuuucagagguaauuggauuuagaugaggucaauaggcagagcccucaugaugggauuaguguccuuagaagaaaaggccucagagagcuugauccuuuggguuuucaugcuuuguguuucucccugccccaccccaccucgguauguaucaaagaaagaccauguuaggauacagugagaaggcaggcauuugcaacccaaggagaaagcccuuaccaggcacuggaacuguuggcacauuguucuuggacuuuuagucuccagacuuuuaagaaauauauuacuauuguuuaagccacccuguuuaugguauuugguuuuugguagccugaccagacuaagauaauuaacagcagauaaaauaaguuuuaagguaaaugagguuacuaaaagaaaaaaaaaaaacauagcaaaguauaaaagacuaaauucaucaguaaaauauaauaauucuaaacauguaaauaccugaaacugagaccuaaauaugcgaggcaaaucuagaugacagaaucaaagauagacuagggaauucaauaauaaaaugcuauugauuuuaauacuugcuuucaguuauuaauagguaagaaaucagcaaggaaagacaauaccagaacaagucuaucaacaaauuugaccugucaucuguaguacacucuacccaauaauagcaaauacacauucuaucaagcacacaugaauauacuccagaauagaauacacuggacuauagaguaagugucaaugaaucaagaaugauugaaaucauacaguauucuaucuggucacauagggaaaaaacagaaauaaagauacagaaauuugagaaguccacaaauauucagaaauuaaacaaugcacccauuggugaaauaaauuacaagacaaaauuggaaaaaaaauuguugaacugaauaaaagcagaaauacaacauguuuacauuuauagcaaucagguaaagcaguguuaaccgcaaaauuauggcuuuaaacgacuuuauuggaaaagaaaaaaauauccuaagucaauaaccuaaguugcuaacuuaagacagaaaaaaagcaaauaguucucauucauauuuggaagcuaaaagaaaacuggucucauggaagcauaaaguagaacugaggaugcuggcagcuggaacguguagagaggaggcaggauaggaagaaauuugucaaagcacacguaauuacagcuagauaaaaugaauaaguuccaguguucuauagcacuguaggaugacuauaguuaauaauaauauaugguuucaaauagcuagaaggaggauauggaaugcaccaacaaacacagaaaaacaacuguuugaagugauggauaugauaauaacccugauauaaucacuauauauuauauguaucucaacaucacuauguaucacauaaauaugcagaauuaucaugugccaaguaaaaaaguuuaaaaaacaaaaauaacacaaauuaaacagaaguaaggaaauaauaaagagcaaaaucagugaaauaaaaaagaaacacaaaggagaaaaaucacuacaaucaaaaguugauucauuugcuagacugacaaaaauuuaaagaagguacagauugccaaaaucuggaaugaaagagaaccucucuaccaacaagacaggauuauaaaaaaaauuaucaacaacuucauguuagcagagcagauaaaauagacaaauuccuagaaagacacaaaguaucaaacucacucagcgaugagaaaaaucugaauagaucaaagcaaguaaauaauugaauaaugcaaaaucuuauugcaaaaagucuucagaacauacugcuaacuucuaucaaacauuuaaagaaggaauaauaccaauccuucacaaagccuucuagaaaacaaaagggaaaggcagacuucccaaguuauuuugaagucauuauuaaaauaccaaagaaauacuaaaacaucacaagaagagaauaucacagaucaauauaucucaugaauacagauucaugaguccuuaacaaaauauuggcaaacuaaauucaguaauauguaaaaaauauuuuacuccauaaccuuuaaagacuuaucccaggaaugcaaauuuggcugaacaucugaaaaucaauuaaugcaacauaccaucucaacagaauaaaggauaaaaaccacaugaucaccucaaugagcaaguaaaguauuucaaaaaacucagcaucaauuaugauuagaaacccucaacaaacuaugaguauuaggaaauuucuucaacaugauaaauagcaucuuuggaaaauauacagcuaacaucauauuuaaagcucaauggcuaaaugcuugcuaccuaauauuagaaacaggaaaugguuuuuacuuucaaaauuccauucaccauuguucuggagguucaagccacugcaaccaaaaaaugauaaaagaaagaaaaggcaucuagauuuaaaaggaaggacuguaaauguauuuauuugcauaacaugauccuacuugcagaaaauccugacagauccacaaaaacuuuaacaaacaauugaguuccucauggccauaaguuuucagaucaaaauacaaaaaauagaguuuauucauuagcaagaacaauauaacuacaagaaaugauuccguucacaauaucaaaaugaauaaaauccuaagauaaccuaauagaagagcaagauuuguauaaugaaagccaaaaaaaucuuucugcauagaaauuaaagcagauauaaauagguggauauguauucuaaauucauaaauugaaauacucaauauuguuaagaugguaaucauccccaaauugauuuauacauucaacagaauuguuacuaauuucccagcaugcuauuuugcagcaacuggcaagcugacaccaauauuuauaugaaaacaaggagaacucaauaaccaaaaauaagucgguagaaagaaaaaaaguguuggaaaacuuacaguucaagauuucaaaacuugccauaaagcuacaauaugguacuagcauaaagacaggaauuuagaucaauggaagacacgaguauucugaaauagacuccuauauucauggucaacauacuaucaacaaaagugccaaaauaauucaacaggggaaaggauaaccuuucuaagaaauaguucagguuaaauuggauuuccccaugccaaaacagugccucauaccauacucaaacacaaacacaaaauaacggauagacuuacauauaaaaguuaaauauaggcauuuucuagaagacaugaaaaaaaaucuuaaugaccuuggaauauauucuuagauacaauaucaaagcuaaacacauaaguuuaaaaaauaacugcagcaaaauuuuuaauuugcauuuuaaaauacuccacuaagaaaauaggggggaaaaucauggacuaguagaagauacuugcaaacauguaucugauuaaaaaaaaacucuuaucaagauuauaaaggaauacuucaaaauaaauaagauugucaaaaaaccucaaauaaauauguaugcaugauuggaacaagcacuucaucaaagaaaauacacagaugucaguaaaaagauacucaaugucacuaaucauuagagaaauacaaaguaaaacaauaaucagauaccacuucacguauuuuacaaaaguggcaaaaaugugaagaaauuggugggaaugugaaauaguacacagcuguccaguuacauaagaagguaaacauuaauguaucauaaaacugagcaauuucucccuaaauaucuacccuaguaagaugcuaugacugaauguuuguguccccucaaaaguucauauguugaacacuaaugcucaguguggauuaauuuuaauacagggccucuaaggagguaauuaagguuaaaugacggcauaaggauggaguccuuaucugauaggauuagugucuuucuaugcagagaaaucagagggcuugagcacacucuguuuucaugcacacacaaagaagagaucauaugaguacauauaaagaggguggcccucugaaaccuaaguggagaguccucaacagacuucaaccuggcuggcaccuugaucuuggacuucucagacuccagaacuguaagaaaauaaauuucuguuguuuaagacacccagucuguuguauuuuauuaugcagccuaagcaggcuaaaacacacacacacacacacacaugcacacacacacaugcacacacacacacauacacacacauauacacacacacauauauauacacacauauauauauacacacacacauauauauauacagcuacacacacacacacacacacacacagacuauucaauaaauauucauuacagcacuuuuccuaagagaagcuggaaacuaaguuucuucaauuauugacuggaaaaacaaaaugauauaucccuauaauagaacacuauucaucauuaaaagaaaaaaaucuugucacuugcuacaacauagauaaacaucaaaaacucauucuaagaugccagacacaaaagauuuuguauuaucuaauuccauuuaaugaaaugcccagaagaggcuaaucuauagaaacaauucgugguuggcuugaagguaguauggaacugucaauugauuggacuugagagagcuuguugggugauggaaaaguucuacaaauggauuuuggugauggccauauaacucuguaaacuuacuauuaauaguuuaauuguacauuuuaauaagaugaacuaaaugaugucucaguacagcgugaaggacgaggaaguggaaaaggagggggaagggaaaggaaaagaagaaaaugguaaaaaacagaaguggagcaucugaguucucagaauuggauauccuuacuaaggugggcagaaugauacuucuguuacauguagugaaauauuuagagacagguaugaucguuauguuuaggguuaaaaguggaacaauaucacacacauaaaguggguauuaaauaagacagagaugccuuucucuuacucauagcaguccagccagggcaacucuucucuacaggagaaucauguuccuccuaucuuguugcucagucauccccuaaugcauuguccccaucugccugguaaaaccugggucccagcaacguaaauauuccaggucauugaaagggggugucagucuaaggcaaagagcuuguguuuaaguuggaaugacuuggaaguuguccacaccucuguucacauuccauuggcccucuguauaggaucaaggaaagguaugaaauguaaucuuauuugggggaccauaaacccagcuaaaacucugcuacuguagaagaggguaagggacucuuuugaauaguuuaacauuguggaugaaaaguuuauuaaauuaugguaacagauaauagugauaauccacauacauuuucaauaguaaagagauuaugccuaauuaacagauacacuggcucucuuuucaagaucagaguuucuaaauaaaaucaaauaugcagauaaacugcaucuauaguauguguaauuuugauuuaaaaaugaauuuucaaaacaaggcagggugugaaaauauaagugacugcaaguaguggucagauaauugaagaagguauucucaaagauaugacaguuacaugauaaauggaaauaagguacuaauguggucacgagaagaaagaaaaauuauagugaucuacuauuauuauauauauauaauauauauuauuuccaguaacuguuguacacucugcuuuccacuggagagccacaucacuuuugcccuuucaucauucaggucucugcucaaaagucaucuucucaaaaagcgauuuuccugaccacuuuauuuuaaauggcaccucaccaucaucaugauuaugccuaguaugcuacuucauuuuuuuuaauacuaacucuucaaucuggaauugucuuuauuauuuuuuuucuucaacuagaauauacauucccagagagcaagauauuguguuuuacacugguaccaugaauuccuagacuaauacuuggcacauagacacucgauaaauauuuguuacauuaauuaaauuaaugaaaacuuaaccacauaguaaggcucucaagacugaaauaauguuaaauaaccucgagcagacuguuauauauuugguaccaaauauuggggauacacuaagcauguaaggaaaaacaaguauuucaagcugugugugaagaacagaaaguaagcauaccaacaucagugcuucucaaaauccucuaacacuucaucuuuacuaaugaaaacuuuauaacuuacuguacuuuguauuaugacuguuuacaucuauauuaauguuauuuaugucuuuuauuugcuaaacaacaaauuuuugaagccagaaagcacauugaugcaccuugguauuuagcacuuacaguauuuugcaaauuauaaguucucaauauauauuugggugaaagaauaaaugaacgauuaacaaaguggccaauuuuuacaaauugaagagcuuguuuuauucagaauaaacaaaccucaauggccacuuguaauaaucagaccaauaaaaauacuuauguuaaaacauuaucucacuuaaugaaaaaaauaguaaccauaaacuaugcauauaaaggaaccacaguacaugauauugauauucuuuaucuacuucugucuaacucaguuaggaaaccauccauguuuucauguaagagcacagcaccaugacacucugaguuauagcacacaaugccaaauguguaguaaaacuccuuugagagaauuaguuaauacacaugcauagcacuuuuuauauuauaaaacuugggcgcuuaucucuuucuuuaaugugaaaagcaauuacuccauugaagauguagaauaauuauuuuaaaauaucacuugcucuuaaaacacaguggaggcauuguaccuuugaagcggcaucuuugaacucaaaccauuuucauuacuuuugcugcauuuuaaaagaaauaauaagacuuugguauaugaagauugauaucuuuauuaaugucuuuauuagucuucaauuuuacuugcugaaucaugagucuuuccaugcugaauucacuauugcaccacuaguuugggaaagagguguccuugaaguugggaauaggacacagaucuugagagaaaaguuacuguuucuguccuugcagcaugauguuuacauucucaauaucuuccagccccuaccucccauuuuucuaucagucgcaaggauuuauuuuugaauauaccugauucuguugcuuagacuuuuucuccuuucagaaaggaaagcagagcuuacuacuuuucccuuucauuaauuuuuuccuuccccccucaacuugccauccuuaguuauaagucaccucuuuuucuacugaacuuuguauuuuguuucuccuucacagaacuuacacauauugccuuguuauccuauuguuuacgcacacauuuuucaucuucauucauaguuuaaagcuuuggaagagguagagugcuucuaaguuaccucuacauucuucgcuaauucuaccucagugucuugugcugaaaggcugaacaauguugaauuagugauggaguugagaaccuuauuauacugaucacaucuuguaagaccuuuccuacucuucugccugcucuacugccugguguuuggccauuugcuguucauuagcacuuauuuaaugaguaagucugggaaacaaaaagauaugagaugcaaacaggucuguuguaacucguuacuuucucauuauuauucuagguaauaggugacagaaaguuaccaagcaaaagaaaaucuuggcuaugaaaaauguucaccaguaacuugcgguucuuccccacccccaguaacuuaauaaugagucuaguuuacacaguauaacgcuccuacaaagaaugaaauaaaggaaaaacacugaaaaauucuuaucacaaaaaauaaaauauuaagaaauuuuugaauaacugauucaucaacuuccuuaaccaaaguagaggcuuaaaagaagacauuuuaaauauauaacuucagcauuaacauucguguuuauuucauuugucauauuauuuaaauuaaaaauagugauguuuccuucacccacuuaugccuaguguuccauuauuggaacgcuaagcaugugggaguuauuuauauccugcugcucaagguaauuaccaaggucugauugcaaaaauucaaaaaauugcaaccaggcauaaaugaguaaguucagacacucaacuaugcuguguauuggcaauuuggagauagcuguguuucugcucagacuuacugccuuuuggaaggggugcugccacucaguaucuccaacaucaugucgaccuuugcugcaacauuaaaguguccaugaacauacagauuuuaucuugcaaugcacagaagcuagaaaucuuugugaggcacccuuacuguguuuuguaaugugauacauagauugacuuuauaauacaaucaaagauguaacacuuucugauuagauuagacaaauaugaguuaaauaaugauguugguuaaaauuccaauagaaaacaauggcaacucaaaauaggauaauuuagguagggcuucuuuuucaauggguuaaauuacgcaggucuggguggagugcagccaacgaaaggggaauagugcaaaaacccagagcuaguagcagugaggugguaccaguuccaggcccaaaggauaaaggacaagacagugaauuucaagagagugauacagagcaggaugcaucaagagauacaucaauuuuguuugagguacagucagcuuaagacaaccacacacagaagacagaaaauaaaugccuuaccuucuuucuucuuccucucacugaaacaugccugaaccucccaaucagcagacuuaaagcgaaacuaguguucuagccacuauucuaaagguuccagguguaauaaguuaaccuaacccagcuguugcucauuuucuucaucuguaaaacgcuaauaagaauaguaacuaccuuauaccucauaagucaguauaaagaucaggagaaaacaaaguauuuucaacaguucauuggaugugauaaguuaugaauaaaugucucuuacuauuggcuuuaucaaaugaggcucuuuuguacaaguguacagaaaacuauaaaagccacaaaaugagguuucuuucuuaggauucaauaauauaucucugugaauuacucuguguuagaagaacaggaaaacugaguaaauuuauuuucaaaaacaaauuuugguauuuauuuuaguuuuccuggaaagaagaacacuuacaggaaaagcucuuauguuuccauaauuaaauucaaaaucagaauuauagcaggugaauuuaaaaucuaaaaaggguccaguaaaaaagucuccaugccaaaaugucagugagaucugcaggaauaccagguuuuccuucggaauacacaccauguccaaggggaguauaaggaaccaaagcugauuuagguaaaaaacucacaaguaauaugguugacaagcaaggaaugacauugaugauggaaauaaauauuuguaaggcaacagaauaaaaauuugaguguccacaagaacauauaguuccucaacacagcaagcuccuaccuccaaauuacuuucccauaugaaauagcuuggaaugcuauucccuucauauuuucaugucugucuacuacucaaccugaaaucuuaaagguuuuuuguuuguuuuuggcauccaucaucaucaucuuauaaaaaaugagcccuugauuuuaaaucauacacauucuaccuguuauuuuaguaucauuauuuuaugucacuuguuuccacuauaaauaaaauuaucaacuuuucuagaucucuuuguauauugccccuaguagacuauacauuccuugaguacuugaauuaaauuagucuaacucaucuguauaaaucccaaucuaguguaccgugaauaagaaguauccuacaaauaagugaacaauuaugauucuuauuuuugaaagaauaaauugaccuuggaaauuccuaguuuccgucauuuggccuccccuucucuuauuuaagcauuaagcaguuuccaaagaaagaaaauguacacugguguauuaguccauuuucauacugcuauaaagaacugccugagaccagguaauuuauaaaggaaagagauuuaauagacucacaguucagcauggcugggaaaggcuucaggaaacuuacaaucauagcagaagguggaggggaagcaaggcaucuucuucacaagguaucaggaaggagaaauacuaagcaaggggaaagacccccuuauaaaaccaucagaucuugcgagaacucacuaucaggagaacagcgugggggaaacugcccgcaugauucaauuaccuccacuuggucuuuuccuucacagguggggaauauggagcuuaugaagauuaaaauucaaaaugagauuuggguggaaaaaggaagccuaacuauaucaacuggugauuuauucugugcucacauggaucccuggcauaaauuguggguaagcugaaggacagugguuugacauaaagccugccuguuuccauuuugucagacauaauaaauaggauuaaaaaauauuuuauuuuaaguucugagauagaugugcaggacaugcaggcuuguuacauaggcaaauguuugccauggugguuugcuguaccugucaacccaucaccuagcuauuaagccccacaugccuuaguuauuuauccugaugcuuucucucuccauaacccccaaaaguccccucccuguuccccucccuguguccauguguucucauuguucagcucccacuuauaagugagaacaggugguguuugguucucuguuccuguguuaguuugcugaggaaaauagcucacagcuccauccaugucccagcaaaugacauaaucucauuccuuuuuauggcugcauaguauuccaucauguauauguaccacauuuucuuuauccaguuuaucauugacggucauuuggauugauucuaugucuuugcuauugugaauacugcugcaaugaagauacgcaugcaaguauuuuuauaauaaaaugauuuauauuccuuuggguauauacccaguaaugagauugcuggguuaaaugguauuucugguuuuaguucuuugaggaauugccacacugucuuccacaaugguugaacugauuugcauucccaccaacaguguaaaaguguuccucuuccuccacagucacaccagcaucuguuguuucuuaacauuuuaauaauugccauucuuacuggcuugagauaguaucucauuguuguuuugauuugcauuucucuaaugaucggugauguugagcuuuuuuucauguuuuuggccauauaaauguuuuuuuauuuuauuuuugagaagugucuguucuugucauuugacuacuuuuuaauggaguuguuuuucucuucuaaauuuguuuaaguuccuuguagauucuggacauuagaccuuugucagguggauagauugugaaaauuuucucccauucuguugguuuucuguucugaugguaguuuauuuugcugugcagaaucucuuuaguuaaauuauauuuauuugucaaauucugcuuucguugcaauugcuuugggcguuuucuucaugaaaucuuugucccucccucuauccugaaugguauugccuagauuuucuuguaggguuuuuaucauuuuggguuuuacauuuaagccuuuaauccaucuugaguuaauuuuuggauaagaaagggguccaguuucaguuuucuaaguauggcuggccaguuuucccagcaccauuuauuaaauagggaauccuuuccccauugcuuauuugugucagguuuguuuaagaucaaaugguuguagauguguacucuuauuucugagaucucuguuguguuccauuggucuguguguguguuuucugucaguaccaugcuguuuugguuacuguagccuguaguauaguuugaagucagguagugugauggcucaacuuuguucuuuuugcuuaggauugaauuggcuguucaggcucuuuuuugguuccauaugaauuuuaaaguaguuuuucuaauucucugaagaaugucaucgguaguuuaaugggaauagcauugaaucuauacauugcuuugagcaguauggccauuuucauaauauugauuauuccuauccaugagcauggaauguuuuuccauuucuuuguguccucucugauuucuuugagcagugguuuguaguucuccuugaagagguccuucacuucccuugcuagcuguauuccaagguauuuuauucauuuuguagcaauugugaauuggaguucauuuauuauuugacugcuugucuguuguuuguguauagaaaugcuuguuauuuuugcacauugauuuuguauccugagacauuguugaaguugcuuauuagcuuaagaagcuuuuggacuaagacgaugggguuuucuagauagaagaucaugucaucuacaaacagagacaguuugacuuccucucuuccuauuugaauaaccuuuauuucuuucccuugccugauuacccuggccagaacuuccaacacuauguugaauaggagucgugagacagggcauccuuguuuugugcgaguuuucaaguugaaugcuuccagguuuugccaauccaguaugauaccggcuguggguuugucauacacaccuguuaauauuuugagguauguuccauugauaucuaguuuauugagaguuuuuaacaugaagggauguuggauuuuaucaaauuccuuuucagcaucuauugagauaaucaugugguuuuugucuuuaguucuguuuauguaaugaauuauguuuauugauuuguguauguugaaacagcuuugcaucccagggaugacaccuacuuguucauuguggauaagcuuucugauguguugcugaauccgguuucccaguauuuuauugaugauuuuuacaucgauguucaucagggauacuggccugaagcuuuuucuuuuuucuuuuucuuucuuuuuuucuuuucuuuucuuuuuuuuuuuuuuaaaucucuggcaaguuuugguaucacagugaugcuggccucauaaaaugaguuagggugaagucccuccuuuucaauuguuuggaauaguuucagaagaaaugcuaucagcuccucuuuguaccucugguagaauucagcuauaaauccgucuggcccugggguuuuuuuccuugagaggcuauuuaugacugccucaauuucagaacuuguuauuggucuguucaagaauucaacuucuuccugguucagucuugcgaggggguauguguccaggaauuuauccauuucuucuagauuuucuaguuuauuugcauagagguguuuauaguauucucugaugguuguuuguauuucuguggggucagugacaguaucuuuuuuaucauuuuucuugugucuauuugauucuucucuuuucuuuauuauuucagcagguggucuacauuuuuaaauaaauaauaauaaauccuggauuuauuuuugaaguguuuuucaugucucucccuccaguuccucucugaucuugguuauuucuuguuuuauguuagcuuugggguuuguuugcucuuaguuuucuauuucucuuaguugugauguuaggaugucaauuugacaucuuucuagcuuuuugaugugggccuuuagugcuauaaauuucccucuugacacugcuucagcuaugucccagagaaucugguauguuuucucuuuguucucauuaguuuuaaagaacuucuugauuucugccuugauuucaugauuuauccaaaagucauucaggagcagguuguucaauuuccauuuaguuguaugguuuugagugaauuucuuaaucuugaguuugaauaugaguucacuguuguaugagauauuguuuguuaugauuucagcuauucugcauuugcuaaagaguguguuacuucuaauuaugugaugaauuuuaauguaagugccaugcucugcuaagaauguauauccuguuauuuguggguggagaguucuauugauaucuaucagguccacuugaucuguggcagauccugucuagacugccucuuuaggcuggacccugacugauccuuccucacuggauggggccucccugcaggaauuucagcaacuucaggcaggaguguagggacagagcucuggucucucugggguuaagcccuuugggggagggacggcuguggucuccauggaucaacagacuuaguccuuccugguggcucugaggaaucuaggcaguccagauguaugggagugcccccagcacagugcacuuccucuaccaaggggcagccagagugcuuuguuaagagguccugcaucuuaugccuccugacugggugagacucuccaacaggggucaccagauaccuuuuacaggagcauuccugcuagcaucaggucgguuucccucugcgacggagaucccggaggaaggagcaggcagccaucuuugcuguucugcagccuccacugaugacaccuccagguaugggaggggcccaagugaauagggucugaaguggaccccgagcaaaccacagcagcccuacagaagaggggccugacuuuaaaagaaaaacaaacaacagaaggcagcaacaacagcaucaacgaaaaaguccccauagucagucaucauuucagucuuuuuacacaaucccguaguucuuggaguuaauauagagauaaaacuuugaacugugcaacacaauucuaaacacuaaagcuuacugaacaaauaaauauaacauaauaaaagcaggauuucugagcagguagaaugaggcuaauaugacaacuucucaucccuugaccuguaagaaugugaccuuuucuguuuuguguauuaauuuuuaauccucuaguuacccucucucaccugagcccucuauaccuugcucagguuuaauaacaugaaugaguacaugagaccacuucagaacuuucuguuuguauaaguauacauucaaaaauacaaaaauauuucuuagcauucaagguaauacuauucaagaauauucucuauacuaagauuguuucugacuuugauuugucaacugcuuccccaccuacacccuccccuaaaauacauucugagaaauauauauauauauauauauauauauauauauauauauauauauacacacacacacacacacacauacaugaaguauugcccugucgcccaggcuggagugcaguggcgcaaucucgccucguugcaauguccaccucccagguucaagcgauucuacugccugagccucccgaguagcugaaacuacagguguauggcaccaggcccagcuaauuuuuguauuuuagguagagacgggguuucaccguguuggcuagaauggucucgauaucuugaccucgugauccaucugccuuggccucccaaagugcugggauuacaggcgugagccacggugcauggccuggaauauauauuuuuuauauauaguagacauuuuaauguauauuuauguuugaaauauagcuuaagaaauggacuuaacccaucuaaccaucauaucacguuagucuaucaaagaccaaaaaguaaaucuguuuugaagugaggcauaaauucuuaagaaaauaacaugauaucauguguuuuugaaguacaguacaagaaauucaaauaagcaaaugacugaguuuuuaaaguuaauauuucccuauguauaauugcaaugaaaugugcaaagcauggaaagauaaccuuuuaaacaaucaugucagauauaaauuugccagagaugauccaucuuucaaagcauaaagcuuuccuugaauuaauuucuauauucaaccuucauauauaucacucuccuacaacacuauguugcucuacagccaaauuccauuuagcuaugacucagcgccuuauuuacuucaccgauuguauuaagccuacacaaaucaucagaaagcuuuaauuuggccuccauggccuuucucuacuucccagaaaugguaacaagguauuuuaaauccucccaacccuaaguacacauguugcaacaucacuacuauuugccaaauaaauuacacuacauguauaauucucaucuuccugugcugacuagcagaaccagcccaaggaaagagagagagagagagacaggaaaaaaaaaaaaaaaaaaaaaggaaaagcauuucauuauauauauuuaaaaccacagcacucaaaaucuugguaaggaaagucccauuugggcaaaaauaugucgcugacuacgcagguaauaagguuaggcucagagguauccaugggaaccacuaauaaaaguacuagaauauguuugggaaggaaauauuggaaacgggugaaaacuuacugagggacacaugcaaugguacuaaaucaucacauacagcacuaucauuaaaauguaauuagauuaguggaggaacccaucuaccauauuuacaaucccauauaaucauuacacaauaaucacauaaucauauuaaugcuauggaguauguauuuauccucauuuuacaugugaagaaacugagacucagaaauaguagguguguucaagggcccacagauaauaagacauagagcagaauucauacauaaaauaaaggcagguaucuaauuccaugggcuaugaacuuaauauauauguuuuucccugcgagguaaaugaaaccaaguuuaagauuuacauaccgaacuaaaugcagacauuuugagugucugcaguauaauauggagagucaaggauuaaaagggggcuaaauaaagaguuuaaaaauaguacuauaaugggagggcaaaaagaagagagguacacauaggucaggaccuaacacuagguuacagaguaaaggccaaauuaaccauguaagacgacagggcagccaauggagagcaugacagugugcagaguaguuggcacaagacugaauguucacaggcacccaaaagguacuggcggauucauuuucuuuuuuuucccagaauaugcaauuuccuauugcacacuggcuuauugcauguuccuuuuaaaagagagcuuuucuguaauaauuauuuugaaaauuacaagauaacaaacuauugcaugagucccaaaagacuauucagugugauucccauaaaccucauuacacuugucaaggacaacaaaaaauagguguuaaaugugaaaguaaaugucagcuugcuauuucuucuaaaauuaaccagguaaacuggaucauauaaaaguuggauauugauaauagugauaacagauugaaaauuccaaauauacugaagucaucauugguuugucaacaugaacuuaaauuauuuuaugacuacauaaugaucucucauuacaacugcgaguguagguaaaugugguuuuuaaucaaaucaaccagauauucagaguuaauuuaagauauguagugauuccucuaaugagucaguuucaaaaaagacugauuaaaagugaauuauguuaccauauccaugcaccauacauacagacauagaagaauacaagaaagugaugugcuauuauuaggagaaaagaauugguagaagaaagaacacagacaacaaaagaacaaaucuuuacuuccuuuaaacacagcuuucacagaacgcugcuaaagacucuuccaaauaaaacaaaauccagagcagcacaaauugcuaaaauauauauuuuaugagguaacacaacagaucacaauuguagauagugagguaaaaguccucgaagcacaaaggcuauaaaauuaugauguagaggucuguaaacaucugaauuucaauccauucacuguaguagagaccuguuacuucaagaguaugauaucaaaugagguaagggaaagacauacaaauacagcaguaaaacaacaaauaacaggaaaaaagauuagacuaugcaauuuguaucuucauuaauauuuuguuuaaagguaaaguaauaaccuucuuuaagaaagaauauauuuucuuccccuucugccaugauuguaaguuuucuaaggccuccucagccauguggaacugugagucaauuaaacuucuuuccuuuauaaauuaaacaaauaaaaauaaaaauaaaaauaaauaaauuugguauaaugaucguaaaaaaaagaaaauaccugucuuuccugaaaaguauacuuaaaaagcuagaccaucuuguuccuucuauuauuaacacaauuaaaccucaaguuaaagguagaggggaacggcaugcuuuuucaugguuaaaaauccacagcuuuccucaaauacauuuuuauuccuggaguuauaugcuguguucuuuuguuuuuugguuaucucccauuguagcuggcucaaucuuggaaguacuaggcauuuaauaagcacuugaauaaauuaauuugacugaguaaucucaaaauuagguucuaaauauauauauuuuuaauugcucuuaaugggaaauucugcaguggaaaagguuugugugagcuguuuuuuuuuuucuuaaugcauauugguguugucucuaacaagcauagaauuauuuguccuuuaauacuacauugaugauggacacuaaagaucacacauaagauagauucuaauuccagaccuuguggcccagucuuuagaaugugacaggcaaggagaaaaaguaauacagguuuuggcaggagauugcuggggaaaggaccaagcuaaguaucuucccucauagaggaaaacaggggguuuagucacugaauagacauccagcaucccuccugaugugcagguguuuggagauggcuguucaacaacacgauuugcuccuuccacuaauucacacauguagaugguccagaguuaaccagagcacugggauagacauugagacucaaggcacaaccuugacuuugaugugggaaggaaaguaggaaugaaaacagugaauaaaugaacgaauggaugaaugaaugaaugaaugaaugaaugaauagaaucauacccacaugaucuccuaguuuuguuucucagcuccuacagacaacaauucucaaguuuaguuuauugucagacaauucagaaaauaagcuggaauugaaguuaucaaaauugguccaggaaacacaggcuguugggguacacauacuguaguauuaugcuaggaaaguugcagaauccaguguaagaaguuugaaauuagcagauuuuuuaaucacaguaaaaaugucauauuaaagcagugggcaaauaaaugaaauauaaaugagaauaaucccuggaaagaagugucaaauaaugcagccacacaaaucauucuauuuacaucuucuuuggacuagacuauuuagauuuaaucaaugaccagaaauauucaccauggaugguaauguguuuuggagaugugcuuuuuccuaauuauauuuccuugcacuuuuucugacugugcuaauuuccugucaucccauuuacacacaugaaauaaauauguauguauuuuuauaacuauaaagaaaugagauugguaacauaaaccaaaaaugaaugcaguuuuauuguuuuauaagcauaaucauauacuggaaauuauuuuauuuuagaagauauaugaggcagaucuaauugaaaucaucauuuuauuagugaaauguuuaccuuuuacaagagcaauggguaaucaacacugguguuaagauaugcaaagaaguagucguaaggucuaccagacugaaacuugcaagaugaucucuauuaacuacaacuuuuuuauauauauuaaaaauaucauuuauuuuguguucauauuuccagcaucacaacaguuuaacuuuaaugaaucccauuacugcauauuacaauaagaguuugcuucuuugaauuguacuuugagauauugauucaaauuuuuauauuucaaaaagcacuggacauuuuuucaaaaaccuuguguuuuuaaauuauaaugauauuguuuauaauguuuugcaauacauaaaaaaguauuauaguuuaauacauuuucuuucaaacagaaucauuugugacuuuauaguauaauguugcccuuauauucacgaugcagcuuauuuuuagguauuuuucuaauaagagcaauuauuucaaaauuguuuagcugaaucuugucauuaaauaucaaagaaugaugcuucacuuccuucuuaauacaucaaauacauguaagaauuauauauggauucauacuucauucaccuuuugacuugaggauuucuacaaauauaccauccuuacauuuccugacuuuguuuucuuauaaauuuccaccuuucauggcccauuuuauguucaucucagcuaagagcuaacaauauaaacaauaaguacugcuuucagaaacgacagcaguguuuuucacaaaaacauuuguacauuuaugcuaaauguuguacauagaugccacagaagaaaaaauuuauaagagaaaauaaaaagaguaacuuaugaauaaaaagaguaaccuaugaacagcuacuuugguucagguuaagggaaucagcacaagauccuuugaauucuauuggugguaaugaguacuguggguuguggugaauaguugaaugagguggcagaacaaacaauggauacccuauaucuguuuaaucuauuuuaaagucagacacagaaaaacuaggaggcaauuucagcaacgugaaacuuucucuaaagggacacuaaauaaugaucguuucuauaagguucuaauucuagaacuguguucuuaagggucauagaagcauagagaugaaaguuaccuuaaaaauacauuauauucagauuccuucauuuuuuacaaaugaggaaaaccaaggccaaaagaacaagauugauuuauauaauguaacuggucuuuaucaccuagauugaaauuuuccuacuauuccaugguugaacauaaauaauaaauagcaaauaaauaucaaaacauaaaucugcuacuuuuuugaguccuuacauuauuuacugaaguccuauaauacauugugcuaucucaugugugucuauauauaugcauggguggguauauagcaagaaaaauacuggacuagugauguaaaggaggucuugguuuaguucuuuuucugcuacacacaagcaugguaacccuagaagaacuagggaaaauuauuuaaccucucugggucucaauuauuucaucuaaauugugaaaauauucaaccagauuuauauaauuuuccaccccuauaauucucaagguuuuuaaaaauaacccauauacguuuuuuuuuucuuuuuguauuuaucuuuuuacggagaacacuacauccuagauaccaaaauagccuauccaaaugaaaaaaaaaauugucaagaaaaccucgugaguuaagguuugaaaauguauuugcccuuaguuaauauccugcagcucaguacacaaaagaugaaaaauggcuuaucaacaaauacauucauaagaaaggaaaaaagaauaaucucaaaauagguaauuuauuuccagauaacuuuugugaaaacagaaauuuuuuucuauuauucauguauuucaaagaucugaaaucaauguuaccaaauacugacaaaauuaacagauacagucauugaucuccagagaauggaauguguaccccguguuauaacugagguaucugucuagaaacucauuuucuaaaggauuaauugcuauccaaaaauguacuguagccaaagcuacaaaggaagauuuccaaaacaccaauacucuuuauuacuguuuauggguuauauaggcugucacugaauuccucucucuuauuaagugauaacaguagaaagauacagugaacagaaauuuugauuuuuaaaauaaaaaaccagcucuuaaauguggcugauuagaggaaauucuaacaauaaaauaaauugaggauuucaagcuauuagauuuuacuuaucuaaccucugagugaucccuauuaucauuugucauuauuacuaucuauauguuugaugaugcuauuuguucaaggaugagacuuucaaauuugaauaaacaggcagagggaucaaaaccaugaguuuuucuauaaauucauuaggagugcuaauauauaagcaaucacuuauaauuguaucauugaaucuuuuuuccuucuuuagacuguaaaaaaaugaaaacagacaaggugauguuagucccucucaauacaaguuugcauaguauugcaguaaacaugugagagaaaguugacuaucuucaauggcacaguugagguuuucuccuaaauuacuuccucaaaacauugaagaaaauagugcuucugaauggguuguuuguuaucuuucaauagaauauuuucucuuauuuuuuucaagccaccguuuuacaaaaaaaauucuauaaauaaguauuuuuacuucuaacauuaacugaaacccuucuugauauugaauagggaaacaaauugucuuuaaagcuuccuggaacucauuucagguuuauuacccaaagcugaccaucacaauaacugguggagaacauccuguuaguaucagaaaccaucaggcaaacuguccagcucuuucauuuuucuugacaaauaccuaguggucucuaucugggaaccuuauugccucucucaauuugcuuucagugccgucacgucacuauugcaagauauuuuuguuuucagaauuuagcuggcagcagaauaauuaaagagagcaauguugaaacaaaaaaaaagguguaguauuuaaaaaacugucauuacuuuucaaauuauagucuuuaauaaaggggugagggacuuuuucuucuuaauuuauaauuccgguuucucaccacuguguugucuucauuucauuuuuuuucuuacuacuuuuuuacucaagguuaauuuuuaaaaagcauagguaguuuagccugucuuugaaguuaauucacaauuauuaauauguaguuacuaagaagauaaagaaagaaaucaguccucacguuuuuccugcucacauucugguccuuacaaauaagaguuaagaaagaaaaauaauacagauuucuuaaaaaugaaugacauauauuuccuauugaauauaucuuuaaaaugauuugguaucuucaaauucuauguuaugauuuuccagauccuucuauuauuucuaauauuaauuuauacugcuuuuaaauauuuccauagaaaauuuauuaauauuuauuaacauuuccaguauugaaauccuuauauugucgggaugauucugauuuuaaaauguaaauaacugaaugguuauuucaaucugacuuuuugcauuaauguuuacuuauuaaaaauuaaaaucucauuguauuauuauaaacauuauuauccuauucuuuguaaagccaguuuuuacuuaaaacaguucuauucauuucaaaaaauaaugauuuuuuacuccauuccauuaacaaggaaaaaacuuuuagaccaccaaucacauaucuauuuucuaacuaacauaaauaaguuucaacaguagccagugcuauugauugaaaauauauuucaauaaauguuaccugcgcaucaagcagauaaaacaguaaaugaaaaguacacauuuucagacacuuuuauuuuccuuacucuuucaauguuugcauuacaaaaaaaauccugcccaacuuuguuacaguuaauaugguaucugccuuuucuucugccaaauucuauuuaaauuuuuaaugaggcaaauguuuuauuugacuaaauuaauuuugcauucauuaucuucaguuuaaauacaucaucacaauaaaaaauaagguagacuaguuucuuaguuuaggcugcuacaucaaaauaccucaggcuaaguaauuuauaaguaacauaaauuuauugcuuacaguucuggagaccagcaaauccaagaucaagggcccagcagauuaggugucuugugagagaucuucuucugcuucacagacggugccuucuugcugaguccucgaauggcagaaggggcaggcaaguucccuugggccuguuuuauaagggcacuaauccuauccaugaggacagagcccucaugaccuaaucaucuccugaaggccccaccucuuaauaccaccagaaugggaauucaguuucaaccuaugcagcgggguaggaggggacacaaacauucagaccuucccaauuaucaaccaauaguuucauuuaaagugagugcuuucuggaucaaggcuaaauguuuaauuagacuaauagaagcaaacagaaaauuccauuuuucuaggaucuuucaaucaaaaccuucauaauaggaaugaugauuccaauauauuaaaaauaauugguauuugcauuacuuugcaccaaugaaaaaauuuaauuuacucagguuuacagaggaaaaggaggaaagugcuuuaauauuuggugccucguagagaguaaaauuuauagcguaggucaguauguuagaguccuaauacaaaaucuuugauuuguauguaguguccaaggguuuuucuuucagcaguacauuugucaugaguucaccugauaugucaucccaaguuguaacaauacccaagguggcaguuaucucagagaaguccaaaguaaacuuucuguuagaaaauacuauuuuaaaaagauguuucauuuacacugaagucauaaaaauguugcaaagcuuuuacauguaaauauuuguucauuuucauauuauauuucaauuaauauaauaacuuuccacauucugcccuuucaaaacuggaauacaagauuaacaucuacaaaacagugaucuccaaggaaaauaaugcccuauuaucaacaagauacaaaaaugauguccauguuuaauaaguuucaucaaagauaauuucauugccacuugaauugaaccaaaaaaccaaaauaaauacugaugaccuuaccuucuugaacugcuuggaaaggguuguugccaucaacaaacgucacugaaaaugugauuuucucagucuguaagaucuccucauucugguuaaggucaccaaccgcagugcgaaauaccucaucauccuuuuuggcagauucaucaaaaauugcuccuagaaagaagugaauuuugccauuaaauaauaacauaaauauucugucauccccucuggaaauaugacaaggagacuuauguguuuaaaaaacauauacuuucacuuagagcaugcacuuuauuuauuaaugaaacacauuguacuggaagcaguguaauagcugagaaggaauauaguuacuucuuccaaauggaaugauaaauaguaccucaaaguguuauugcggggaggucauggggaagaaaacauaauagguauaaaaagcuucuacaugacaaaguauccaauacauuggauaucuuauaucaugaaauuuuuaaggaauucauagcuggaagauuucuuuucugaauaaaaggaaauaaccucagaaaacuucuugagguccauucauagaauauauaggaaucaaaccuuucuugcgaucuuaauuuauuuuucauuuccuuccuuucuuacuccccccauuuuuuugaacacggguuucauuaucuuuuauaauaguaaagucaauaauauuuauagaaaauguaaagacauucaaaucucugugcagagggaauggauaaauauuucucaaggaacuaauguaaguccuaauggauaauuauagcauuuuuuauccauguguaaauaugaugaugauaaacacugugcuaacuuuuauugacuauuugauugguaauggaauauuugguaaacacauugauucuaagagcaaacugauuuuaaauacugaccgucacuuguuaaguauacgaccuugagcaacaugcucaaauucuacaccucacauuugucuaaccucacauuguauguauuaaacacauuugucuaaaccucacguuguguguauuaaacacauuugucuaaaccucacauuguguguauuaaacacauuuguuuaaaccucacauuguguguauuaucauuauauacacaguguguauuauaaagccaguguggagcuggcuuuaucuuuucacugcucuuuuuguuugguugguugguugguuguuuuugagauggagucuuguucugucgccuaggcuagagugcaauggcgugauuucagcucauugcaaccuccgccucccggguucaagcccuucuccggccucagccucccgaguagcugggauuacaggugcacgcgaacacacucggcuauuuuuuuguguguuuuuaguagagacgggauuucaccauuuuggccaggcuggucucgagccccugaccucacgugauccacuugccucagccuccaaaagugcugggauuaaaggagugagccgcugugccuggccaucacugcucuuuuauauuggcauggauuguaucagucuccucaagccauagccuuguuuccuauauauuuugaauaccuguccauggcugagaacuugagagaaacuaaugaagaauuuuuuuuuuuuuuuuuuuuuuuuugagacggagucucacucuguugcccaggcuggagugcaguggcgccaucucggcucacagcaagcuccgccucccggguucaccccauucuccugccucagccucccaauuaccugggacuacaggcaccugccaccgcgcccagcuaauuuuuuuuuguauuuguaguagggacgggguuucacuguguuagccaggaugguuucgaucuccugacaucgugauccaccuaccucggccucccaaagugcuggcauuacaggcgugagccaccgcgccuggccagaauuuuuaaaauugacauauaaauugaguacuuccuuaauauguuaucagauguuuacuagugagaauauuauuauuuuauuaaucaaauauauauuauagacuuuaauuuuuacuuaaccugucuuuucugaaccagauaaugcuuuuuaaucuaagcucuuguaaaaacauuuagacaauaaauguuugaccuaucuugcuaauuuaagcagcuuucauaagaauuauuuuaauaugugauaauccuuuguagaucuagauuaaucauuacauugaaauuuaauacucucagguuuagauauacaaauuucuuuaauaguuuguuaggaaguaugauacaaauuuuuuacaauugaagcugaaauaaccaauucauuuuaaaccagauaaucuaaaugucuauucgcaaaguaguaauguguguuuauacaaagauguuucaaguugucguggguucuaaaugagucuuuaaaaaagggcuucuuaucaaccuuguuuuauagcaggugacguuauugacuucugcuguauugguaauacauuuuugauggaagcauuuuacuauuacauggcagaacacuuaauauugccuuaaacauuaaacuuggguuaauaaacagcagaaaccugcagaaaugauagcacauuagucaauccuuugcagaauuaagauauacugaaaaaauggauaaaagaaacaguucaucuuucugcaaacagcaaggaaguacacagaagaaacaguucaucuuauugcaaacaguguaaucaaagaacagaaaaucuuauccaacauuucaaaucccaguuauuuauuuacuuuuuucuucagcuauaaaaaucucaucuuaaacugacuuuguacuacaggagugcaugcaguauuuugucuucaacacaagcauucugaaaacaaugugauuaguuccacaggaaggauccugggacagaaauuccuuucuaauuucacccacuuccaauagucacagcaaagucaucucuauucuuuguauuaauauacaaauauuaccaaucuagauaauccaauacuauagguacuagaucuacuuuguuaacuauauaguugcucaaauguaacauucuuaacuauguaguuaacaugaugucaaagcaucuagauccuucucagguauuuuuauuagcaugauuuuacacucaguuuuauuuuauaaccuucaugggaaaagcagauuagaccugucaauauaaaauaauuauuccaccacugacacacacacacacacacacacacacacacacacacacacacagcauuucaucaguacucucuauauauuucuuauuggccaaacugaagggaagaauaaccaaucaauaaagcaggaaaggaacaccuccugaauauuccuauuacagcaauuuuuagucauuuccaucacuaaagguugauauucuguuccuuuuauggggggagaaauaaaggcuuuauguaauccuuauacaaacauacugacaugcaaguggccaaaauauauauuuuuaaaugaaaacuauaucauguuuacaugucuucuuauaucuuagaaaaauauuaauguuuaugaguuuguacuacauguaaugcuacugaaaacaauuuucacggacuaauggaccaauuagcauauauaugaaaaaaauaccaaauuuagacaaaguucuacaaaaauauaauugucaacuuaauuacaauuuauaguaauauuaaagcaaugauaauggcuuaaauuuucauugugaagugucauauguaaaaguauuaaugcagguaugcccuuugaaaauucauaaauuauuguacaauucaaagcuaacugacaagcuacaguacuucuguuaaaaaaacauaauuauguuuuagaaagguauuuaaauauucccaaaauacauauacuuacuugccaauuuuuaaaaugacaauccaaauuucuucuuuuaaccuaauagauauaugcuuggugucuguguguguguauguguguguguguguguguguguguguguguguguguguagauuuuuugugcuugaaauaagucaguacuucagaucauaaaaucauuucacccaaaaauacauucacaaauaugccuuuuaaauaaaauauuuauaaguucacuaaccuaaccaacucaacaagucuccaaacauucgaagauuuuucuccuucuugguuuuauuuuugguguuuccucuaccacagagguaguccuuaucaauuagcaaaauauaauuuccuaggccauauaaucuauuuuuauacuuacacuguguauaaaagagccugaauaguuuagacacucaagaaucauugauuaaaucuuuuuaacauuaaauuagguauaaucuuauaaaauagauauaaucuuauaaaauaaaauaccuaaauucagauguauggauaaaauauaaguuacaccuaaaccuaaauuaaaacaaaaguagacuugaaaauguacuugcauguuaauuuguugucacaggcauuauuacgauuccagaaaacccaaguuagcaagguaauaaucauacacaagguaauuaauaaucauacuaaaaacuugcauuuuaguuugaauauugaaaauuuugugucuuauaaauuuaagaggcaaguggaguaaacauuauuuaccugauaagauaguagagaaaaaauuauguguucauccugcacauaauuuccucuaacaauauugagaaaaaauuugauauaucuugaagaaauuuuccacagcgaauagaauuauuggaagauauacauauucuauaacaaccuuaucaaguuguguuuaaaauaaaagacucuaaauauugaaaccaagcaucaacacaucuacauuccucuugcaaaucaauagcauaucaucuagaaaaacuuauauaaaaacauuugugcauaaauauuucguuggauuucauaauuccaaauaaaaucaaagauagcugaucuuuauuuuuuagucagaaaguucaaacuuuuuaaucucuuuacucacuuaauuuugacuaacauauaaauuauauaugguagguaaucauaaaaggaauaaacuuaacugaaaguuagcaaagaugcuacaugcaaugaaucuuuuauuuucuuuuuaacaacagagaugauucuuuugugcaugcucucacucucucuaccccccaaauuuuuccccucacuuuuucucuuuguguucacacauucaugcauccagccauucauccaucuauucaucaaaccaaucuuuccuaaacacagagaaaaccaucaaagccaagccacugugcucuuuaacaaauuauuuaguggccaaauauuugaaauggguuaaguguuuaauaaagccauaguggaaauaagaugccauaagaagaucaugaaaagaaggaaucauguuguuuuuguaaacucauagcugaaaggaauuuuagagaugguuuaugaaaaccuucucaugcuucauaaauuguagugcaaacauuuuaaauguuuucacccaaauuacacagccaaagguuacaagauguagaguaggagguuagguguccuuguuucaaguuuggagcuaugucugccauuuuaugcuuuuuucacuuuaagcauuuuuuuuuaugguggcuauauauagacagaggguacaucaguacauauaugugugugcauauacacauauacauauauauucaauaaauaguacuauaaugaugauuagcauauuaaauccauuuauuuuaagccaugaagguuauaaaauugaugaaauguaguaaaaugcugaucguaagacuaguuuuacaugaaauuuaauuccuuugccugagaagcuucaaaaacuuuaguuuaggaaguuaaaauaaagaaaaaagugcaaccuucugccuuggggaguuuauuagucacaguaggauuuacaguucugcagagcuauucagaauuguuaaaucaucauauauccuuucuguuuuagaugcuacuauucacaagugaguuuuuaauuuaauucugacaaugcauuuugcauacacguuaguugcacuguaagcauauauccaagucaagagauuuauaacauuuuuuucaucuacaaauggcauuccuacaauugccaguggaaauuauacaggcauuuuaaaaggagggcaaauaauaaaaggcauuauaaauauuguaaaaaucagauuucuccuuuauuucauugucucauucauguuacccucaguucaaggagaaaaaauguuaagcauguucaaaacuacuagguaguaagagaaauuagcaguauuaugaccaaaagagauuagcguuuuugauacaauuuaguaucuuuacuuaagcauagauaguaucuuugacaccaauaagcaucuucacuuagcauaguaucagcuacuauuucagugggauaucauuacaaugaaggugaaggcaauguuuguacauauauauauauacauauauguguauauaaauauauacacauauauaugcacauaugcauauguguauauauuuauguaauacauguucauguuuauauauuuauauuacacaugcacaaauagguacauuuauuacauacucacauauauauuacaacuguguauauguaaugaauguacauauguguguauguaauaaaugugcuuauuugugcguguguuuauauauaaauuauauguauauuauauauguguauguguguguauauauauauauauaauuauuaucugcucaggaaauauuaauuaaguugauauaucauucacaauuuaauucuguauuacaaauguuucagcagccucuuauuuaacagaacauuuccuaauauguucuaugcuaauauccuugcaggcaugaaauaggguuuucagaacccuguaucuuuuuaucaugagguauauuuuucucaguucaucuuaucuaacccuucacaagcacucugacugacuaaagaaggaaaccaaaacaaugacucuaauuguuggaaaggaggugcuggauauacaucaaauucaugacaauuagcaaauauuauucugaauuagagacaauugugcucuguuguguuucucuccaauuuauaauaauugaaauauuagaaacacuggcaguuaauauuuuuuaguacuaggaacuguacuaaguggcucauagacauuauuuuauuuaguucugauaaaaacccuuugagggaaaugaaacucagguuaaguaacuuucccuaggcccaagcuaguaauaauugcugcagaauccacagcucucaguuucuuagcaaucuucugaaaacacuagaagcuuaauaacuggcaauauauacauuaaaacaaauuuccagauaagaaaauaauauguauauuuuuacuuucauaauaauauauauagagagagacagagucuuucucugucacccaggcuagaguguaauuauacagccauggcucacugcagucucaaucuccccgacucaccugauccuccugucucugcucccugaguaguuggaacuacaggggcaugcaaccaagcuuggcuaauuuuuaaauuuuuuguagagacuggggucucacguuguugcccaggcuuaucucgaacuucugagcucaaguguuccucacuugagaaacuauacuaucacuguaccucugcaucccaaagcgcugagaucacaggcauaagccacaacacccaucauuucauaauaauuauaauaaaauuuuauuguauauuaaaauucucaaauagguuucagucuuacauuuuguuuuauaaaauuuuauuaauuaggcauauuuuuauaaaauuucuaguacuuuuugcauacuuugaaguucaauauuugucucagugauuuaauuuauacuauaucagaaguugauuuaccuguuuuuauacaaacuuuauauuuaaggguguuuagggauaauuaauauauauaaagauguaaauugauaugaauuucuaaaccuuaguuuaaauaacaaucuuugcaguuaccuuggaauaguguuaagugaguuccaauagaauauggacuaugacauauuuuuaaaugcagaauucagaacaaaucucuagccuuucaauuucuaaggaguuuuguuguuguuguugcuuacuuuagugacgaauaauccuaagagagugacaauaaaauauaaaauaaaaauuguauaaaauauauaaaguuauugacuuuauauauuaaggaacauugauaauuuacuuaggucuauaauauucaaauuguggccagguacagaaacuaucuggcucguuauuuuccacugucuagugcuuacuuagcacuuuguucugagaguucaaagugccuuauaauauuaacuuccauuccacccaccauaauuaguuagccuauaggaaagcaucauuuuuauuuuaaacauaggaaaucaaguucaaagaggauauugucaagaucacagaggguauuaguuaugauauaguguagaaagguaugaguggaaggagaaaauuccacgcagauauuuaaaaugauuauacagaaauccuugaaugugcauuguaauuuacauuuagcuaguguccgaaauauuuuuaauaauucagacaccuuuaaauucuguuuucuucaauauauuuuugauauagugacuuaaaaugagaaggucuaaaucauagaccaagaagagaaauuuucaguacugucuccagagauuucuccagagauuuauguuugaaugugacauuugcucauagugugaaauaagucaaauucaaagggauucuucauucuaacacaagacccuuuucuuagccuuacucuccaauaacaugugaaaucacauuucguuuggaaaaccuguauaguuauccagaaacccaaagcacauuuaaacugauaauacuaucacuggaaaagucugacugcugugugucuuccagaaguaugugggagaaaaggaaauguagggugcuugccuaaggaacagguaagcugagucauccacauggagcauaguaagagguuaauuuuuaaaauaauuucauguuggaauaucaauccucucagaauaguuuaugcauuuuauacuaguuuagugaauaaacauuucaaagaucaauucuuugaauaggaauacuuugcaauuuuuuaaagaguacuugugacuauuucuaaaaaaaaaaaaaaaaggguggggggacuggacagugaaagcucaaauaucuggauuuuuucuuguauaaaggcagcaauguuuaacucuaaauuaguuuacaucucuucuuacugaauccgugaagauucaaccagaaccuugugugcuauguugcagucucuuucucuauugcauacaucuaauugaaacaauauccuauuauuacaaaauucugccaugacaagaacaaaaagaauugguuugacaauagacacuuugaacacugcacaccaauucaaauucuucccaaacugaccugaugcauuuaaaaaaaaaaaaaaacaaauaggcaaaaagcugauaagguagcuacugaaaaguauguucauggagaaaaguugcagauauuuuuagaaauugaacagauuuaacauuuuucuucuuguaacaauuuacucuaccuuuuuaguauuaccuucaacuuccacaaaaaaaaugugagaauuggccuauacuacuauaaguaaaaucauaugccaaagaaauaucuguaugaaaccauaaugugaaugugauccucuuagaagggucaaacucauuuugcacacaaauaauauaguguaggcugucuucuacagaguaaaaauucuaauuuuauguuuaagacaaaaauuuacucuacuuugagaugaaaaaucauuuuaccuaucugaaugggccaaaauaaauaaguuucuuguaauugagcauuuuaaaacuucuguaaacuacuguuuuaguucuaaaguaacagauugcagccuguagaauauuucagguaggaaaaugguacucuuccaauauaaaucucaaacuucauaauuuauuaacucugaacucauuuguaauuuuuuucuucuucuuuauuacaugaauguacauuuaacuagcaacaaugaagauuuuacagauauccacugauuauuuuuccaauauguccuauaaaauauacagauauuuccagggaauugccauguaaaauauuucaaaagcauuaagaaaacagaaauucuauuauaacuguagacuagacaacuguaaaggagacaugaguuucccucagaaggacggcaaauuuucuagguauuuauuagcugcaauauauauaacagcaaauuauacuauauauauauuuauauguauauauguagauaugaugaaauuaacugaguccauuauacuauauauaaaauauauauguaaaauacauauacauauauaaaauauauacacauauauaaaauauauauauuauauacauauguauacauauauaguauaauagacucaguuucaucuuuuaagaucuguaucauagucacagucucugacauuuuguauaucaauuacuuaagaaaaaucaauuucuaaauaguauuuuaauaauaacuugcuagaaaauaaaccuuacaaaauggucaaaguuguguaugcuugccacuguaaguuuuauucauacuaagaaaaaagaaauaauguuuuuaaacuuuaucauuuuuguagguuaucucucuuaauccucauuuuacaguugaggagacuaagaaucagaaaaguuagaugaauuacuuaaucacaugcuaaaacauacaugauauaggacuuaaaucuaaaacucucuggguuccaagaccuauaguuuuuauccuauauaaacuguaucuauguuaaaaauguaguccauucuugagaaaaaauauucugcuuuuggaauaauguguuagggaaagagaaaaacagugaaugccuucaaacuguguucuuaauuuauuuucuuagacaguuugacaccaagacauggaauguaguaauccucuuuugaagaaaaagaaacaaaaaagagcuggaaagagugaauaauuuauaaaugauuugugggccauguuaaaagcgaugauagaguauacacuguggccuuuuaaacacauauugaaaaauuaucuaaaagucaaaauauguccagcaagaauguuuacuuauggaacuugauauuaaguaauuuaccacagagcucaaguuaaaaaaaauaaaauaaaagucacguuuggauaaauucuuaugcccuccugguguaugaagaccauaguugaaguacauaagggaaacauaaggagauuucucgggaucuucuacuaugauauauaucuuaagacuucagauuaaaacucaaaaaauauuguuguuuaaauaaaaaagaaacaaguuuccuuccuuuaacauaagcuauaaagcaaauuggcaaacauuuguaucugugaauucugguuuuuugguaaauagaugaaaauuuacagugaccucgaugugcauuucaguguuuugaaaauugugaucuaaugaugaaguaaucugguacuacauuauuaagaguuugaacaaaauauauaugaugcaugucaaaaugguaauuacaagaauucaaauauguagauagauagauagauagauagauagauagauugauagauagauagauaaugauauuuuuguuguugaaaugaguuugcccagacuggucuugaacuucugaacucaagcaacugccucagccuccagagugacugggaugacaggugugagucacuaggccaugcuuccauaaauuucugaagauguuauucucuauuuaauuauguuguuuuccauauaucuuuugcuuuauuaaagagguagcuuuucaagcuuuaggcagccagaccugagaggcucuaucuuuuaauaauuccauuuuaaauaaaaaugaugaguucauguccuuuguagggacauggaugaaauuggaaaucaucauucucaguaaacuaucgcaaggacaaaaaaccaaacacuucauguucucacucauaggugggaauugaacaaugagaacacauggacacgggaaggggaacaucacacucuggggacuguugugggguggggggaggggggagggauagcauuaggagauauaccuaaugcuaaaugauaagucaaugggugcagcacaccagcauggcacauguauacauauguaacuaaccugcacguugugcacauguacccuaaaacuuaaaguguaauaauaauaauaagaaaaagaagaagaagaagaagaagaagaagaagaagaagaagaagaagaagaagaagaagaagaagaagaagaagaaacuaaguuucagaaaauuuuaguaagucaucccaaaucuucacuugaaccuuggaaaaaacaccauuuaauuuaugugagauucucacugagacuuugaggccagcuaaucccaucgugauucaccacuggcaucuuugcuuaccgcccaaaauguauaucucuaaccauucaucagcuccucauuuucuuuauauuguuuuuccuuugacaaaagcccaccauaccuuuacacaaugcuaauuguucuccacucugaccaccuaauuccaugguaauuccauuucauuaauauuuucaacuccuuuauagaagaauccuagcuuuuauuaaauucuagcuuucucuagaggaccuugcucuuccuguaguccuuucaacuggagauuuauuuuuucacauaccaaguccuguuacaaccagcuaacauugcuuagcuccucaaaaacaaugccaaacaguuacucuuccauuauggaguaaaaucaucucuucugaaucccuugccauuuaacuguccuacccucugauccuucucaucacugucacuugacuaccuccugcccagaugacuaaguucauuuuguaaauugaaaccugguucaacaucuuucucucuguccucgguccuaccaucauccuuggugauaacaguugacuuauuuaccuuaguaacaacucaaucucauuuuucuuaauccuaauguuuauaccuccacuaaacccacagccagugacaggucccugacauccccuguauacucuauaugagaaaucuugaaaucuauuaucuaacacucuacacagucuuuuuuucaagacucauuccauuacaucuguucuucagccacaaagaaacuuccaguccccugaucacugaguugauggagauuccauuuuacagaaacagugauaacugacaaaguaacaagagguaaaucaaugguucccuuucgaauaugcuaugcuucugaagccuauuaaaaucaaaauggagaauuuauguuggcaauuaaauauguagaaaauggagcuuaagagaaagaugucugaacugcagacauauauuugaaaguaaucaagguaccuuuggaaauuaaaaaucugagacaagauguuaucauauuaaaaaauagcccaaagagaaagaagaggggcuagaacagaucccagacccagaaugaaaaaaagcaggguggggcaacggcacacccaggagcaauggcccacccaggagcaacagagccaagggaucuccaauaccagcuaagggaagcgaugagugauugugugaucccaggaaaccacacuucuaccacagagcuuugcaaaccauggaucaggaggucccaucaugggcccaugccaccagugucugacacacuaagcugggcaaagucucaggagaccagaugcucaggcacaugcagagauccaggagcuuuacauacuccagccccaggaacccuggcaagguugucugcagcucaagcaaggcagaagguccuuccuaggagaugucccuaggaagggggcugaauccagggagccgagcagugccagucuucaggcccaacuuccauagcaucucacaggauaagacccacugguuuggaauccagagcagccaccagcaacagaguggagccugccugagaggagauggagcccucugggggagggaccaggccaccauaucugcuguuuaguccaaucagcuauuccagcuuguggguuuuggagaguccaaaugguccggacaaggaaggauuccaacagugcagcacagcugcuuugccagaacauggcuggagugcuuccauaagcaggacccugguccauuccuucucaguggaugggaccucccagcuggggucuccagccaugccugccugcacauauucuauagauaaagugcugacuucucucugguacagagugcccucgggcaaaggcagauugccaccuugguuguuuagacaacucagccauuccagccugugggcuuuggagaguccaagccaaugggcagaggcgguuccuuagcauggcagagcuguuugucaagacauauccagacugcuucuuuaagggggacccugauccacuccuucucaugggaggguccucccagccagggcuucuggccacccuguccauguucaagagccaacaguucuaauuucucucugggagggagugucuggagaacaacggggguggccaccaccuuggcuguucaaauaucucagcugguccagacugugggccuucgagagcccuaaaggauugggagcugaagaguugcccaaggacuccagccaccuccuacaggaggguucaggcuggcaaccagucaguauccccuggaauggagcuuccagaggaagggacaggcugccauauuugcuguuuugcagccuuuacuguugauaccuccagguuugggaaaaaaugaggugacuagggucuauagcugacccccaucaaacugcagcaaggcuaaaacaaauaaacauaaaaacaaacaacaacaaaaaccacaaaaaaacccaucgaaaagucagcaaaaucaaagaucauggguagauaaguccacaaauaugagaaagaaccauugcaaaaacacagaaaacucacaaagccagagugucccuuuuccucuaaaugacugaaccaucucaccagcaagggcucagaacugggcugaggcugacauggcugaaaugacagaaguagacuucaaaaugcagauaaaaacaaacuuugcugagcuaaaggagcauguuguaacccaaugcaaauaaccuaagcaugaugguaaaacaauacaggggcugacaggcaaaauagccacaauguagaggaacauaaccaaccugaugaagcugaaaaacacacuacaagaauuucccauugcaauuacaagcauuaauagcagaauaggucaagaggaggcaagacuuucugaacuugaagacuauauuucugaaauaagagagucagacaagaauagagaaaaaggaaugaacaaaaccuucaggaaauaugggauuaucuaaagagacagaaucuauaacugauugggguaccugaaagagauaaagauaauggaaauaauuuaacaaacauacuucuagauauuaucaggagaacuuccccaaccuagcaagaaaggccaacauucaaauucaggaaauguagaaaaccccaauaagauacuccaugagaagaucauccccaagacacauaaucaucagauucuccaaggucaaaaugaaagaaaaaguguuaagagcagcuagagagaaaacgcaggugaccgacaaagggaagcccaucagacuaacaguggaccucucagcagaaacccuaaaacccagagauuggagggcaaaauguaacauuuuaaagaacagaauuuccaaucuagaauuucauaucuggacaaacucagcuucaaaaauaaaggagaggagauccuuucauaagagaaagaggucguuuucagacaagaaaauguguagggaauuugucaccaccagacuuguguuacaagagcuccugaaggaagcacuaaauauggaaagcaaaaaccauuaccagccacaaaaaaaaaaaaaaaaaaauacuaaaguacagaccaguaacacuauauagcaaucacauaaacauguguacaaaauaaccaguuauaauaccaucaugaugacaggaucaaauacacacauaaaaauacuaaucuuaaauauaaaugggauaaaugcccccauuuaaaagacaaagaauggcaagcuggguacagaacuaaaacccauugguaugcugucuucaagggacucgucucacauacaaagacacacauaggcguuggaggaaaauuuacccaggaaauggaaaacaggaaaauagcagggguugcaauccuaguuucugacaaaacagacuuuaaaccaacaaagaacaaaagacaaagaaggggauuaccuaaagguaaaggguucaauucaacaagaacagcuaacuaucuuaaauauauaugcacccaauacaggagcacccagacucauaagcaaguucuuagggaccuuuaaagagacuuaggcuucuacaaaguaauacugugagccuuucacaccccacugaaaauacuagaucauugagacaguaaauucacagauacucaggacaugaacucagcucuggaucaaguugaccugauagauaucuacagaacucucuaccccaaagcaauggaauguacauucuucucaguggaacaugucacuuacucuaaaaucaaucacauaauuggaaguaaaacacaccucagcaaaugcaagauaauugaaauaauaacaaacagucccucagaccacagugcaauaaaauuagaacucaagauucagaaguucacucaaaaccauacaacuacauggaaauugaacaaccugcuccugaaugacuuuuggguaaauaaugaaauuaagguagaaacaaacaaguucuuuguaacuaaugacaacagagaaacaacauaccagauuaacugggaugcagcuaaagcagugucaagagggaaauuuauagcacuaacugcccacaucaaacagcuagaaagaucucaaauugacacucuaacaucacaacaaaagaacuagagaaccaagagcaaacaaaccccaaugcuagcagaagauaagaaauaaucaagaucagagcagaacugaaggagauagagacaugaaaaacccuucgaaaacugaaauccagaagcuguuuuuuugaaaaaaauaaaauagacuccucacuagaauaauaaagaagaaaagaaauaauauucaaauaaaugcaaucagaaaugauaagggagauaucaccacugaccccaaagaaauacagacaaccaucagaggauacuauaaacacgucugugcacauaaacuggacaaucuagaagaaaugaacaaauuccuggaaacguacacucucccaagacugaaccaggaagaaacggaaugcuugaacagggcaauaaugaguucugaaacugaggcaguaauaaauagccuaauaaccaaaaaaagcccagggccagauagauucaugggugaauucuaccagagguacaaagaaaagccaguaccauuccuacugauacuauuccaaaaaaaaaugaaaaagaaggacuccuccuuaacucauucuaugaggccaucaucauucugauaccaaaaucugacagauacaagaaaaaaagaaaacuucaggccaauauccuuggugaacaucuaugugaaaauacucaacaaaacacugcuaaaccgaauccaacagcacaucaaaaaguuuaucugccaugaucaaguaggaugcaaggaugguucaacauacacaaaucuccaggaugcaaggcugauucaacauaugcaaaucaauaaaugucuaaaauucucuuuuuuuguuguaucucugccaggcuuugguaucaggaugaugcuggccucuuaaaaugaguuagggaggauucccucuuuuucuauugauuggaaucauuucagaaggaaugguaccagcuccuccuuguaccucagguagaauucggcugugaauccuucugguccuggacuuuuuuugauugguaagcuauuaauuauugccucaauuucaaagccuguuauuggucuauucagagagauucaacuucuuccugguuuagucuugggaggguguaugugucgaggaauuuauccauuucuuguagauuuucuaguuuauuugcagagagguguuuauaguauuaucugaugguaguuuguauuucugugggaucgguggugauauccccuuuaucauuuuuuauugcaucuauuugauucuucucuuuuuucuucuuuauuagucuugcuagcagucuaucaauuuguugaucuuuucaaaaaaccagcuccuggauucauuaauuuuuugaaggguuuuuugugucucuauuuccuucaguucugcucugaucuuaguuauuucuugcuuucugcuagcuuuugaauguguuuguucuugcuucucuaguucuuuuaauugugauguuagggugucaauuuuagaucuuuucuacuuucucuuguaggcauuuagugcuauaaauuuccuuccacacacugccuugaaugugucccagagauucugguauguuaugucuuuguucucauugguuucaaagaacaucuuuauuucugccuucauuuuguuauguacccaguagucauucaggagcagguuguucaguuuccauguaguugagugguuuugagugaguuucuuaauccugaguucuaguuugauugcacuguggucugagagacaguuuguuauaauuucuguucuuuuacauuugcugaggagugcuuuacuuccaacuauguggucaauuuuggaauaagugcgguguggugcugagaagaauguauauucuguugauuugggguggagaguucuguagaugucuauuagguccauuuggugcagagcugaguucaauuccuggauauccuuguuaacuuucugucucauugaucugucuaauguugacagugggguguuaaagucucgcauuauuauugugugggagucuaagucucuuuguaggucucuaaagacuugcucuaugaaucuuggugcuccuguauugggugcauauauauuuaggauaguuagcucuucuuguugaauugaucccuuuaccauuauguaauggccuucuuugucucuuuugaucuuuguuggcaaaucaauacaugugauucaucacauaaagagagcuaaaaacaaaauccaugugauuaucucaauagauucagaaaagaccuuccauaaaauucaacaucccuucauauuaaaaacucucaauaaaccauguauugaaggaacauaccucaaaauaauaacagccauauaugcuauacccacagccaauaucauacugaguggcaaaaacuggaagcacuccccuuguaaaaccggcacaagacaagcuuguccacugucaaaacuccuauucaacauaguauuggaaguucuagccagggcaaucaggcaaaagaaagaaagaaagacauucaaauacaaagacagggagucaaaauauccuuguuugcagaugacauaaugcuguaucuagaaaacuccgucauccaguugaaaagcugcuuaaacugauacacaauuuuagcaaagucucaagauaaaaauaaauauguaaaaaccaguagcauuccuauaugccaacaacagacaagcugagcaccaaaucacaaaugaucucccauucacaaaugccaccaaaagaauaaaauaccuaggagauaacaagggaagugaaggcucucuucaagaaaaacuauaaaccacugucaaauaaaucagaaaugacacaaacaaauggaaaaacauuucaugcucauggauaggaagaauuaauaucaugaaaaugaccacacugcucaaagcaauuuauagauucaauauuauucccauuaaacucacauuggcauucuucacagaauuagaaaaagauauucuaaaauucuuauggagccaaaaagagcccaaauaaccaagacaauccuaagcaaaaagaacaaacccaaaggcuucaugcuaucucacuucaaacuauaccacagggcuacaguaaccaaaacagcaugguacugguauagaaacagacacauagaccaaugaaauagcauagagagcccaaaaauaagacuaaacaacuauaagcaucugaucuuugauaaaggagaaaaacaaggaaugaggaaaagauacccuguucaauaaauggugcucugagaacuagcuagccauaugcagaagacugaaacuggaccccuuccuuacaccacauaugaaaaucaacucaagauggauuaaauguuuaaauguaaagugguaaacuaaacaaacccuugaagaaaaccuaggcaauacacuucaggacauaggcauaggcaaagauuucaugaaaaaacaucaaaaguuaugcaacaaaagcaaaaauugacagaugggaucuaauuaaacuaaagcgcuucugcacagcaaaagaaaguaucaacagaguaaaaauaccaccuacagaaugggagaaaguuuuugcaaucuacccauuugacaaaggucuaauauccagcaucuauaaggaaccuaaacucacaagaaggaaaaaaaacauuaaaaagugggcauuggacaugaacagacacuucucaaaagaaggcauacauguagccaaaaaacaugaaaaaagaucaaccccacugauuauuagagaaauacaaaucaaaaugacaaugagauaccaucucacaccacucagaauagacauuaaaaagucaauaaacaacagaugcuggcaagguuguggaaaaugaaggacuguuuuuacaauguugguaggaacauaaguuagugcaacccuuguggaagacaauguggugauuccucaaagaccuagagacagaaauaccauuuaacccaacacucucacuacuggguauauacccgaaggaauauaaaucauuuuauuauaaagauacaugcacgugaauguuuauuacagcacuauucacaauaacaaagacacggaaucaaccuaaacauucaucaauguuagacaggauaaagaaaauaugguaaauauacaccauagaauacuaugcagccauaaaaaugaaugagaucauguuauuugcauggacauggauggagcuggaggccauuauccuuagcaaacuaauucaggaacagagaaccaagugccaccuuuucucacuuauacgugggagugaaaugauaagaacacauggacacaugucagguagcaagauacacuggggccuguuggagggugugggguggaaggagagagagcaucaggaagaauaauggauguuggcuuaacaccugggugauaagaugaucugugcaccaaaccaccauggcacacuuuugccuauuuaacaagccggcaugucuugcacauguacccuuuaacuuaaaaguugggaauuuaaaaaaagaaagaaaaugugguacauauacaucauggaauaguaugcagccauaauaaagaacaagaucauauuauuugcaggaaaauggauggagcuggaagcuguuaacucuagcaaacuaaugcaggaacagaaaaccaaauauagcacauucucacuuauaaguuggagcuaaaugaugagaacacauggucacauggaggggaacaacagacacugggaccuacuggagggugaaggugggaagagggagaggaucagaaaauguaacuaauggguacuaggcuuaauaccuggguaaugaaauaaucuguagaacaaacccucaugacacaaguuuaccuauauaacaaaccugcacauguaccccugaacuugaaauaaaacugaaaaaauacauauuuuuuaaugaaauuuugcacuucaaguucugacaagaugacagacuaguagaguuccucauucccgccaccaaaaucaaauauucagaaacuucagaagaauaaagguagcacauaucugaggaaccaacaaaaaacuugagagaaaccauggggagacaaaagauuguuguaaaaguuucuuuguaugucagggcagccuugaauggcaucucgacacaccuguagaaacugucaaaauccucccagggcuuauugagucuucuauaaucagacacuuuguuaaauuucagaccucagauccuaguauuccgccucuuccucacugacauccaguuacccaagucuuuuuguugcuccugcaauacaaaaaguauauucccaucucagcaguccugaucucguuauuccuucuaguuguaaugcuccuucucuuacagaaaaacacagcuucuccucaacugcuucaggucuugcucaacuucuuagugagacccuccuugaugacccuguuuaaaacugcagccucugccuucaaucccuuucugccaucccugcuuuauuuuacuucauaguuuauauggccaucugaugcauuacauaucuuaacuauauaucucuuguuuauuauuuccuucucuuucaaaugcacuuuccaugagggcaagggguuuuguuugcuguguuaacucugaauuaccaaugcaaagaaauguguucaucgcauauuagguaaguaguagaaauucauugaauagauagauaaaauacgauuauaugauugaauauuuuaaaagauaucaacaaucauaaaauuaauaguguaguaagacuucuaaagaauacuuaaaguauguauaccaaguucuugagacaaaauuguuggcaagagaucauaucugagguuuaucugccuuugacuucaccuuguagaugcuuuuauaaaucacuaauugaagaguguccugaaaagcugcaagcucuagcauccuauuuucccgaugaaacuuuauuucucuaaaugcaauuagauuuauuagcgcaaauauuuaacaaauucccaaguauccuucuugaauuaagauaugacgaaccagcagaaaucaucacaguucaguaaugcuauagauauucaaauaugccgugaaucuaagcaagcacauuuuccuauagaaguggcaaauguaagccuaucagguaucuaacucaaaaauaagaaaaaccacuguguaguuaaaucauuuauauguaguagaaaacaacauauucuauuauuugagaagaauauaauuuugaaguuaaaaaugucagagggaauuauaaaggaauucaaaaaagaagaaaugacaccauuagaaagcuugcuaaugucaacuggagguuaucugauccgauaaguuuuggugguauugcagguuauuucauacauaaacuaauguuaacauauuacuuuucuguaauacuuguuuuugcaagugaaguagugaacaaucaaauacaaaucugaucauuuuuaaacuuuuaagguguaacuauuuagaaaaagauacuaacugaauaaaaccucugacaaguaaguaaaugagagguacaauguuaaucacagugaaacaaaucuccagagugggcagcucuucagaaacggggauauaagauucaaaaacuuuuaauaguaagcuuuccuaccuaaccacugcagugaaaaucauccacaacugaguaccagcauuucacauacuagucauacuuugagugaaacucuguaauaugugccugaaaauguaucaucuuuugcacauuuuagcaccauuuauuucuaguuuucauaguuacauagaaauucuuccaauuauuugcuuuuagugugaauaaaacaauaucugugcuaucccuuuacauaguguaaauuaguuaucacucuauaguaauagcauaauuucuucacucauucucuagaaaaauaucucaguguacaguaaggagcauagagagacaagaaaauuucucaacauguuuuccaaagagaaacuuccuguagcuuuucugccauugugaaggaggcaugccagcuguugacaggagaaugaauagauccagucaggcuuaacaugcauccuauuguccgaaacuguguucauuggauaugcugucaacaaauuuucuggucccccuuuuucguuguuggcaaacuuuauuuuauuucucuaaaugcaauuagauaguuacgugcuaugcagaauaaugacucuggggcaucauuuuccaucuuaaaaaaaaacagaaauauuuccauauugaauugaauaauauuuuuuagcuuuuuucuaugcaugaaaaucauauuuugagaugcucuccauugagcagcuuuacuuuuaucuuaacaugcaucacacauaccuccccaaauuaaguaaauacuucaccaaaaauuuugcgccagcugcuaggcauaucgacauaguuuauugaaaccucuuaggccuucaaaaccauaaacggucagcgaagaacacaugaaccuccacuguuuccaaauauuccuagcuuacacauagggauuguauagguaaacucaaccuagguaauacuugauuucuucuuugugauacccugaggagagaaccacacagugccagacuucuaacauacaaaacugugaauuaauaaauaugugcuguuuuaaauugcuaaguuugugguaauuuguuacacagcaauaacaaaccaauacacucaauuaucagcauucuuuaaacuaugaacaguaauaaauuauucacuagugucugagagcaacuaguacugggcuuauacaacaugggagaaaaagacuuguuaauuucuuuccuuucuuuagcacacacuauaggaguauguacauaugccaggaacuguaccgcugcguuaggaacuaguaguagaaacugaagucagauaccagucuugaagagauuauagucuagcuauagaaauggauagauaaauagauagauaaaauuuaguagauagauagauagauagcaguauaauagcuuaaauguuauaaucaagaaauuguguuaaggggaaaaccagcaauugugaaagauuuaaaauauuuccccugugggauauaauaguuugaucuucuuauacugucauauaaagugggaauauauauaaagcuucuagcucuuagcaagcauaugaauucaguaaacuaaaacuauacuaagaaaaauaauaugaauugacaguguugauucacauauuuuuacaauguuuauauuguuuccagccugggugcuuuucuuguaaagaaacaucacuuucagagaauuuccucauugauugaucacuauaaaacuaauaauuuuuuaauacaacauauuaucaaaauucucauaugaaaguaauaaguaacauaacaagcauuuaaagauaaaauuaggacccaggaguaacuggguacccagaaguaauuaguacccaagugaggugacuugccaaaacuguaugccuugucaaaaccauucccacauuugugguuaaaauuaaggucagauccagguacagaagcuaauaauucuaaagccaauaacaauggugaucacuugauaggggaacagcaaaugcauucuggcaugauauacuucccacucuuuugaugaacagaccuacaaacuacacugacgauacagggcauauuuuaggacuggaaagaaaaaaauauauuuggccuuguagcacgaaaauauauauuuuauaaauauaugacauuccaaauaguuuggcuuuauuauuuuuaauuucaacauguuucacaaaguaauguuugcauuuuaaguguauugguuaacccccuuuaacugaaacauuugccuuaggaauguuuaagauucuuuuaguguauguacugccgaagagagcacuugagauucuuuuagauguuaaauuuauauuucuuuauuuucaaaacuguauuguucucaguacugauaagggauagaaacccuucuacucucuaaagagauggccuucuucaauuucauuuaaaaaggaaugcuuuauauuaucaugaauuuuaagaugaaaugaccucuccucucgauauuaucaggugcucuauuggcacuuguuuaagugucuaucaaccuugauuuguacuaauguaaugcuuauaugucuuucuucuccauuaaaauuuuaucccucaggggcaacaaugauuuuuuuaaaaucagcuuucauaccucauauuuuucugugcauacuaguaauuaauuaaaucacauuaauuucauauggguaugacuauggucuaaauaaguuagccuuauuuaaaauaauuuuugucugauucuuagaguuuauuuuuccccauauggaugaaaccuaaguauuaaauaccacagacauaauuucuuauuucauuugguguauagacuaggacuaaggguaagacagacccaugaguuuccaaauauguaauaaaaugugacauaauccauguauuuggauuaaauauauaaagauuaaaagagauucagaaaucauggauagaugaaagaauguuauguagaagaauauaguuuaaguagaaccuugaagaauagguagaaguaagacauuaaagaguaaagaaaggacaaauugagaaaggaacagcguaagaaaagucauggaaguagauaauguauggagugcgcacugauagguauuucauuuagcugaacacuaggguccaugagaagguguagagagaaguaaagguaacugaguagguuggaacuagaaggaagauacagaaaaauaucugacuaauuugacacaauuauauuuaagaugucauuaacuuuacauaaaucucagaaauaaaaaaugaucugaguugacuggcuucccucauuagucauaugcugaaaaucugguaaggaaagagacuuauaauacugagacaauauacuaggcagucauuaaagaauaaaaaagaaaaaagcauuaaguguuucuggaagaauuguauucaggaggagugugguaaaauuagaacuauacauaauccucuccugcuauuuuugcaacggaaaauaguagcucuuagagaaaaaaauaguaauauuauuaggcuugguagaaauuuuaaaccacuauaagcauaaaaucaauuuuccagcucagcacuucuuuaguuuauauauuaugcacacauuacugaggcagaaaaguuaauaagccuacuagcucuugaaggauaccacaaacaaguaguggaggggaaaagagcuucuaguugaggacauagagaacucauuccauuccuuagcagcuucucacuuuccaaacuuucuaaaagcuuaacuaauauuauuagcacauaauccuaacaaccauaaaaccauuuuuuaaaccauuaaacuagaaacggggagcaugguggagggaugacaauuuaauccuuccccaaaucacucugauaauaguuacuccacaaaggccacugccacucaugaggcagucucaaagucaugggaagaagauucuaucaaauaugcagcugacuccaagagaaaaagaguaggccuggguaauuuagaacuauaaauagaauaccuacauuacuuauuauugauaaauauaagacuguaaagugauuccguaguaaaauuucauaguaaaagggaacuauguauaugagagcucuuagcaucagggcacucugccaggcauuuuacauauacaugauguauguaaaacgauuacauauuuuaauauagccuuaguaaagauaaauugaauuuuuacuaaaauuuugugaggcaggcaucauagauaaauaaaaugugguuuggagagccaagauucaaauccaguuuggacuccaaagcccagguucuucucaugauacucauugcccaucuauguuccuucauguuucuaggucgggccuaccgggcacaggagacauagcagcuccucacugaucugugugugggggcucuacauaaagcaggcaaugcagaaaaaaugagaauugacuguuaguacuacuuggaauauaauuuauccaaauauuuauaguaaaauucaauguuugcauaaacuguaaugaagcaccuaccauuagauuaguugugaaguuaugguacuuacccucaaaaagagaaaacauuuuuaauuauguucacucaugguuugggauuguacuaauuagcacuggaaauuauuagauuauuacaauaucauuuaaaugucacccugugcccauuaaccuuggggaaaaucagaauaauuuuaucuauggcacuuagagaacagcacaaacugaacuuuguucuuuauugcaauggccucagucuaaauaaacugaacuuguucuuuucaaggagauuucauguuguuacagaggacagaacucacaaauuaagcccuccaggaaagaauggaucauuagacuaauuguaagaaaugaauucaaaaccaaaaguaaucaucuuucaaaaccacaauccaaacuuucucagagauaaagacuacauaucuggcuaaaacaaaguuauuuauuuguaggugugaguuugccuauuaaagagaguccacuauuuaaggaauccucccauaaugugauuuuauaaauaucuugaauuaugaaauuuucauagucacagcaccaccagaaucacgugaucuucugacaugcauuagcaguaacaauaaugauaagacaguuucagcaugaggaauaacugagauugaauauacucaugaaauuagauagacaacccaacaauccaccaacucucaaauauaugguugauguaagagaauaaugacaucgggcauucaaaauuagaacuaauguaaaaaauuuuuguuaaugaaucuaaaaguuguauaucuucuacaucagaaaugcuaaacaauguagccacacuauaaagcuuuacucaggcagaaauaaucuaucccacaccuaucaugugcaagauuguaauuaauauuuaaaagaugcacacaacauauauccugcucuguagaagaaaacacacuaaacugcauaaaacaauugaauuucagggccuguggagaaacaauauaaaagaagcauauuuuggaauaccuacugguaugaaacauuucuuuaugccuaaugcaaaaacagaagcuuaaagugauuuaaguaaauguaaugagaugguuuauuaagccauggaaguaagguauaaacucaagucugucuggccccaaaccuguauauauuucuauuucuccaguguauuuugcaagaagguuauuacaugaaauaaagaugcaauuguuguagaaguuuaagaaauguucaguuuuaaaaaguugaacaaacuucuucauuuacucaaggacuuuucaaagacuuccacacaucaauaugcuuuuuaagucuucaacauuuccuuucaaauaaggauauuagaaagauauuuugggaaagacugugcuauacucugcugucucuaucacaagguauaggaaauauucaggaagauaucaaaggagggugugauucaccuaaaguagauuaaaaaauuagaaagcggccgggugccuuggcucacaccuguaaucccagcauuuugggaggcugaggcggguggaucaccugaggucaggaguucaagaccagccugaccaacauggugaaacccugucucuacaaaaaauacaaaaaauuagcugggcaugguggcgggcaccuguaaucccagccacuugggagacuggggcagcagaaucacuuguacccgggagguggagguugcagugagcugagauccugccauugcacuccagucugggcgucaagaguggcacucugucucaagaaaaaaaaaauuaguuccauguagaaggugggcuucaacaaggucuggaaauaucaguaggauauaagugagauaaaugagaaaugagaggauguuccaggcagauaaauggaucuaaccaaagguacagcagugguaaugaccaaugcaccuuugugaaacauugaucaauaaaggauuaaacacuaucauaagggacuuuaguauuuugcaguucauccucaauguaauauucagucuccccuuuugcuuaacauucaugaugugggcuggggaaaagaauaaaauaugauugcuuuauaacauuguagccguauuauaacaggcuucaaaagagagaggaacagaauuguuacucauugaccucauaauaaaauacaccuggcaucugccuacccucugccaugcuaaguauguggggugggaaaagaggaaagggguucuaaugggaggcuaucucaaaagcaugugaguaagaauuugauuugggacuuacuaucaggccacacuaugaauccagcugcaucucauuaagcaggcuccccucuccuuucuucuccacauuuauccuuccucaagaaggcaccauuuuggauuauggaauauggaggagauaugucccucauuuagaacuccuaaaaugucauuuccuucaacuaucucauuauuuaguaaugauauaaggccaaagauauucuaauaauacagauguuaggaaaauguaaagaaaaugccuuucagaguaaauuaaaaauuauacugauuugauucuuuugugacuuuuaaugaaauuauaagaagucuaauuuugguaaaaaauuaaaauuaauuauuaggcaaugacuauaucucuccacauucaugagcacuuugcaauccugaguuaugauuuggucucaguguucaguaacugcuaacagcuuauccucuuauuuguauacaaaccugucacuugaguggaauuauaguugccaauuuagaaaaggggaguugauccauguuuuaauauguaaauuuguaauaacuuauguggugauauuugaauuuccuuuguuuaugcauagacaguagccucaaugggauuuucuucccucuaaguuugauaucuuugacucauaccuugcuuugacuguggaagacaauaaaguggugaaguugauaagaaaauaauacagguugagcaugucgaauccagaacuccaaaauccaaaauguuccaaaaucugaaacuuucugagcaccaacaucaugcucaaaggaaguacucauugaggcauguuggauuaggaauacugaaccuaaguauaacgcaaauaucccacaaucugaaauaauccaaaaugugaaacacuucuugucccgagcauuucagagaagggauacuccuucuguaauuagaagaaaaaaacucuuucuuaaauguagagacuggauuuucuaucaguaaccaguuuaucaauauuugauagucugauguuugcauggcaacuauacaaauuauaugugcuuuaaaaucuauauuaguaaauguuacauaacuaugaaaguguuuauguauauuuaucaaauggcuuauauauaauaaaauuaaauuaagcaaaauaggaauaauuuacuuuuaaguuauaggcauuggcauaaauaaugaacaggcaaacuguucuuagaaguuuucauagaguaaggugcauauaaauuaugcugaaaacuggagaacaguuaauagugaaauaaauauggaauagguuuccagucacaguaaauuuauuaaagguuugacucagcuuuuaagagauauaaaaccaguaauugucucgucuuuuguugaccucagccacaaauauaucugagaucaguugcucugagggcaccaucagcucuaguaaugaauucauuauuuccauuuaucuuacaaaaaauacuuaugaaaugugcccuuggugcaaagcucagugcuggacacagggaauacaaugccuugcgaagcaugaucuagugguucacagauagauaacccuaacugucauaaaaggcagcaucuguuggugccuuugauaaaagcacaacaaaacaaagaaauauuaaagagauuagagguaggaggaauaaaagcagcuaggcucaccagggaugucuuguuggagcaggagggauuugagcagggacuugaagaaaggauuauauuuuuaaagaauggacgguagagugaauuucagguggagugaauuucaaguagauuaaaagcuucuugcauuuacuguaagaaaaauagugcuucuuuuucuaugaaagaaaaauacugcaaaugcucaacaacguuuauaaaaguucaauuuagaaguuuggccuuuaaaaaaugugaaugggauaguacugaaguuuuuugauuaggagaaugacauuuucaaaaaauagccuuuucauccccaugauuauaaccucagucaaugucaccaucaucucuuacaugaacaugugcauaguuuucuaauugaccuuuauuuuacucuuccaaacuccccaucuaagugucuauauaucuuggcauuguaaaaaugaugagguuuuauaagauaaccucugugauauucgaccuucccucacaggaacaauguuacccaauugcaagcauuugagagagggcuggccaaauguaagaaacuucauuggcuccaaaaauagaauggaggaauccuacaggcugugauuuuuagcuccauucucagauuugugaugacaaaaucuagaccaaguaaauaaaacuaaaaauuauucuggcccugugauucuaugcaaaguaucugcagaauauuucaauaaugucaaggcauaaaaguuuuuuaaaguguaguaagcaugcguguacuuaaaguggauuuacuucagcuacuuagguguagccuucagccuuucaccugaugccuuuguguuucaguuuaguuagauacacaguacaaaccuaggacuagaggauguccaaggcccuucuauaaauuuauaaugccauauauaaauacacauuucuguucacuagaaguauaugaaaucgacaguuugguuauauauauauauauaaccauauauauauaugcagugaaguauuaaaauaucuaauacacaaauauaagguauauauuauauauauuucugcaguaaaguauuaaaauaucuaauacagaaauauaagguuuuauuugguugcaauuuauuuccauuuuagaagaaaaaauauauguguuaggauauacugagaaguuaaauuuauguuguauuuguagauccaugcauaauuuuccaugucuuuaauaucucuuauuuccuguuuccugaucaaaaaagccaaugucauuacuagcuuaagaauaaaauaucaaaucauuauaaaauuaaaauuuugaaaauuuaaaauauuuuauuuaauacauuuuaaauaugaauguuuguguuuacaagugucuauaguagaauuugaaaaucugguuacuuguguaggaaacaaaugaauuuuugcauuuaaaaaauaguaaaagcuauauauaauuuuguuaauauuuuaaucuuuuacugcugaaaauuuuccauaauuuuuugcaaacaaaaaccaagaaggggcaaaagagaacacuucuacaagucuuuuauuuugugguuucuccuuauaaaauuaaaauucagcaucguuuucucuguugggcaauagauguuuuaugaaugaaaacuaaaagguaaaauguccuuauuaguaagagcugaugauuuuauuauacuaggauauuacgugagugguaggcagcauguaaaacgguuucccaugauuccaccucccaguauccuuguccuuguguaauccccucaccucgagccuauugauuuguaucuaauaauuagaauauggcaaaugugcuucuggggcuugcucauacuaacuagagaggcuguugccauguuguaaacuacucuguggagaggcccacaaggcaaacaaguggucuccagccagcagaugucaaaaacuugaacaaagugagugagcuuggaauuugauacucacucacgugagccuucagaugacuacauccccagucgacaacuugauggcaaucuugugaaggacccugagcacuagacauacagcacccagauuccuaacccacaaaaacuaugagcuaauauauuuuugaugcugugagccauuaaguuuugggguaauuuguuauauaacaguaguuaacuaauacacugcaaaauaauaauaauaauaaaugauccaaugaaaauuagcuuaaaucgccuuucaucucaaauaaaaaaauuugaauuaacuaggauaauguucuaaaaauuugaaaggcaaauguauuuauuuauaguuuauaucucuaaaauuugauuucaaauuuuuaauuaagcccuuuuuugugucugguaaaggaagaaucaaccuuugaccauacaaagaaggauauaaaaaaugagcauuaggcuuuggaaaauccuuagcuucuauagggaacuuuuuccuuugccuuuuguuauuagaauuuauuggcuugugaaggaaguucuguucaaguuguuuuuaugcuaguggcccuccuucucaccuuaggacacagguuguccacaacugagcuuuccccagugguucaguuuucccuggagauuacaucucagauuagauuugggucuccuucagggcccauugucauggguaagagaagccaaagaacauaaauuauucaaggaggcagggaaaagguauaugucuuugaaaucuaggaauucucucaaagucaucccugaguaccaucugccagagaauuuagagcucacugaggcagccucuaacaacugagggaaaaaugagaagggugaaaugcaaacuuuuauaggaaaaaagaaaucaaaauaaugaaaaauccucacagaauugaggagcaucugugguccaauacgcaacaucacaccccugaaauuugaagauaacuccauccucaacauggcuuggaagccaaauuugaaaagacaggaaaugugaaaagcugucuuuacuucugacaaaccacagacgagaaguuaaaaagccucgagaacaugccaaaaugcaauuaaguaaauuucaucccaauauuuuaggaaguuuuucucuauuuuucuucauugccagaccccuagaagauaugauguaugccagcugccuucauuuuucucaccaucucuuccuuccauuucuuuugcaaucuguuaucauccugaacacuacugagauggauuuucacuauccuuaaugaaauugaaguuaagcuucuuuuucuccuacauauuacuugaaauaucuguagcuuugacucuuaaauuacuucuuucauccugguauguucuucucccuucacaguuucauaugaucuaaaucauucuccuauaacccuacauacauuuagugcaacuuuacuucaacacaaaugcuaacugcggauaacucucauggguuaauauggccuuuuauauucacucagugagggaaacugccuuccauacccuacagauauuaaauauauucacacuccucgacuuggcauucaagaaccucuuuuauuuaauauuuuaugguacuucugccugcaaacucaugcaacucucacgacuggaucccacccugaaaaucauccuucucuuuuugaaaaauauucccugcauuuuaaucaguuaauuuuauuaaacaacuguaauacauucuaaccuuaugcaaaauaucuuauuauaguugccuuuacugacgagcaauaaacacaauuaccauaacuugauugguucaaagcuaaggacaaaaggugagaaaauugagggccaaccaguaaaaaauaaugucugacaugacacaaauacauaacgauagagcuagaaguuggauuacauguaauaccaauacuccugauugggauucuauucagagauugagaaaaauauuuauacagaucauuuaucugagaaguuacugcuagaauaacuacuuucauaauaaucucuuuuuggaaacuugucuacuauaauaaaauauuucccauaaggugaaaugaaaaauguccaauggauagauuuuuuucuaccaaaaauuacauuagcuguaaacagcuugacauuacccaggagucaugaugacaggcaaauuacucgauuaaguuguuaacaaugcauuuacugauauguuuucaugucacugacauaaacuuucugaaaugagaacuuaucaaauuguuuuuacauuuugucuauaaauuugaaaaaaauggucuucagcaagcuuuauacucggaacagaaccuuguacauuucaaagugcuugagaaaauaugaaagucagauuucaugugauaauuauuacuuuauaacagauucuuuguuauuuucuaaaucauauuacucgauuucucuguuucuuucuuauagacggcaucacuauagguuuacugccgcucauaaaugaacacagcauguguauacguauauaaaguuauguuaacaccaugacaucuuucuaauugccccuuugcaaucucagcuauuuccauucuaggaacaacagcccuucuguauuaucaguaccuugcuuuucugcucccuuuagucucucaauauauacauaccuaugugauuuucauguuuuucauguuuaacauaauguuguugaauauguugcugaaauauauuuggccaaauccuucaagauauccugauacuaugauucugagauaaauaaaaauguuaaugauaggcugggcacgguggcucacgccuguaaucccagcacuuugggaggccaaggcagguggaucaugaggucaggagaucaagaccacucuggcuaacguggcaaaagcccgucucuacuaaaaauacagaaaauuaguuaggcaugguagcacaugccuguagucccagcuacuugggaggcugaggcaggagaauugcuugaacccagaugcagaaguugcagugagccgagauugcaccacugcacuccagccugggcgacagagagagacugucuaaaaauaaaaaaaaagaaaaguuaaugauaaggauuugggaaguuggggagguaugucauuaauaauagauguaaguggucaauauaauuuaugcaauuaaaaaauaagugagaugcaucaaaauauuuuauguaaaauauauacauuauaaaaauaccuauaaaucaaauuucuauguuacugagaauuacgaagguauacaaaugcaggaggagucauaaaugacauucuccuaaagaaacaagguagagacuuacccaaaucaacaagcuuuugcucaugguauauucuguucaacacauuaaaccaucauucuucagcuuuuauaugaauuauccuuuccuaugcuaucaaagacagauuauaccaccaaaaaaauucaaaacacauuauaaaaauuucauauaaagaauuauaugauguguuguguuuuacacagauuacccaaugcaggugcauucugggaacaaaguuagguccgucuuagauauuaagcuauaauugguaaucacccuauucuaaguuccauaaagggaaagaauuucgaaggagaaaaauuauggccucuuagccuugcuccccacccaccaaaaagaagaaugacucauccuauaggugauaucaaagaaauaagcaaguagguauguugcagccugccucuugcuugcccccauuucauuguuucacuuaugugagcaaaucugcucaccaaaacacacauucugaucuaccuuuggcaaaaucauuggagcaaccaaaggugacugagagagaagacuggaauuguucagcuaugccugagaugggucaguucagucuauauaauuccaaagggaagaauuaagagacuugcuuugcuuguuauucuaaguccccaagucauccaauccaacuuuuauuaguuauaauguugaacuuugccuucccuucgucuggacauucuuuguugcuccccaaaacuucaacucccuauuugcuaagacauaacccuucaucuuuuccuuuagauucuuaagagucaucuacuguagcugagcuuuuaaaaucugcuucauucgaucuuaagagaacgucuuccucuggaaacuccuauauucuccauuaguuuccaucucuucucuucagccaucauggauuuuacuaauucaucauuugaauagcucugucuuacagcuacuucacaccauuuugcagugcaacaucugcuuucucuaccuccucuccaaccguuccuucuguaacccauuguacuucccacaaguuuucugaaacuacucuaucaaaugucacaaaguaucugcuuauuauuaaauuaagauaguuucucuucaguauucauuuuuggcuguugugcuaauuuuaauguucacaaaguuucuauucuuuccuucacaguuuucugggauauuacuacuuuuuuuuuuuuucauuuuugcuuugcccauucugcauucuaguaucaguaugguuuuaagcucugacuuuggucuuuuaacauuuaaucagaaacuuaguuuuuccucauaccgaaguacugcuaacucugaauacaugcacuacccuuucaucuaaauuccaauuuugaauuuucuuucaucuugaauguaucagucaccucaaaaucaaccugaucaaaacugaaauugucacuguuccucuaauacugcccaccccuuaguguucuuauuacuauuuugccuuuaucuuagguuuuacaucauaacugacuuuccucagcucuuuuuuucucuauuccuuucuacuggagagagagaaaccuuaucucucuuacuuaaaaugcauuacucauaaauaugaagucuucuccauuccuagcagcaucuuuccaguagaggcccuucucacuucaugcauagacuacugcagcaauccucagcuuccucuccaaccaaugcaacauguuuauaauugucugauguuauuaacgaugguauuauuuguguuuguacuauuguuuaugauuuauacauuucuucuucaugcaguauaaguccauuaauuuaucuccaacaucuucacuaaugcuuguacauugaaugcacuuaauaaauguuuguugcaugaauagaugcauaaaugaaugauuagcuaaaacaaauguaauccucccaggcacugacacauagaauuuaucuaucucugagauaaggcagauauuauuaguugcauuuuauagaugauaaaguuaguuuuagacaaguuaaaugucaaugcuacaggcaacuaagggacacaaucugggaucgauuguauaaugugugacaauguuuuauacauuugcacauaauacuucucacacuaaguuucaauucuuaaaauaacauuucauuguguuaguccugugacauaagaaaugcguguacacacacacacacacacacacacacacacacacagguguagauguauauauuucccuucaaagaaauacugauuuagauuuccagucuacuauuuguuggaaugacacagcuaaucacuuagccucuguggaugucaucauuuauaaaauaaaaugauacuaucuauccuuucaaguucacaggggaaagaucugccauauggaaguuuaaaauguaaagcaauaugcacacuaucuugugagaccuuacuuuuagugauccccauuuaacaaauuuaaugaaaaagaaacaauuaaccagaaucagaaaacugguuuuuaauuguuuauggagaaacaauuuaugacugauuuuucaaugaaguucuaaaauuugagacuagucuuugcaauguaacugcuuaacauuaaacugcaaguguucuuacacuuuuuauaucaaucagaugcauuccuuuccacauuaauauuaucuuaaaaugaauuuaguucaaguauuacauuuuugauuuucagacuuugcaauuuauacaguucuuuuuauuuccucauaguuaugacccaucauguuuucguuuuguuuuuagguucuucuccgugcuguaaaguacccugaaacugugaaggugcccucaauuagagaggcugagaaaacaaggaucccagagcaagcucuucaagccucagacagagagccugccaaaccagucugaauauuuuuagaguaaacaaucauuaauaaauaugagcuacauuuauacucacaggaauccagauuauacucauacuuuuuuaaaaaauggguugccucuaaguguauucaauucacccaugaagaaauuuuguuaacauuuaaugguaggugucuaaugaacaucuguggaauauggaauuaaaagaauaaguugaugguucuuaacauacuauuauaaacuaaauauguauuacaacauuuuccuuuuguagauggaaauuauucuauacuucacagauguugcuuauauaguuaauaaauacucuacaaacaaaaaauauaaucuauguguucauauuuacuguugccuaaaaguugucaaaauuuaaaaaaccauaagucuucauuauaaucacaaaguacuggaacaaagcauuuugauauuccauccacuucuaugcaugguaaaaucaguggcucuauauacuguaaauguauauaucaaugucuuauucuggaaguucagguaaaacauaaaauauuuaauuaucucacuguaauacacagugguuccauuugaaaauuaugcaucucaaaauguugcauuuuauuuaaugaguucuuuuuaauguuauguggguugucucuuugaguuuuacccuaccaaaaagcuaaagagcuauggaauagcauaccucauuaagagaauaaagaguuacuagauuacauuaguauuucuucucaaguacauauagucauauagauuaugcaggguaucaagugucauguuacauuuuaaacaugaccacuaggauuuuaagaaacaucacgggcaucaucuuuuuuaagcuacuacauauuuauuuaugaaaugacuuaccuguaaccuaaacugugaaucuuagcccuucaaaaauggaaaucacaaaaauaauaccaaaaaaugccuuaaaauucuuggggauuucuuuucuuuuucuguaaaggccucaggcuaagauuuagauuuuuaaaacuuaaauagcccucagucccuuugucauuuaauaacaucaguuugacucugcaucacuugggaaucacagaguucagagaauuuucuaagacuaagaauugucagauaguuggaggugugugugaugugugugaaugaggacucauccaaugagugaagaaugacaaaaaugagaucacuuccuagagagaagaagacuaaauaugaauacaacauggugacauggugugguauauagucccugaggguaaccauaucucagaucacauuaaugguauaauguucaauuuuacugagccucaguuuccucauuuucaguagguaccguauaaauuacauccaacaaauauuuaaguguuauacauuccuucaaagugcaaaaucaauguggcauuuucucauuaaagcucaucuauuugagauuacuugguaaguguucauuuuuuuuuuuuuuuuugcggaagaccuaaaaaucuuuagcuccuaucaucaucuaucauuaguucuuucuuacauuccccaaauaagaguaacauguuuuggauacauguaccaaccaaaucucauuuucaauuguaauccccaauguuagagauggguccuggugggaggugauuuggccaugggggcagauuucucccuuugguacuguuccugugauagaguucuuaugaaaucuggguguuuaaaagugugugguaccuugcccuuucuuuacuuccuccuucucuggcgauguguagugcgggcuucccauucaccuuccaccacgaaugaaaguuuccuaagguguccccagaauaugaccagaugcugccaugcuuccuuuacagccugugaaaucaugagcugauuaaacuucuuuucuuuagaaauuacacaguaucagccaggcgucguggccacuccuguaaucccagcacuuugggaaguugaggugggcugaccaccugaggucaggaguucgagaccagccuggccaacauggugaaaacccaucucuacuaaaaacacaaaaauuagccaggagagugccuguaaucccaguuauuugggaggcuaaggcaggagaaucacuugaacccggcaggcggagguugcagugagccaaaaucgcuccacagaacuccagucugggugacagaacaagacucugucucaaaaaaaaaaaaaaaaaauuacacagucucagaaaugucuucauagcaguuugagaauggacuaauacaaugagcuuccuggauuaccaaacuggguuaaauaaaagggcauugaaugaauaccugcuacauggcaagugcagugcugagcacaagcagacuagaaguguaaacauaaggaagacauacaccuuguccucagcgaguagugcaccuaacucaacauauuacaucuuuaauugagaagucuugauuuugucauuuccauauuuuucuacuucuauauacuucuuagugaccauguuaaacuucagaguauuauauuauuccaaauuguccuucuguccucaguaccauucuagauguauacauuuuaucauuauuguugccuacucuuuugucuggaauucagaagaauucaggucuuguaaguucuuuuucuacuuaauuauuuuuucuguuuguuuuauuuacuucuuccauuucacaguaguagacuaauccuguuggaaucuacuucuuaaaguucauuuccuucaacuauguugccaauauucuccuuucuuuuuguagaaccuagaauuauuucaacaugcaguugcuuccauugagguuuccauucauuucuaaauccucauuuaaauccucccuacuuauaauaucaaauuaugugugagaacaaaaagaagcugcaaguugugugugcaugagguaugcuggcauauaaagaaagcaaugaaaaaaaaaaaguuccuuuucaggauuuuuaacuauuuaccccaaauaacaauauaaguccuguauuuuccauuuuggguaagacaaaauuuuaaaaugugaguauuuuuugauuugucauuuuguauguauauaaacugaaaaugucacaaaaucauuuacuuuccaauuaagcuucccuuuguuuguucacuagagaauuagaacucuaaagcauucaaaucucacuaaguuuguuccaauuguuuuaaaauguuuaaucaacucauacauaaaaacaaaauaaauucaaaaauguacugaguauauauuuucaguauaguaccugaacugugccuguaaauauucaauacaagaacuauuauaauucuaugucuaaaguguaucuucaguaagguaagcuaauucuauuauucugaauaaauguuauacauguguauacauauuuaauagucuauauacaaguauuauuuuaugaauuuuauacaugagaaacugaggcucauagcucauuagaaacauuguuaacuaaaaugagauaagauauaauagagaccaaauauuuagguaucggagaagcugguucaaaguuacagaaacccuccuauuuuuggaagagcaauucucaaaggauacaagaguaagacuuaaaagaucuggguucuagcucugucuuggcuacuuaucucucaggguuugugaaccucauaacugaaagacccaggaacaauccugaccuuaaacaggagggauguagggagccuagaccaacuauuugguguuuagcuaugagcauccauggugaagacuuucacauuaugccucaguucugaaaaucauucucaaggucuaaucuccacugaacauauuaauaauuacuacugauuauuuuuuccuuuguaggcaguauauaucauaauaguaagacuaggaauccuaaagcuaaucucagacuugcauguguauccacugguaguuuaaauucuacuucaauuuaggaaguccagaaaggguaaucucaguuuacuaaggugcauuucuauguuuugaauuccuauauuacguuugauuuugaaaaacacaacuacgugcacaugugcacgugcaggugcaugcacacgcgcgcgcacacacacacaugcaucaguauaauuuuaaacauuagaagaccuucuuaguuaccgaacaacauaaggucacguggugaaagaaaaaauaauaauagaaaaacuugguaaugucauagugcuagcuuucaaaacacucuuuuuaugggccguugcuuuucucuccaugauaaaagggucugucugaaaacauggcacgauggggaaaagugugauaacgaaaaauaaucuaaaugaucacauucaugaagcaaacaagcagacaauauuuuuccuuucuuuugcauguugguuucucugugugcuuuuaaaaaacaacaucuacaauaaugaucacacacauaaauauauuaaucaaagagacuucuguaauuaguuaucucuaaauauacagucacauuguaaagguugagcagcuuuuuuuaaauuaacugugccagauaaauaaagaggauugucccuucccugaacaggcagauugugauagggaagcuaggccuugguguaucggaaacuaacaacaacaaaaaguaaaucauguaaaagagcagcauuuuaaaaguuugccaaauagaaguacauuuuuucagaugcuccuagaauaaaguugcauugaggaaaaauaaauuugggaacagugccaguaauauuuuucauuuggagauuuauauuuuauguuagccuuuacuuaaggcucugagaaguccuugaaggaggacuuuggaggaagaaaaaucugagcuggcuuucguacauaugaacgugcaauugcauaaauagaugaaaugagugucgcagccaagugaaucaaagacccacuuuaucuguuacauaaauggaaaauaaagcaccauauugagaauaauauguuggcuauauccuaaagauuuucaaacauacagagacagaaaacagauuauaauguuaaaccuuuuaaauucuagaacuuaaauuuaccugccucccauuuugaacuuuaaaguaugccaauucaaguacagaaaaauauucaggcaacauuuucucauugcacaagcuaaaaucuggaaccaagcuuacaaaaagaaucaaccugacguuuuagaauuuaaccugaauucacuggacguauauuuuaaagcauuaugcugauuucauucuacucuuagacaugaccuugagcaagagaaaaacugguaugagaagaauuaccuugcuuagaacagcauugcuaugauauucauaggcagcuauccauggggaccuagaauauaaagccauguuuuucucuauugugcagugcuaaauuuccagcaauaguccucauuuccucugccuuaagcaucuaccacacauuuuuuuuuuuacuuucuuuagcugacauagcaaauugaaaauagguuuucauuucauucuuuuucaguguaaacacauuaguaaaguuugaagcuaaaagucagcuuaguaugcaacagucacauuagcucuggcauucaggucaguggcuuuugucuaggugguagcaugaaccagcaauuucaaucaaagcaaguggcuccccaaaugcuuagaaauaugaaauaugggauguauuucucgggugccauaaaaagaauaaagguguaaaaguagcagcauaauuucugggcucauuaccuaauaaauaaaucccugucauugaacauaagaaugcggcaugauuuagaugaagcuauauugcucaaaucuagcagaggcuucuguuagaaauaaagucaagaggacuacguguguauuuucacaaauacuaugcauguguuauuccagauaaagcuaacacauaauauugguuacugaaaguuaauggaaaauagauaaauuaaaaaacugaaaugucagugaguuaugugaccuuggucaggucacuuuaccucaucaggucacacucucucuucuggaaaugaaaaggcugaacugcgucagugcucuuuuaauauguuaaaaugcaguucacagauaauauagccaccuauacucuuggcuucaaaaaaucaauuaaaagcauugaguauaauauaaaagagaaaugagcaauuuuuaugauaaaaugauguauacuugaguauauaaaugcucuggcgcaaccacauugaagacauagcugaagucaccaggugcuuacaccucaacagaaucaaauugaaugacauggcagcaacaaaaacuaauaccaguuguacgacucaaacagcauaaaagccauuucccucaguaaagagauuuuuauaaaaugaugauuaugcaaaguucagugguucaucaguuuacaugacaguuacauuuucagaaaauucauuaaauuucaaaaccaggcaaaaauuaaauuuccuuuuaagcaaacagucaggggucucagcucagauaauuacagggcaacauuuuguugagaggaacuccuccaagaauugcagauauuuaucaccucugaauucugccagccacuaagcaugaguagaagccagugaugugcaacaugucugcucucaggaaaaagucaugacuaguauuuggcaauuuucaagauauaaauacuccaaccauguucuuugucaagcuaccaacaugauguuacugugugcagaguuggaauuagcccuuaggauaacugguucucacaccacugguaaaacucuguaagcacuauguuaaacaaaauuauuaagcuucccucugauaauaacugaccaaaaugaucuguugauuucugcuaccauucccacaaugaauugauuuuguuauugccuugaauuuugacacugucauuuuuuccuauuccaucuaucucauguaccaacauaaaauguuaaccugcacuaaaaauauuagggaaagaauuacuuuuuugugcuaauucaccacccauucauucauucauucauucagcaauuauugggcauuccagguucugguguugguuuuagaaaaaacuuaaucaucuucauggauuucaaaagcgaaugcacauauaaaaaugcuucuugcaaaacuaaaguauuugauggagugaacaaaauaaaugccugaugauuggaaagugaauuuucauuaaggcuaauaggaugugcauauuauaagaauaaauauuuacaaguuaauucuuaaaguauaugaauuuuugcuauaaaauuuuuauagaacuuagcacuuacuauuugaaauugguuauuuuuaauauuaugugcuauagugaaaauaacauuuaccuucuuauucucuagacuguucacacagcucugcuaacuuauuagcagugugaccuugggcaauuuccuaaccugcaaaauggagauuauaaugcuguuuugugcuggguuuugagaagagcagaaauaacauaguaguguguuuggcaugcaggagcaguauuaccaauauuauauuauauaucuuucuuuuccuccuagacuccaaguguucaaggaaaauucaucucucuuccuuuauaauaucugacagaauaccuugcacuuuuuuaacuuuaguaaauauuuguagaauacaugaguuccaaaaaagaugagccuaucaugguacuguuuguuuauuuagaagugcaucaugugugcacauauaacuauaaugcugaaacagaaaaaugcaaaaugaauaaaaacucauuagauaugcaagaauuauuauuuagaagaacagggucuacuagaacccacacguacuauaaucaauuauuaccuucugauuguuuacuuacuaauaauuuaauauuuaugccaucuuagcauuuucuuuuuaaauuuuuauuucaauaguuuuuggggaauagguuauguuuaguugcauggaaaaguucuuuaguggugauuucugagauuugguucacccaucaccugggcaguguacccuguacccaauguguagccuuuuaucccucaccucccuuccacccucccaccgaguccccagaguccauuauaucauucuuaugcucugcaucuucauagcuuagcucucacuuauaagugagaacauacgauguuuguuuuuucauuccugaguuauuucacuuagaauaaugaucuucaacuccauccacguugcugcaaaugccauuauuucauaaaugacauuuuuucuuuuuauggcugaggaacauuuucacuguauccuuaacuuuaaccaucuuuucaacaccucugugaagaaagcagguaaaacuguucuuuuugaucacauucaagaaaaguuuagguacaauggauucauaaucuuuuuuuuucuuuuuccuccaccuaggcuggaguguaguggugugcucaaggcucacuccagccucuaacuccugggcucaagugauccucccaucuucaucucccaaguagagaauaaauaguauacucagaacugcuauacuuuuggucacuccauaauuauuauaccauaucagcuuuucuaaaaaguuaaugaggauaugcauuugggaacuacauuuucaaauauucuugaccuaagaaccacaguuauuacauugugauauggccuuucuugaaccuuauugcaaaaaaaggauuaagaguuaaaauaaaaaagaacacaaacacacuucacucagcacaaucauauucuaaaaaucauaauuuugaggaaaaauauauuuuagaaaucuuccucuucuuuuuucuauguuucaccuauuuaaaaaaaaucacaauauuuuguugugguggugguaguuauuccaggugaaaggugaacaaccaggauucucuaacaguaaauuaagauuuuuuuuuuccagaaauaucugucuggaucauugcccacucucacccucuacauggaugcaaacacuaucaucauuuaaucaauguguuaauuucucuucacucuucauuaaaaacaauauuuucuuuuauuuuugaccacucauauuaauuauacauguuuuaaaugaaaauauuuaggcauaccaaaucauguauccccauguauuaauccucauuuugauaaauaguacuggcuuuaauaugaacauagauugcuauaaauuugccugugaaaaaaauuagauggauuagauauuauuauuauuauuauuggaaaauugagauaagauuaauaugguuuuuucacauuccaugaagcuuucaaauauaaagauuaaaguuuucauuugauuuuaucauauaacuaaaacauuuuuugauuucuuugaccaaaaaauuguuucuugaaugucaagauuuugauuucuuuuuuuuuuccugacucuuauuuuauuuauuuuuuauuauacuuuaaguuuaaggguacaugugcacaaugugcagguuuguuacauuguauacaugugccauguuggugugcugcacccaguaacucgucauuuaacauuagauauaucuacuaaugcuaucccuccccccucuccccacccuacaacaggccccagugugugauguucuccuuccuguguccauguguucucauuguucaauucccaccuaugagugagaacaugugguguuugguuuuuuguccuugcaauaguuugcugagaaugaugguuuccagcuucauccauguuccuacaaaggacaugaacucauccguuuuuauggcugcauaguauuccaugguguauauaugccacauuuucuuaauccagucuaucauuguuggacauuuggguuggucacaagucuuugcuauugugaauagugccgcaauaaacauaugugugcaugugucuuuauagcagcaugauuuauaauccuuuggguauauacccaguaaugggauggcugggucaaaugguauuucuacuucuagaucccugaggaauugccacacugacuuccacaaugguugaacuaguuuauagucccaccaacaguguagaaguguuccuauuucuccacauccucuccagcaccuguuguuuccugacuuuuuaaugauugccauucuaacugguguaagaugauaucucauugugguuuugauuugcauuucucugauggccagugaugaugagcauuucuucaugugucuuuuggcugcauaaaugucuucuuuugagaagugucuguucauauccuuugcccacuuuuugaugggguuguuuuuuucuuguaaauuuguuugaguucuauguagauucuggauauuagcccuauaucagaugaguagauugcaaaaauuuucucccaaucuguagguugccuguucacucugaugguaguuucuuuugcugugcagaagcucuugaguuuaauuagaucccauuugucaauuuuggcuuuuguugccguugcuuuugguguuuuagacaugaagcccuugccuaugccuauguccugaaugguauugccuagguuuucuucuaggguuuuuaugguuuuaggucuaacauugaagucuuuaauccaucuugaauuaauuuuuguauaagguguaaagaagggauccaguuucagcuuucuacauauggcuagccaguuuucccagcacuauuuauuaaauagggaauccuuuccccauuucuuguuuuugucagauuugucaaagauuagaugguuguagauacguagcauuauuucugaggguucuguucuguuccauuggucuauaccucuguuuugguaccaguaccaugcuguuuugguuauuguagccuuguaguauaguuugaagucagguagcuacccgacuucaagauuuugauuucucacaaacaguccaggacauuucagugauaauuauuuuuacaauucuuucuuccuucauuuuuucacuuuuuacguaaagaaacauauuagaacaugagauccaguucauggacagcuaauuuuaagaauguauaggcauauaagaacugcuuuucuaaugcauauaucauauaucccagcaauuacuaauuugguagcaaugacaaucauuuaauuguuaguaauugagaaauaucuuuaaauauaaccauuuggaaguuuacuuuucuaucuguaauguaaauaauccaauagagaaaugaaaauaauggauugucuaggauuauaauuaccaaaaaaacagccaaaaguaauaaaaauuuaaauuaauauuugaaaugaauuaccuauggaacaguagauuaauauuauaagaaaaauuauauuucuaccuugaaaaaauauuuuaauacaaauaaaugcuauguuuuacucauuugcuaauuuuuugucaccauuaaugcacaggaaaaggccaccauuuuauaguaauaaauuuacagacacaacauguuucucuguguaaauuuaagauaguuaaacacucauuaguuucaagucuagaaacaaauagaguacacacuauauugaacugcaaaucguauauuguguuauguuaucuaucucaagaaauaagcccauucucauccugaguauuaauaaaauauaguccccugcuuuggaacacauuucucaauugaugucaaucacauuccuuaaaguuuugcucaaaauucaucuccuauuagacacuuuuuuuuuuuuuuuuugagauggagucuugcucugucgcccaggcuggagugcaguggagugaucucggcucacugcaagcugcgccucccaggcucacgccauucuccuuccucagccucccaaguagcugggacuacaggugcccaccaccaugccuggauaauuuuuuguauuuuuaguagagacgggguuucaugguguuagccaggauggucuugaucuccugacuauuaggcauuuuuaauaaugacacucaccauacucugacuugccauuauuacaauaccuuacauucauuaauguauccauuuaauacauuauuuugugacucuuccuugugcugggauccauccuaagacuaggaaugcaguaauagacaagugugaugucuauuuccucacagagcauguagaguaacagcuguuuauggaguauuuacuaugccaagggcuggaccuauauuauuuaaacuucaaaacaacuuuguuagacaaguuugcuggauacaacuuaucccuuuuguaauugcuuuguggagcuccaagucauacuuucucaugagacucaauaggcaaaugcauuuccuuuguuuuguuuucuuacaagcaacuaauaaaaacacugagcacauuagucauuuauacacauuguugaguuacaggaucauauagaugaaaaagaagcaucccuguacacucaauuuagaaucuacauuuaucaggcaaugaugaaauuugagaagucuaaaacugauaacuauuuuaaucuugaaaagaguuuagaagaaugagaacaauuguuaggguuauugaauauaaaguccuacaggcuuggguucagauuacaaucuguuucucaugaacuguuuugaacacuagugagagaacaugcaaaauguuagcccuuaaaauuagcccuuaauaagaucucacagauaguuauuauauauaaucacuaacagaucuauaguaaguaacuaauaaauacagaaaaguaaaaugauuuaauuaugguuacauacaagaaucauaaugacuacuucugagaaaagaaccagaagaaauagggaaauggcaacaugaagauuggacagaagauaacauuuucuuauagagauggagagaggguuuucaaucuacuuaauacauugucaaaauaggauaugaaaucucauuguauauuuauuuauuacuacuaauucucuggguggucuugcucaaauuagacacacacacacacacacacacacacacacacacacacacacacaccgcaaguuuuuggaaagcagaucacuugccagcuguuuguauuccaggaaugucuuugaaaagggcaauagacuguuugcaaacacaaaccaugaucacugcucacaagacaaguacuauuuagaauugcuugcagaacaagccuauuaaaacauaauuacucauauaauauagcauauuuguucuggguagauuguagcaggaagaaauauaagaaaauauauuugcaugaaaacuuugaaauccaaauacuuucuccuuucagucauuacaaaaaagugccaauuaaaacaacugcuuuaaauucaaucauaauugaagauugguaauuauaaaucuauuuuaccacuguagcuaaagggacacauucaaugcagcucacugcaaccuaauaauauaucaaucuaggucuuucacuauuccugauguagaucaaaaauguguuauucucuuuaugaacuaaacgcuuauuaauuuaggggaaaauauuagcuaauuaauaauaguauguauauaaauuacuuaaauuauauacaacaacuuagaauaagauuucacguucauaaccaaagugaaucccucaucuccaacauacaaugagugcacaaugguaaauuugucaagaaaaaaguuguaaaauauuuaaaaauagaacauuaucauuauuuagugaaauuguguauugaaggguauaaagaggaggaguguaaauucaugcuugguuaagccuauuggauaugaagcugaaguaagccuauuuauagaaggaagacugugcaugucuccuuuucucugaguauuuacaauucuacuguucuuuugcuaacugucuccugaacguguuauguuauauaaggcacuggcuaauaaauacauaguaacuacucaucuaggguauucauauggaaacaaacagaaaagaaacauuuuuuucaggucuaauuuugaaaaccgcaucuuaacagcugcuuauuacacuuagucauucuugggggcauuuauugccauccauuucucucagacgauuugcauuuaaggaagaaaaacuggugagcaagaggcauauaagagaaaaaaucugggaagaaaauuauuuuuuaaaggaaagaacuaaaauagcaagauuuugaagauauuuccauauucacauauguauucagguuugaagaaauaacagaaaaguaagcaaaaaauuaaaauaacaaucuuauuaaaguuuuguguaaaucauuuuuauuucaucuucauucuuuaagcacuuauguaaguugugaauaaaaaauaugggagaguuaucaguauuuauaggauauuaauuuaaauucuacaggguaggucugucuaguacuaugcaacguagugagaggugaagccggcuggguuucuggguuggguggggacuuggagaacguuucugucuagcuaaaggacuguaaaugcaccaaucagcacucuguguccagcuaaagguuuguaaacacaccaaucagcacucugugucuagcuaaucggguggggacuuggagaacuuuucugucuaguuaaaggauuguaaaugcaccaaucagcacucugucaaaacagaccaaucagcacucuguaaaauggaccaaucagcaggauguggguggggccaaauaagggaauaaaagcaggccaccggcgcaagcaguggcagccugcucacguuccuuuccuugcuguggaggcuuuguucuuuugcucuuugcaauguauccuaaugcugcucacucuuugggucugcaacgccuuuaugagcuguaacaaugagcuauaacacucaccacgaaggucugcaccaucucuccugaagccagugagaccaugaacccaccaggaggagaacaaguccagaugcggccgccuuuaugagcuguaacgcucaccacagaggucugcagcuucacugcugaagugagcaagacgacgaacccgccaaaaggaagaaacuccuggcacaccaucuuuaagaacuguaacacucaccacgacgguccguggcuucauucuugaaguuagcgagaccaagaacccacugaaggaaccaguuccagacacaauagauuucuagggcagguucacuuaccacuuguuuuaauaauaauggaguuuaauugauacacuugcagacgaguguucuuuuuuagcuugucucuugguaauugcaugugacaauaauugcuguuccucuggccuuuuaugacuuuguuccauguaaauuaauagcuguuuugagugcuaccuuaguacauuaggucauaacugcaaucccaggaaguuuauauauuccaaauuuaacaguagggaaucuagucccuggaauuuccaaaauuauaaaaucaguaauaaagauaguuguuuccauuguuuuuaaggauugcauuaaucauagcacuugggggaaagagaauauuguaguacaaagagaaauguuuauaagaaaguugaaauauuuuggaaugagugcuuuacuuugaauucuaacaacacuuaaaaguuacgcuuauauuuaauuacuuaauuauaaaacaccucuuuaacuacauuguagauauagauucuuaaaauauaaacaucugaguguaccagaauaauuacagauauauuucagagaacaggguugaugaaacuuaggucuauaggguauuauaauuuucucugcugucaaaacuggauaguuagcccauauaagguagagaauucacuguuauauucaggccuaaaugagaauauuggucuuuaaaauaugagaauauuuuuucucuauauuugcuccuaaaauaauuaaccaaauccuaaacauguaaccuguauuuugcuaaagguuuucaucacugggggcucaagauauaaaccugcuauuucauuacuuuccuguuaauuaguuuagucuuuccaagcucaaguaggcuacuuucauugaaauauacucacucauaauauuaacgucuuuaauaaaggugggaaaauauuaaaauaauguugaaaucaaagccagugauaaauacugcuuuguuuuggcauucaccagugauguaaggcuuccauccacagcauuccuaaucacgacugugacagaagcuuuuggauucauagggaaaaaugcaauauuuguuauagugucauucugacaguaagaaaaagaggguuagcucauguuauuagagaacauaguaacacuuaaauugcuaucauacuuuauaauugaaggaauuaucucaccuguggucacauaagaaguagaugacuuguucaguauuuaaacucaggacuaccacaaauugucccccucuuugauuuuccccaacucuacaaccaccuauaauuuacccuguuuuuaucuucagaagauaauuauauuuucacagaaagacuaugggucaaauugggcuggucuacacucaugaaaugaauggauaauucuaaucuuugaagugugcuacaacagcaaaauaucauccagucacuuuugcaaguaugucuacauuccuguuaaauauguaaauguaaaagguaagaggauagacuuucuuugaaauaaaagcuuuacuucuaguucaaaagaugaccuuagaucaaacgcuggauccuugauuaaacauuaauauauaccuuugcucccgaaaaauaagaaauuguuagacugugaauuuaugaagaguuacuucaaaaagauuuaaauaagcuauuuuacuugaaaggauacauccacacaacacuaacaaugauauuuccauaugaauaauuaaauauauggauuuauuuucuucuaaauauauaucaauuuagaauacaaauauacuucuaaaauuuaaauuuccuuuuuaauauuccuuuuuaaucuauagaauuauagauuaaaucuauagaaucuacagcuaacagaacaucuaaauguucuguuguacugauaaauuauuaagucugcugauugugguguuacuauaguuugucaaggacaaaguacuucaguuaaguauuugacuuuuuagauuuauuuccaagaaauaguaaauaguuuauucggauuucccuaaaaggcaacacuaccauauuguuuaauauuuugucuccuuguuuuuaaaaaauauuccaucuucauauguguuaugugccuucuguccucagacuugacaacaaaaaaauaaagaaaggggaugaacaguuauuguguuucucucauagggguaggagugacuaacaggguagaguaggaaaagaaaucuucagaugugaaugaaacacauuuuauuuuuaauguguaagguacccuguguguguauguauguauguauguauguauguauguauguauguguccuaguacuuugagcauuaagauuuuucacaauaucucuuuuaaggaaaaaugauuucuguauuguuaaaagccaacugcuuuuuuuucuuggacaaaagcuaagaaagaugaaagcuuuuauaguuuucuguguguauguguguguguaaauguugaauauuuuuccucuacuuucuuguaccuuuuugggcucccauacagauuuaaauccaaguuuugugaaaguuucucaaaaaaaaaacaaaaaaaacaaaaaaacacaccaaaguugugcaguuaguugcauacuucuagggccaggcaugacaaugaauauuuauuuagacugaacagaaagggagaauaaaaauuauuuuuguuuguuuuuuggacagaggaucucacucugucacccaggcuggagugcagugguacauucacaguucacugcagccuugaauuuuugagcucaagcaagccucccaaguagcugaguagcuggacuacaggugcacgccaccacaccuaccuaauuuuauuuuauuuucuguuuuguauaaauagggccuugcuauguugccaggacuggucuugaacuccugggcucaagcaaucuuccugccucggccucccaaaauguugagauuacaggcgugagccacacuguaagucuagaaguacaaauuuaaaaaauggcaaaauacccuagacaucaugaaauguagaaaauaaacauauuacauuuacaugacuuagcuugauaaauaccuuuuccauuccuuuuuugaccacauacucuaaacucauuucuucguaugacaacguuauugguuagaggccaucuauugucaaauuuggaaaaacuucuuuuaaaauuauucuacacacgggcaauuauaaacauaauugaauacugaagacuugugcuguaaaagggacucugauuaauuacacuuucacaugauuaucaucaaaaaaggggaacauauccgguacauuuaugauuauauauguuguguuguuguguugcuuaguaaauccccgacaaggagaaauucuguuuagccuagguauugaugauaaccaaauccuuuucuuuuaauuuuuacagcucaguauauuucaaacuuugcuuuuuccucaacuucuugcauacauguagggccagguaucauuggacaauuguauauuacaacacaaacugugauccugcacuucccugucacaaugaguuuucacaguagguaggaguauuccuguaaaccauucauacaccugacuagucagaauaauuuaaacucuaacugaacuacaugaacauaucccacucaacagaaacugaauucauucccaauucaaaguuguuuuagugggauuccaaaaaugcuaguggccacucaaccacaacucuauuugagggaaaauguguuggaaguuaaguagaaagagauaacaucuuaucuuuuauacuuuuauaaaauccuguguuccuacacacacauuggcauaucuuggaaagauauuugcuaguagggccugcguuaaugagcugcucuaaacauaaguugaauuaguuuuuugguaaauuugaccaugcucucauuaaucucccauuacauuucugacaucuauuuuauuucucuacugaaagauaaguuuaaaaaugaagaaaaaaaacugagaauuaucaaaaaggaaaaucugucauagcuaugguuuuuaauaacaggaaaaacccucuuaaaugucucauuuucuaguccucucauaaauucauuucuaucuaguuuuccaucuccucuguucucuccaugaucauuccucuaaaauuucuuuaaauaugaucaccagugaugaccuauucaaaauguaguuaguauuucaacacuuauucuguguacacaugggucauuuuagugacucuccauuuuuuuguaacaucaucuuagcuuucuucccaucucucugauccuuuuugguaccuuccaauaacuuuauuuccucugccuucccacuaaauguuguugucuccauguuuuguuuguugguuucauucucaucuucuacucuuuuuauacauuucuagucauacuucauuuguaauuaaucuagacuguguuuuuacauuauguucuacugaaaaacuauaccugaauaucucguggucaucuaaaaugaaucugcuuaaaauuaaacuauuuucuccuccuaauuaugcauauuuucaaacauuaaaagagagacuacuacaagaaacacucauugauccaacaucuaucuaugccgaaaacuaagcuccagugauuagcaaauauuuccaaucucaguuuaucuauccccccacaaaguuuuuuuauuuuauuuuuguuugauuuuaaauaaaauccaaggcauugugauuuuucacuuguaaauacaucaguauaugccuguaaauaauaaggacuuuuuagguaacauucacaauaaaauuaacaauaaaucuuaaaaauaucuaaggccaaauuuauauucaaauuugggaauuguuuuaaagaccucuuucuccccccccgccaagauggagucucacucugucacucagcuuggagugcaguggcaugaucucagcucacugaaaccuccaccucccagguucaagugauucuucugccucagccuccugaguaguugggauuauaggcacacgccaccacgcccagcuaauuuuuuuuuuuuuuuuuuuuuuaguagaggggguuucacuauguuggucagucugaucucaagcuccugacuucgugaucugcccgccuuggccucccaauguacugggauuacaggaauaagccaccaugcccagccauuuaaggaccucuuuuuaaaguuaacuuggacaaauaaggacccagacaaauucuacaaaauuuauuugauucucgugucucggaagucucucuuuuuuuuuuuuuuuuucuguacuagucacucacuuuuuugugguagugguugacuuuuuccacuauucucacuauuuuccauaaguugguaauuagauccaaagucuugaaaacguuagggugauuuuuaauagaagaauaguucguaugaggcacuguccuuuuccuauugcaucacacaacaaggcauuacuuuuaguaaugcugagacuuauuuacacauucagauaauaucagccugauaccugccuuuugaaauucucugucaauauccaugugauuaccguauucaucaaugacuaucaccuagaucuauuauuuuaugauaguuugaaaauggugauuuucuaauucuaucauccuucugcauuugcuggauaucaucucuaaacaaggaacuuucccugcauaaaaucaguaccuagaguaaaguuaggauaaaugcuugaucuucuuauuuauucaaaaaaaaaaaacccuucuuauccuucucuuucuuacuuacucuuucuucacacucuauacauauacuccauacaguugccaacucaaaguauaucauguugucuacaauucuuccucuucucacccauauguaauuguagccgggauuugucuaucucuaaagcuuuuuacuauucuccgcuucucuacugccagcaauuuaagaaaaauauacucagcauuucaugucaauggccaucauaucagauucuauaacucuagcuuuuacuugcaauucaucccugacacaacuauugaagagaugguccuaagugcagaaucugauaacauaauuugacaguuuaaaacgcuuaaauccuuuaacaccucauuaucuucucaggguaaaauccaagccaggccuuucacaacccaaucccugcuuagugggccaacuucauguucuaccauuccccaguaagcuuacugggcugcaguuccauuuagcuguuugguaaucuugaacuugcaguauguuuucacaugucuuuguaccugauaauuccuaggccuggaaucccuaucuccucuguuucugcucuugaaaucaguauucauccuuucagacugaauucaaauucagcuauucaaugaggucuucucucauugucccagaagaaaaaagcauuuugaucuguguauuuguucccuuaaacagccuuuaggaagacucugugauuguauaauaccuauuacguggcugaacgauuuguauacacguuugucauucucucucucucucucucacuacauuguaagcgcuucaaaaacaagggcaaucugguuauugccaaaacuucaaugccuagggcaguccuuucuauauaugauaaguacaugauaaugaugaauuaugauuaguccuguaaagcacauuauguuuguuuuccuuaccugcacucuaaauagcccucccauccccgaccgaaguucagcguugguuucuggcauucauucuuuugacucacgucccaagagaauucaucuacuguggaguuuuuaucuuuuugcaguuuccuaucuuccauugccuaaauugaagauucacuuagauguucuaaggagauuacucugcuguauaugaaaagacuuuuuaccagucccacacacauuuugcuuauuccuacuucuuugcucauauuuuucccguguaugaaguauccuuccuuucugcaagacuuuuuuuuuuuuuuuuuuuuuacaggauguucuuggauuuagaacaaagaaacgacuuuaguggagcauguucagaggcugccaaaaguauguucgaccccuuccuucauuuacagucugagagcugaguuagauaauuuuaccacacacuucuucagcuggcuuuccccgcauguauguaugcucugccugcuuaaagagcucauuacuuucucaagauuacagucaaacauuucuuccccaguauacccugagaaugcugcuaaacauagcauauguucuaaaugcuuauaugaacaaaaaauaaaucccaucuaaaugaacggauauuaauuuuauguccuaauaauuuugaaaguuauugacaaugucacauucuauuuuguaacauuauuguucuuauuuggaaaaggaaaguuuuaaauacugaaacaaagaauacaaggaucaaucuucaaacaaugauucuuaagaugauacaacuaaauuacauaauuacuauauauguauaguaauuaucuuugaauacauauauauauauacucaaaauauauauauauauauauucauaacccaaguaagaaugguuaauuugugaggccaagccugcuuguacauacacuuauuuuguuaucuuuuccaguuaacugaucaguuucuuuauuguuuaaaagaaaucaugaaccaccuaagcuguguuuuaagaagaguaauuuugaugaugcuaucucaaguuuuacuucucauacuaacuuaccagaaaaggccaauucaaccaauuucuccauauuuugcaagcuguaaaauucagugauucaaauuaugugucaaaaauaucauuguuuuuaucuuuagcauuauuacugucacuauuuacaguaaaauaaaagcaaaguaauaagaauggagcacuguaaccuggacccuguaaugaauuauugugaucaauaacuauguuguuaggaagcaauaaugcuauguucacauaaaauggaaaaauguuuucugaauaauauuauuuaguaaaguuugagguugcagguuggcuuuauaaacaaauguuacacucucauuuucaaucccucaugaaauguuaaaggaauugcacuuuaacuuauacauuuuuggagguuugucuuaugcuacuaacacacuaagugagaaaaauucacacuugaauuuuuucugucuuauuaccuuugccauagugauucugauauagaauagauagucauaaauguucucuguuguaaauguauuuggaaauauucauuuaaugcuucagcuauuuuaguaucucagaugacuauaucucccauuauaauuuguaauacuguaucucccuuuuccugcuacuucuucccacauagagcuaaaagauauuuuugaguauguccaaacccuuuugaguuacauauauauaacacagauuaaauggcagaccauuaucauuuuaaaacauacacugggugcagauauguauaaaguaguagccuugauaauuucaaauucacuuuccaaaacugaagaaaucaauuuuaaaaucauuuucuugcucaguuuacauuucuaguguaguaauguaaucagaaucauuuauucaaauuguaagagguuauaaaaucuuacuucucucuuuuguuguacuaaaugcauggagauuccauuaggagugauagacuguaacuagacaaagagguacacaacaguuaugccacuauuucaugccauucuucaaagcaggaccuuacuaacauugugaguuuuuuuuuucucagucaaacguauccucaucccuugauguuaacaaacacucaccuagcaaaaccaaaacaaugccaauuuaaaaauagagaucucuaaagauaaaaacauuuuauaucuauauagaugcuccuugacuuauaauggggcuacaugaugauaaauucaucaaacacaauauuuucaacuuauaaugaacuuaugcagggauaaccccauaguaagucaaggagaguacugaauauauuucacauuuccuccaucauaacauugaaaaaucauaagucaaaccuaugacuuaugguucaggaagacugugcguguguuugugugugugugugugugugcauguggccaauuagauagguguuuauuuuaaugcagaauugaccuaacuuaaggcuuacauuuuaauauuuaaaaaugcaaccauuggcugggugcaguggcucaugccuguaaucccagcacuuugggaagcugagguaaguggaucacauaugggcaggaguucaagacuagccuggccaacauggugaaacccuggcucuacuaaaaauacaaaaaauuagccuggcauguugugggcaccuauaaucccagcuacuugggagacugaggcaggugaaucccuugaaccugggagguggagguugcagugagccgagaucgcuccauugcacuccugccugggcaacaauagcaaaacuccaucucaaaaacaaaacaaacaaaaaaugcaacuaucaaaauuuuugguuuuuaaugccauccugaaaaauaaaggauaauaucaggggcuguguugauaguauucuaggacaaauuuacuaucauuauagcacugggaaaaaaucuaaugaauuuucuucuauuucucucuuuuuaauuccuugacuccuuccuucuuuccuuccauccuuccaucuuuacuuccuugccucccuuuuucccuucuuccuuuuuagagaugacccaucuauuugagacuuguuccugagcuugcuguaguaucuauaaaugauaccaucuacucuuaacuugaucagcuuccuacaaaccauagaaccucuguuuucauccgugguaguauaaauauauagagagcguucuuugugaaaacuuaucacuucuauccuuuguugucauuuaaaaguucaauaacuuagagcccuuuaacuucucuugcguucucaccagcauagaauacugcucuacaauuccucucucuggcuccaaaugcuacucucccuugcaaaacuuuccacugugccauuuaagugcuccucuaugguuaaacaaaugucucugcaucuucaccugcuuauggugccgugucaucauuuuugugccuuaaauaaaaccuggcucaacccaaaauuuccucugcacucaucucuaggaaaugguucuuuauucucauuccucuuacagacuccagugucaggagguagagggaggcuucuucuguuuuucuaaagcugcuuccagauaguuucuuuucuagauucaaguauaaaucucugcuucuuuuuucucaugccaucuguaccuccacugugaguaccuccauauuugacuacuuuccugacaguucucccucagugauuuaggacagaugagucucauggucuugcuacugcaaggucagccaucacccuaggugauuuuaggguauguaagguccauuugacaccauaacuuaacaaaugcuugacugccuccacuucaaugaucaucauuuccacuguucuuuaaccacuuauucuaacgcuuauguccucuuuuuguuuuuguuuuuuuuucaccgaguaccaaucugacucuaagauuuuuauauucaaauguccuauucucugaauauucucuuuugguucuuuuacuuucuuaaauauauaguagcuauuuuuccaucucauugguuccaccaguucuuugauuccuccauuucccaccucacagccacucucugcaacugaucagccuuuucuuuugcaaaugagucuggacacuuugguuuucuuuuauacugagagaguauaaaaaauacucucucauuaucacauuauucaucuguauuccuauucuuccaugaaaaccacaaguuugaacccugaauccaugcuaaaaccaaggguuuauauuccuuuauugugcucuguaaaugucccuguacaaauucguauaauuuccauucacuguaucuaaauucagcuugacccucaacaucagccauugucauaggcaagacauugguuucccaaagauaucaguuuccagaagguaucuaccuccuaauuccuggaaaaugugaauauauuagguuuucacucccacucucugagccccuguugucaccugacucuguacacagcccacugugaauauguuagguuacauggcacaggaaacuaagaaaguagacggaauuaaguuuguuaacaaguugacuuuaagauagggaaaguacccuggauuuuucggggagguccaauguaauuaccaggauccuuucaauguggaagagagagacaaaagagucauggucagugcauuguggugugaggaaggcucaacugaccauuggugacagugaguauaugagaagucauaaccaaggaaaaaagacagccucuagaugguaaacaaaaaaaaaaaaaaaaaaaaaaagacaaggaaauccuagagcagaaagauauauaggccugcugacaccuuaauuucagcuacugauacccauguuagacuucugaccuauagaccuguaaaguaauaaagcaguguuuguuaaagucauuacauuuauguuaaauuuugcaguagcaaaaggaaauuaauauacccauuaauccuuuugacucccuaagucuaggauuuacuucuauuuucuucugcaaguauuucaaguuuguacucaacccuuguuuaccaauaaagacaacucuuagggcuccaucaaaaaguucguggucaaaaaacauaguuuuccuugacuuucuuccucuuaaccccuauacauuuaucugaaggauuguucuuccucaucaacaucuaugcuguuaacaguaaaguaaaauuccccuuuaagcacaucuuaccuucuaugggacuuugcuccaauuguccuguuuccuauauuccuuccucccaguaaugagggagacaugauacucuuagaggauaauguaauucucucuuugcccacaaccaaagcuacaguuccaccuuaucccuucccuucuuguuagaaccucuuggaaguguaggcccuguuuucacucccacucucugagccccuguugucaccugacucuguacacagcccacuucuguguccuucuacuuccaccugcgucccucugcugaaccugcuaucacaacuaucaccaagaucucauuucuagcauacuuuuacagucuuuaucuuacagagugacugugugcaaagaacauaguggaucauauuauuuuugaaauuuuuauuccuuuaccagugacucaugacuuuccuugcuauaaccagucuauaauuucuuucacaugucucucuuccuuuaccuaaauuuuaagugguugcauucauuuggauaucuugggaauauuccauguuuuacucucaaacaugcucacaucugaucucaugguuucaacuuuaaaauuaaucuaauuuuugccuuaacuuauaugcucugcuuggaccuguccccagaauuuuacucuaauauuuacaacugucuacugguugccuccaucugaauauuccauaugagcugaaauugaaacaagucaaaaauaucuuccaccuaaauaugcuuuuuaucugcacucuugauuucagauaaugacauuuacauuuaacaagucaaucaauuuagaaaacuauuuuacuuuucccucucucuuggacucacaaucauggccaugaugauuuuuacuuguaaaguauuucucaagucauccuauucuuacccaucuuugccaccacucaguguuuauuuguugaaauuaucuugcuauacaaaacuauuaacuguucucccuuagcucagucuuuuauucuuucagaacuaucuccuuuauuuaucaccagagagcacuaaacuacagcauacaauuggcuauaauuccuccaaacuuaaaaccuugcagaggcuuuccacugcuuaaggggccaugcaaauuucugaauaucuaauuacucguuuuuugucucuauuugauuuuuuaguaaacaucaucaacuuucuauguccaauaaugaacuccucacauuucucagcaaaccuguccugucauugccuugccaaucucauuugagaagcauuccuuccucucaauuuucccaaccccaaaacuugaaguuaucuuugacuacugcucuugcucugauccuacauccaauccaugagaaaauccuucaggcucuaccuaacagucauauaaauaacuugacuacucaccacuuccacuacuagcagcguugcuggagcaacuaucagcuagagaugauuaagucaauagcuucauuaggaggguuccuacuuccaccuuugcacuuugugaaauuuagucacaucucagcagcuggaaugacaguuuuaaagccuaagucagaucucagauccugcuuccucugcugaaaaacccuccagugauuuucuguuugacucagaguaaauguguaaguugucacaauggcuuauaacgcccugcaucgucuugcucucuguucaucuuuuguacugcuuuccuguuauuuuuuuucccuguuuacuauaauggagugaccccugccuccuuauuguuccuucagccugacauugcaaggcacaauuuaaccuuagaauauguguucuaucucuuuccugugucuggaaugcucuucucccaaauaucugccuggcuaucucccucaucuucuucaggaauucgcucauauaucaccuucucuauuaucucuacuccuaugcuccuccuuaauacugccaccagccccuacucuaucugccccacaguggauuaucuuuaucuuauucaauuucccccaaaagcacuaguuaguuucuaauguuguacaauauaggcuccacgagggauggaaucuugauuuguuguuuacuauuucccaagcacuuagaagagugcuggguacauaauaauaaaugacuacauguauuauuaaaugaauuaacucaaaaauauauuuuacaaaaugcugcaccaucuauuauaugccucugcucucucaauucuuaucuuuccaggagacuaagccauuuguacugccggccauauacacucacacaacuauuccaugcugauucucacaugucuuuucuuauaaugcccccucugcaagaaauuuuauuaaccaacaugauucgucacucuuaucaugcugguuuaucauuuaagauaagcucaggcaccauuuccuccaggaaaaauuugccuaaauuuggauuucuugccaauuuauauaauauuugucaaauagaauguauucaauaaaugauucucugugaauaaaggaauucuaugcaacagagauaaggacaauaauagcucagugaauuaaauguuuaguaaauguuuaguaaugcucaguaaauagugaauccugagcauuuaauaacucauuuauuuuagcaaaucuuuuaaauaaauugucgauacuauuaaaauguagcaaaucugaaauaugacuuucuuuuauauuuuuaugauuuuuaguuuuuauacuuguuuguuauauaauaaaacuugcauaacauagauaaaucaugugucaagaauuauuuacuucuaagacaacugugaaauuucaauaguaauaagaaguguaguauuaaggaauuuuuuuaaauguuuauauuugcaccugaauucuuugcaaaugauaugcugauuacuacugguuagggagaucacuuuugugauaacuggaauuucuuauuuuaaauauuaaacucaauaaauuuauuuauugagguaguuuuuguucuaaaaauauuauauaauguucugaaaacagugaaauuguuauuacuuaugaacgguaauuguuauaauggcucauaacucaauaacuguuauguuuccuuuuuuucucagcucagggcaaaauggaaguggcaucauucacuauuuccucuagugauccacaauccaaauuucuaaguuucuguuuccugucccuaugaccuuauccucugcuggccuagagaucuuaguuacaaagggaggaaugcuucuauguugauugagacacaaugaugccauugaacuggaaguuaagacugccaccuggccacuuugagcuccucacgcaucugaauuagccaucagggaaaagagucacuguuccagcuuagcaugauugauccugacuaccaagggggaauuggaauagcacuccccaauggagguaagaaagagugcaucuguaggagaucuuuagggcgccuauuagcauaccauucccugugauuaagaucaauggaaaacuagagcaaccucauccaggcagggcuuaggucacuccaccugguaaagaaacacaaucagcagagaugcuugcugaaggcaaagagaauacaaaauuggcaguggaagaagguaguuauaaacaccagcuaugcccaugugaacaguuacaaaaaugaggacugucauugucauacauauuccuuguuuuuuuuuaucaauauguucauguguauagaaaauaucuuuguuuucuuccuucucuuauuuccucaucauguaacauaagguauguugacuucauauucuaauauuuaaguauuauuaauauuacauuauccugaagaagaguaaacauuaaucaagaacucuacuuccucuucuggggaaggguuuaguacauuuucaacuguacacaggauagcuguaucauauuaggaaaaauuaugaacuucuuauuuccuucauuuggagauuaaguaugacuuaaggaguugcauaugggugccaaguugacaaaggguggacuuguaaagguuacuuuuuugugucaaacugaaagggucauggagugccuagauacuugguuaaacacuauucugggaaugucugugaggguguuucuagaugagauuaacauuugaaucgguagacugagaaaagcaaauuccgccccccaauauggguggaccuuauccaaaggacugaguaagagagaauucacuuuuucugccuagacucuauuugagccucgacaucaguuuucuccuguauucaaacucagguuaaaacuguaacuuaaaccaucagcucuccuuauucucaggccuuuggacucagacugaaaccacuacaccauugguucuccugggucucagcuugcuaaauggagaucuugggacuuauucuuuuuuauaaauauguaaaccaauuuccuauaauaaagcaaucucucucucgcucuuauauauacauacauauauauauauaaucucauauauaagauauauauaugcauauccuauuaguuaugguucucugaagacccagagggauucaguacaagagcucuaauucaugguauuaggacuauggccuuuaugugccuguguaguugcacauaaaauuacguuuucuaggugaauuacuuuuuaguacuuagauucugagaacuuugaaauaaagaaaacuuuacauuucuucuagguaggguaauuuuuagauauuauagcagguaaauaucuaauuacuaauggcauaucucauuuguucuucacaauaacuuauggguagaauuccucccuuagcaaaauuaugaauuaaaugacuuuuuucuuuagugacuuuuaggcaaaugcuucucagguuugggcuugauaauuuuuuaaaaauucaugccauccuaugcugccauugaguauuauuugaauaaauaauuaaaauuauaacuaaaccaagcuaaauaaagguuaaauuugauacauguauuucaauaugcauauuuauuucccuuauuccucaccccagcuaugacauacuaucauaguuugucuucaauuugggguucuggaauucuguuuuucuuacauuggucaaaacucugugucagaaaauuauccaguaucaaccauuucauauggauuaaaguaaaugugauguuuuaucccaauaggcuauuuauuucaaaacugaucacuugugauaaacuauguggcaagauaguuuauaauacuuugcuucaaagaaugguacagcuugucuauuuucagaaaaaggaagauaauugaagagauuccauguaauauucuaguaaaugacugcauuuaaaaggaauaaacuauuucuuaaaggucaauaccuuuuauguauuuauuuauuuuacuuuauuuuuaacugugguaaauuacacuuuaacuacuuuuaaauguacaguucaauaguuucaaguguauucccauuguugugaaaaaaaaauuuccagaacuuuucuaucuugcaaaacugaaacucuauacccauuaaauaauccuccauuuccuccucccacaauccucuggcauccaccauuugacugucucucucuacauauuuuacuacuuuggauaccucauauaaguggaaugaugcaguauuugucuuucucauuuuuaaacuucuuuuaacuuucaccaguaaccagcuucagugcucaaccaaaugcacuaacuuaaggcuuuuccuuguaagguuuaaaucugugaaaagcaaauuggaucuuggugcagguauauucugagcuuuuguaucuuggcagggccaggauuuaauuuauaguagcaauaagccuguugagcuaaccuuuaccuuaacuccuaauuuggagaauuaucaggcaaagaauccacugaagagccuaaaucugcucugaaaaaaauaacagagaaagaaaaaaaaagggggaugaagaguaggagaagaaaagggagagagaaagagagagaagaugggaggcacagacacacucauuauaagauuguagaaaugggguauggguggggaaaaguaguuauuguucagcuacuugauauaaguuuagaaguucauuucuucauuugaugagaaaacacuuuaccucuagaaguuacuuauaaaaucuuguuauugcauuacaauacaguggguuuuuuugguuuuuuguuuguuuguuuguuuuugccuaucugaaaauauuguucaucuuugauagaccucaaaagcugauaaagugauuuauagauauggacacaaaaugugggucuccacauaguggcacucaauacuggaaaaccaagugagauguauuaauauuuggaacauuuccuuaaaaguacuuuucauauacuuccagaaauuuuuaaaaauugacuauuuuaacucuggaaaauguuaugguaaaaacuacuaccucauguagcugacugaaggcacagucuucugaauuaaacccaaguacuacucauuuuuugguucaacuauuuaugacugaccuuguucauauacguuaaaaggaaacagaagauaugaggccaauauaguugaaagauauuuaauauuuuuuaacaacauacacauucacacacacaaauuaacagaauaauaucuaaaauaugagaagcuuuccaagacuuuugcuuacaaaguaucauuauauccucaaagguaugaacacuuucauuuuuguuuaccagcucucaauaaauaugaugaaagauaacauuaugaaauauucuaucaugagugaaaaaugaaggaguguuugaauaaauaaagcaaaugaacaaaugacuaaaaaaaugggaggaacuaauuucuuuccuguuguuucacuuuaaauuuaccuuugggacuauuugcuacaaagaguaggagccgucuugcugaacgaucuuauuaugaguaggguuugaauucugacuuuaugauugaaaagcuggguaagccuacgagggcauccaguacguggcaaauuggucauuauuauacaagcaaagagcaauacuauaagaagugaaaaaagucuucaaaauauguaacuaucccagauauguuuauaaguuucucuuuuuaucucucuguaugauuucuuaccaccuuguuaauggugcuuauuagucacauccuuaaaaugaaaacagagcuaugauuauauuuuuauaaauaauaaaauccauagaaagaaaguaauuaggcaaagaaucuacuaccuaccaucacaaccuaacgaagaagagcagacuguauuccuggaaaggguauaaagaagaugagagugucgagagccagugggagcuaagaagggacauugggaauuuacacugcaggaagccugcacaguaaccgaaacauggcaacacucaucucguugccuguuugccuggcaccuccucuuagggaagguuaugguuuucugccgccaugauugaugcacagaaucacagacgugucacagcauuaaggagcuacaugacuacaaagacaugcugcuuuaaagugagccuuaucugagcuuaaauauagagcacagcugucaaaccacacagggcuuucuuccaaucugauaucauuaaaaugauuuugugaacugauuguaauuugaaacgauaggguugcuauuacuagagaagaugggucaacucugggucaaagcugaacaucauugauugccuacuauuaaaugugguuuauuuuaaugauguuauaguaaagaaguuguugguuauuuuaaguauuugauugccuacaaaguuacuccuagaauucaaagaauuguuauagaauaaaggauauauacaacaugaaugacauuauaaaccaaaaggucaaaaguuauagcaaaacugcaucuuaccaucaaauaaaguuuaacaaagcaaaauguacuagccagucuuucccuuuagggcuaguugaguugauucucugcagcauacguuaagcauuccuccacauaauuuucaaacaaaauauuugaguuauaaagaacagaaagaucccaacuacaagccuugugugacuuuucuuuuacauguaucugacagaacgauaauuuucuagcaaaaacauaaaguaacaugguuuaaggaaggcaacauugagugguuuggggucugcaggacucuccauaugagccugacuaucaauuuuuuaaaaaaaucuacuuucuauguaaaaauguuaaucauucugacaaaugaagugagaaacuagugucagaauaauuugccuucguagaaagucacaaaauguagguaacaucgacaaacaaaagaacaauauucuuuuuuucucuguuaaucacagaauguauccaauuauuuaaaacaaagcucaaccguuaguagguacucaauaaauaucacauaaauaacaagauuguagcagcuguaccauuugugugaauauacuucuacaauacccaagguagauuuuauccagaacaaauauaaaacuuucgaaaguuaucugauggccucugaacuagucacauaggauaaacccauuauuaauaaaaucacuggacuucuugauugguuggaauacucucuuauuauaauugccaggaaaugagauucuucugagcugaaauccaaccucuuuguaauaaauuaacaagugaaaaaauagaucccagaggaaaaacauauaguuauucaauauaaucuuuuauaauucaauggaaauaauuuauugucuuuuauguugucuauuuuaguugauaguuuaauuagaagauuaguuuuaagaaacaaggugacgggcacuacagugaucacaguuuauuaaagacuuguguuaauuggauuucaauggugaauucuauguaggaacagaaauaaaaaauggugaacaacagaauuuuaauauagcuuagcaauuuuuccucauucucauaguggaaucagaaaugaaauuaaaaacuacaaaugaaguauaauuuauacuaagucaucacgucaauauaaaaauauaacaacauuauauguaucgacuaugucaagaagaaacugcacuucccucagcuugguauuucugcauaguugagggcaauuguggagaaucacuaauccaauccgcugcuggauggagaccugauauagggcaauugcaaaaagguaagaagaagaaauacuuuauacacauacugagccacaaccucuaauaucacugcuuagaaagaagagaaacagacagaccaacuuagagcauggcugcaggcaugggguaacuuugugaucaaaggagucuggcaggcuuugugacuaugaggcagggauucaagcagagcugaguuuuacaaauagcagcagcagcagccauagagcaaaguacaguuuuaacauguguauuauguggaaaugaccaguggccacuucuguccuuuuugucacauagucuauauggauaccaauugcuauagaaguguaauucuucauagaaagaucuaagauuuuauaugaucauucuucauugugaaaacuugugaagucagugaggacacaucagcuagcagugguaguaacaguauaucuauuuaaacuugacugaguauaguaacauuagauuuucacagccuauggaaauagcagacuuucuuuucauuuaguugaaaaugaaauguaaaauaucuuaaaaacuaaaaauguauguaaauuaccuaaaucaguaccugagucauagaagugcuaaaugauuucuuauucacacuaucaauaauaaauucaauaaacuuucauauaucucaaguuuauugggauuauaaaguaacuugugcugucaaagugauuauaaagugauuuauaaaauaagcuguacuaucaaauuacaguuauacauaaggguugaacaugacagauucagaauacaauaaaauauguggaucaauaauauaaugcugucuaugugaaauuaaggcuguuauggguaaaacagaacucaucaguuggcucauauaagcaguuuaguaaagaaacaacaaacccuuuucauguuuuuuauuuauagucuuccccugagaaaugccugcccauuguugguccuuccaugucccacaguuccaaaguuucaauucaaggugaugaaaugaaaauacagcuuagguccuugauaucagcucuuaacuuuuuauuguucaauucgucuucaaaauccugaagaaacugguaaccaaguucuaugcuaugcuuucuaauuagaggucuacacaguacauuaaacucacauaaaauauauuucaaaauaguuuuccuuuauagaucuuuaucaaucauucauucauuuauuuacccuucaacucauucaauaaauauuucugaguacagacuacaguauccagcacuaugcaaggaagagggacgcagcauugagugaaagcaggcaggaucucuacccauauggugcugacaguuuuguaggugaagcagagguuagugaaaucaccauacaaaaaauguaaaguuacaaugauaauaaguacuaggaaagagugcuacauugugcuaugauauuguauaagagggagcuaacuuaggauacagucaaaaaaauacuucuuugugaaauucaccauugaaauagaggcaaagaggaggaauuauuuuugaguaaagguggcccugugugcaaagacuuugaaaccuuugaaacaagaacgugcaauacuccaggaacucaaacuuucuccugucaaugugcauagaguucccagaauuaagcagaacauggugugugauagaaacagaagcuuggccaaaauuuuucauucucuaguaaaccugcuuguacugaucaauuucaaggugccagaauccugugacaaaauguguuccacuguauugaauaauaauguuguaaugucuaacugaugcuauugguaagauaggggcaauagguuaauuaagaaagagucagcuuuuauugacaaagaucacagcaauuaacaaugauacaaauccauauacacgaauacaguacacaccaguuuaggaagguugucauugcuauaaaaaucuugcaaaugugcuguuuacacuauuugcuaaaguauucucuaggagccauucuauauguuaaucuuguacuuauguuuuaugauauauucacaaauguguguucacucaaugucucacucaauucaaaguaaguuaaaacuuuaagacucaaccacaauacacaucuauuaaaaugauacuuuuucaaaaauauuacagccaacuaaaaaagaggcagaguaaaaagaauaacuauauaauuacguucucagggucaaucuuuagugguuauacaaauaaaacuaucccauucuuacuucuaacaggauaugauuugccaguugagauauaagcuaaaauaucuauuaagguagauucugaaaacacacagaacuaagguguaggcaccaagcaaugaaacagaacuuugaauagacaauaaauaugcuuuauuauuaaucauaguguauaccucuaccuaccuaggaccccaaaauauuaauuuaguuaaagcauuuauaaaggcucauugucauuuaaguuuguaauuuuccuuccuaaaugauaucuggagcuauuugcuggacauagugacaaauaauucaucucuuuuccagauucuuuacuggcugacagacauagagaaagcuuacuauguuuuagaauuucuuuugucuuaaaauaaucguauauauccaaaagaauuaaaaggagagacuugaaugaacucacaugaaugaauauuuauacaaccaugcuuagagcagcauuauucauaacggccaaaaggugaaagccacacagaugucuauagacagauaaaugguaaguaaaauauguuauaacacauacaaugaaauauuauucagccuuagaagcaagaguauucugaaacaugcuacagcauaaaugaaccuugaagauacuaugcuaagugaaauaagccaauugcaaaggacaaauacuacaugauuccacuuguaugagguauccacagugaguaaaguaccuacaguaccuuacauaagaaaaaaaaaaauagaauggucauugucuuggauaaauucauggacaugggauguagaauggugaaugucaggaguugaggggaugggagacugagguauuauauauaauggguacagagcuucaguucauuaaaauaaaaagucucuagagagggaugguagugauugcugcacaaaaauacaauuaaugucacucuaccacacauaguuaaaaucauuaaacuagaaaauuuuacauuauguguauuuuauuucaauuaaaaccaaacaucuuuuccccacaaccuccuucagcuccacuuaauuuuuauagcaaaacuuucauugauuugcuuguuccuacuaucuccaauuuccuuccucucuugaacugauucaacuagacuuuuaauccuaauauuuuaacaauauuuuaauucuuaagguaaucaagaucucuacagugcugaaugcaacgauuauuuaucagucuucaucauacuugaaaugucacuuggugacuauauauuccagguuuccugaaagaguaccaguuuguauuuauaguuuagauguaacuaauagugaccccuuucauuuucagaaguguaccagauuggaugauaauaugauuuggauguuugucuccucuaaaucucauguuaaaaugugauucccaguguuggcgguggaccuggugggagguauuuggaucaugggggcagauucuucaugaacggauuagugccauccccuuggugauaaguguguucucacucugguaguuuaugugugaucuaguuguuaaagugggcuuagaaccuccuccacuucucucuugcucccacucuugccaugugauguguuggcucccucuucaccuucugccaugauuguaagcucccuaaggccugccuagaagcuaaggauaugucagcauuaugcuuccuguacagccuacagaacaaugagccaaauuaaaccauuuuucuuuguaaauaacccagccucagguauguguuuauagcaauacaggaaggacuaaaacagacaauaaaucuuaugguaagccaaacucucaguauucuacauauuuacucacuuuauccauauuuaaguauguuauuuacuugacuucuaagacaucacgcuccugguuuuuguuuuagaaagcacacucuuuacuggauuccuucuuauugccacuguuuuuuuuuuuuuaauugacacauuguaauuguacauauuuaugggauauggcuugauguuuuaauacguauauaugcuuucuaaugaucaauucaggguaauccggguauccauuaccucaugaauuuaucauuuauuuguaguuuggauauccaaacucuuuccuacguauuucguaacauacuaugacuuauuguuaaccauagucacccuacugugcaauagaacacuagaguguauucuucguaucuaauuguaacuuuguacucacccucucuccaucuuccccucuccuuuccucacaacccacuauuucuuaacuuugaacuucccuagaguuugcuucuaucaaacccuugaugacuauacccagucuuucgacuugaaaaauagcuaaaauuugauuacuccuaaauucauaccucuagccuggacacuucuuagccugcaauguguauuucaggguuauguggaaaacuccucugugcugucuauaaucagaugucuaauggauaucucaaauucaauagguucaaauucaaauacgagcuccucaucuuccucauugauuucuccaucucaguaaaugacaaauccauuguacugguucagauccaaaaccuuauaugcuuuuuuucucucuugccccaaaucaaccuaucagaaaguucuauagauucugacuucaagauauauccacaguuaaaccauaguuacuaucauucacuauuaccaccuuggacugggcauccacccucucagauuauuguagcuguuguuuugcuuauuucuguccccucaacccuuccaacccaauacagucucuuauuaacgcaguauccagaggaauucugugaaaguauaugucagaauaugacauuagccugcugaaaaacucuaguugucuucccauuuuucucagaguaaaagucaaaauccucacaguagccaacauggcuuuucauaauuuggccuucccuuaucccuuggaaugcacauuuuucugcucuauuuuuuaaaguaugaucuggcaacacugggcuuuugguguuccuacaauauaccgagcaugcugcuaucucagagcuucugugcaugcuguuuccuugagccacaaugcucuuuacucaaauacuuaauuaucucaaagucucauuucauaaagguauuaaccaaagaaaugcccuuuucaaccacucuauuaauuugcaaugccacuacucuaccucaauguccuuuuucuacuuaacuuuucugaagcacuuaucacaaucuaauacacucuauauuuuauuuaguuuuauaucauagaaaucaucucacuggauuauaaacccauagguuccaugagaacaagcauuuaugucuguuuuauucauuaauauauccuuuuugccucagugcauuuaguagguacucaauaacaucaguugagugaaugaaggaaagauaauuuuuuaaaaagugagaauagugccaauaguuguuugcugauuaagauccagagaugaucacuuuuuauuaagugucuacuucugcuaagcacuguauuaaagauacaaagaagaauaagccaagagcccugccuucacugaguucauauucuauuggagauacaaacaaguaaacuaaugguuauguuuuuuucugaaguuuuguccauuuuuaauaauaucgucauuuauauuauugcucauguuauaaacacaguaauuauucuugacuccucuuuuauguucaacuccaaauccaaucuaucaguucuuucuuucuuuuuugguuuguuuguuuguuuguuuuuuaacagacagggucucacucugucgcccaggcuauagugcaguggugcaaucauagcucacuauaaccucaaacuccugggcucaagugugccucccgucuaagccuccugaguuauuuuuauguaauacaucuucaaaauggauccuggaucuaacuacugcucaacaccucuacagcaacuaccuugguacaaaccacaguuauuucaacuggggauuuuauuagccuccuaacuguucucuccacuuaaacucuuuccucucucaggcauccuuuaaaaaaaguauugucugccauucccugcucaagaucucccaaaguucucccaucuugcuuagaaugaaauccaaccuccuuacucagacuuacaagauccaacucucucgcaccaucuucuagaacuuuucuuuccucuucuccaaacaccaagucuucuugccauuccuacaacaugguauacuuaugucucccuuccggcuuuugugccugcucuuucucagugucuucuccuagaucuuugcuccuuuauauuguacaggucucaacugaaugccacuuccucaguaagggccuccaugaccucccuuccuaaaauaacacuuagaucugucaguguucaaaauauaccauucguugauuucuucauaguacuuauuucuucccuuauccccuucuagaauauguccuaucaguauuuaccgauagaauauguccuaucaaguauuuacugccauaccuuaagcacuagaacuacauaccacucacaguuguaguaugagugguauguagaagguuuucaaugaauauguguuaauugaaucaauaaauggaaugcaauaagugcuauaaugaaaguacuuuauacaacaacuguuucugaauuccuacuauguaccagacacuuuuucaaaaacuguguuuacaaaaagaauaagauauaaauacuguuccuaggaaaaauagucuauuuugaguuucagaaacauaaggaccuuccaguaaaauaugaugcugcaaaaagugcuacuaaaauaaauaaaauagaauauuucugccuaagacagaaauaauuuaugaaagaaguggauuuuuuguacugugcugugaaggaauuuacaaugcaguaaagccagggaaggguauucuacauaauagaggcuacacagcccaaagcauggaccauaugaaagggcuugcuacaaacauggcacuaaugcugugugaauuuagcacauacuagaauaccuugaagaaugacuugagaugaaguuggaaaccugagacucacauuccaagaguguuauauguuguuugccaggaagcaacugaggcaagaagcacuguuauaaagcuauugcaucagguaaaagaggaaaggaagaaggaaaaacugaaaaaaagauauuaaguacucacugcuaagauagauaaaaauaaggacaauauugagaguuuuuacagaaguagcucuuguacugauuuuuuauuuuuuaaauuuuuauucaauuaaaaaaaacuggacucagaaauuaacuacauagggguuaugaggaauagugaaagggagaggauuccaaagguuuuauauugaggaccaaguaaacagugaugcccuucauacacacaaacacacacacacacacacacacacaauuauacacgagaaagcacauuaguagcaguggaguaggcagugggaaauaauauaauuuuucauuuucaaugucuugaguuugagauuuuuucaggacauccaagugguguaucaucuuagaaggagcugugauaugcucuguaguuucaaagaaauaucccugcaggaaauauaugacacucuucaaaggggacugaagugaaauacugcauguaaagcuaucaaaaacauuaaccucacaauauucugacagaauagaaucaucaaaaugcuggggauagaaggaagccagauuguaauaaauuaacacaugaauugacagugaagaauagagauagugaaaguagacugcuuuuuuucaaagagauuugcagugaaauuagggagggaaagugacauagccugagcaggaggcagggaugcuaaaguauuagaggaaauaauccauuuagcaguagaagcacaggaggcugacagagaaauagagaacaagaugaagaagauaaauaaaagacauauuagaaaaaaugaaagauuuuuuucagaaacugaugacgccaauugcuaccuuuuuguuucuguuauauccugaguagaaauaggaagacacauaccacaucaaccuauugucucaaaggaggugaauguauauuauuugggaauaccugaaugcucuguauucuccaauuccuaauaacugccuucagcaaagcaagaagaaaaggauagaaauguauuaucguauauagguaagggauacagugagaauacaugccagaaaaucauuuucucuuaaucuaauaaaaaaaagacaauuuucaagcugucaugugcucagacauucaacaagauucaguacucuucauagucaugacaaacuuuucccaauauaaucaacuggccaucaauguuucuucugauuauuuugcucaugccaauaaaauguuauuauauauuucuuuucuaaaaacagcuucccucuuucacauuugcuuaaaauuguacuuaauacaaccuguuuuaugcauccaugacacuuugaaugaccauacagauauugugucacauagucacuuaaaguucuguccagaaagcuauuguuguucuccucuccaauuuccuagaaagcagcucaacucauuuaucacagaaucauuuagaaucccaccaccacauucuggcaucaagcugguugccuacaguugauuuuccuuuuuuuacugcaugcuauauuuuguaucccuugaaucuuggccacauguacuucuagaauucaguuacuacuacacuaaauugcccaaauuaucacuauauaaagcuccaaaguguuuccuuaauuuuaaaauaguccaugaauucaauauauacauuuucaugugcuuagucaauaugcaaaugcagaagaacugccauucuuaaucuauaccuacuuucauuuaauguugauugaaguaucuuuauugcucaauauaauaaaugccagcuucuauaauucuugaucucaaauauaaaaagagauuucaggaaauggugguagaauauauaacuuauugacacucuucuuuugugaacaauacuuauuuagaaguguauaucaauauaaagcucugcugaggauuaaagauauacauugcacuaaaagauauauucaacaaaaauuuagaaugccugccaaguaguccuguccucugggucuuccacuuuaucccuacugucuucucugauuaacaucugcaauaacagauuaaagcaaugucuuucuuguaagcuuuccuugucaccucacaacucccucuccuccacuccccuaacauacuguuuuccagacucuaacaaagggcacauguggcauuaaauucacuuaucuauuacaacacuaacccgugggcaucaugaccauugacugugcaaaauuuuaucacuaugcugugcaugcuuaagaauaagaacagguguuuuauauauguuaacuugcaaaaagaaaggaagaaggaagaaagaagaaaaauagggaaaagaucuauauuauaauuuaggagcacuugauaugacucugacuucuucauaggauuuugccuuuuugucagcaguagaaaguugccauuuaauccaggccauuaaaaauaaaaaguuauggacagcauucuuuauaaguacagaaaauaaaugagaaaauucagugggcuuacauuaugauugcuccaagaguccuauucuauuugcagaagagagaauccacauguugugagcagaauggcaaugacacugcguuuuaugaggcuauucaaaaagccacuaugguuuauguaguguaaaagcucucaaguuuuguagauuaacucuacuacuugaugccaucuucgcaccaucuuaaguuacauuuucucuuuuaaaugauucgacgguuuaauuaauaaaauguuucuugcaauauuuggacccauuauuauuaguuugacuuguauucugguacaaaacaaguacaauuuuauuuucuaguauaaauauuuauauuggaaaaaaauucugaauauuauuggcucauguagaugcaccuaaaguuuugauaucccaaaaugaaauguuuucucuuugauaacaaaauaaauuucaguuuaaaagcaagauagaaaagguacgauuuuaaugaaaucuuggaugccagccagugugauuauuuuaggaaccuaucuguuuuuuuauaagaguuuuaucaaacugccugccaaauauucaugaucuaucccuaagcauaucaggaagaguugugcuuuucuaguugaagaggcugaaccuuauuagugauaaaaauuaucucaacaacugcaccaaaacauaugaaagaaaaagauuuccuauuaacuuccuucggcaugagaaaauuauguuguuuauuagguacaggaacuccaaauacaauugguccauucucuucuggagucaaucucaacauauuccugcaaagagucuguagauuugaucauuuuuucuacagcugucuccuuaucaccaccacccugaauccuauuuuccaacuugcuuagguagcacacaguccugacauguaauauucccuaccacacagaggccucuaggaauuuggguuuuucucccauucucaugucuuuucucuuagaaucucaucucaugugauuucucuuagaaucacaccucuaugacuuugcuuacauuauuccauacacaaagaaaacccuuuucuccucucuucuggguauggaaauuuuacucauucaucaaaauuacuuuuccaauuucuauaaaaauccuuucucaacaucagcacccuaaugugauuuuucuuuucuaugaagucauccaucaauuauggucugcuuuacguaguugacaauuaauaauguacuacacauuuuuggucuugaaaugauauauaaauuuuuauugcuauuuucauacuuuuauuucuuauauuuucaaucuaacuguuauuauuuugagauuggggagagagguuuacucuucuugagcuccuccaguucuucauuaacuauauaccucuaccucauuaagcucaauaaauauucaugauuauucuauaauagaucuguuagagaucccugggcacuuuauuaaguagaaaaacuuuccuucagguuuacucuagcuuuauaaaguaggaaaaauaauuccuggcauuaaguuguaacuauaagcguuauaagaaaaguaaaauuauacaguguuauguauguucagugggaaggaaaucaugcuguucugggacucaguaucagacagcauuucagacagcauuggcauuuaaucaaacaacugaaugaugcauuggauugagaagcacagcuauaaggaucauggaaacaauuuagugauacauuaucaaauuaucacaauaaucacauacuucaaauaauauugggacaucuuuuuaggaaaccucauaaaaaacggaaaugacaccaagggauuuggauagaaccauaguguaaacuaaauuggauuggaugauuucauuguaucucucuuugaggugggguaauuuucaaugccaauaugcuguaucuugauaacuuaauucuaaaaugagcuuaguaaacuaauuuuacauaagaaucagaaaacagaaaggagaaacuaaacuuauuuaauauuacaaucucugaaauucaagcagaaauauuguuuuuaaaauuuaggguuugcuaacuauaaugagaauggaagauacuaucuuuuuauugucauguuguuacauacuauauagcauguacauaauuaguacaggcuuucuggauuucuagaaagaaagcguuuacauaaaacugugaucaagguauccacauuucaaggaacucauuuuaaaaccaccuguaauaagaaaccuuaauuuuuuaucuuugcuuuugaaaaucauauggcaugucuguaaucccagcacuuugggaagcuaaggugggcugaucauggggucagcaguuugagaucagccuggcuaacauggugaaaccccgucucuacuaaaaauacaaaaaucagcugggcgugguggcaggcgccuauaaucccagcuauucaguaggcuggggcaagagauuugcuugaacccaggaggcggagguugcagugagcugagauugccgcacugcacucuagccugggugacagagcaagacuucguauaggaaaaaaaaaaaaaaaaaaaaaaaaaaaagaaaucacauggcauuaguucauugcuuuuauuugcaaaauuauacuauuauuucugcuguaauauauuuccaagaacucuggguggauaacaacauaucuuuguaucaaaauuuaauucuacuuuaaaaacacuuacauaaaaacuauacccucgauguuccagaccagacuucuuacucagaacauuucuuucuaauguaucauguaguugcauguauuuauguuauauuuaaucaaacuaccuugaaacaucaaaauaaacucuuaaaaucuuuacucauuuuauauuuuauguggcaacaacauuaccgagaguugaaaucaucugcaguucucaagaaaauuugcauuuagccccuaauaauuguagaauaauugauauuaccuuuaaugaauuacacuuuuuaauacagcuuuuaguuaacauguaauuuuuauguaagcagaugauguuuuucuuucuaacauuaauugaacuuauaaaauagaaaagaaauuuuugaaaacugcaauagaaauauauguuaaaaaaauuaaaauacuugcucacuuugugguaacuaucauaauuugguuuuuagucuuuuauuuuuuuaaaaggaauacuaauuaauucauaauuugacaacaauuuccaaaggaauuuuuuaauaaacagauacauauauuaguuaagcuacucugcuuagaagucauauaaaggagagaaaauauuacauuaccaugauucaagaaggaaaguaaguuuaaaaauuuaauucaugaaaauauucuaugccuauauccagaaacaaaaucaucaaacuguuucauaugucaucugaugauuuugucuuuauugucauauucgucacaaucucaaauauauguaaacaaucauuucuugguuggaauauaauuuuaaaagugcaggaagaagaaacuuuaaacacuacugacaguauagauccauaacaguuccauugugacuaauuaguacacuccgaccuaguaggaacuuguuggcagugcuaagcaaccaggucauacaggguaaggcuggaggcugcuggcaugauuuguucacugaugcuugaagugauaccugcaucagagagguuacuaaagagcuuacaggccuugaucauuagaggaagaaggcagaaugagauggugcuguggcauugugcuuuaccuuguaagcauuucucuuggagaagacuacacagcugaaaccccccauuaguugacaugcucuccauucccuucauuccuccugugccaacccuguuuugugggcacauugaaagcacuauccuugccuuauucacaauaucauuucauggaccagcuugauacagugccuagaacauacuuuaaguguucaacgaauguggaauugaauugcugguaaaaugagcccacuggcauaaccugcccccucacagaugcucuggccagcacucacuuuauuccuugccacacaauaguuggcuacuccuguaucaaucaauuacugcaacugacaguaauuacugucaauuaaaguauacuucugaaaacaaaucauugagaauucccgaaugcauuccuguuguccuucccuccuaaucaaauucaauuaaccaacaccccuccugagagaagaaucuucagggguuggcagagcaucugaaauaagccuaagguuucuauugguauucagaaaaauagcacguaacucugggcccuaaugaaagaaugagaaccagagcuguaaagauaagcaacaaagaacagaacaugaaugaaucuuagaaaauaaagggagcucugguaaccugaauaguacugggagacucugauuaauuaaaugcaauacucacuuaagaaaccaucacccaaaagaccuagugguuuuuauggccccggaagagcuucuagaccauuguuucacccauauuccuaaggcuagaaaugcccuagcuuuguaacugagaaaaucagguaucaggcaggauuacuccuggcuucuggcggacaaagauuucauaccaccugguauucuuuuaaagccagagacagcccaccaauuucagggcuuagcaacauaaagcauuccaacaaucagacugguguauggugaggcaaaauaauggcagcaaaagacaggaauaauaaguaaaaacacaaguauuuguauuuauuuuaaaugaaacagacuugcuagagaacucagaugccagccugaauaaacaacaagggaauucagagaaauuucacuuaaguccaccuaaacagaagauauuuuaaaaauuuaguucucaaaggaaugugaauaaaaauauguuuuuuuuuaaaagaauuuaacuuuuguagauagacugagaacagaagaaucacuaaugacaucuuaaugauugcgcugggagaucaaguggaggaaauaucucaaaacgaagcacaaaaauagaaauuaugaaagaaaaaauuuuuuaaagugugaaaacaaugcugauauuggcaacuacagcuagguaggggucacuaaguuacuggauaaaagauuuaaaaaaaaagaaacacagguaagcaaauccuaguaaaaugccugagacuuacaaagaaaaaaccuugcacacuucaagaccgaugaauuagaccaaaaaaugacagagaacgaauuguugucaacuuuucaaccacaauaauaaguugcaugggaaaaauauuaaugaaagaacaggacugaaauccuauaauccugaauuuaaaauaucaauuauuugucaggaauaagaaagaaauuuggauguauaaaaacauucauaggccaggcgcaauggcgcacgccuguaaucccagcacuuugggaggcugaggugugugaaucaccugagaucaggaguucaagaccaaccuggccaacauggugaaacccugugucuacuaaauauacaaaaguuaacugggcaugguggugcgucccuguaauuccagcuacuugggaggcugaggcaggagaaucgcaugaacccagaaggcagagagguugcagugagccaagaucacgccauugcacuccagcuugggcuauagagcaagacucugucucaaaauaauaaauaaauaaauaaacaaaacauucauagauuguaucaccuaccuacacuauuuauuuaaaaugcucaauaugagcuucuuccauuuggaauuuuauuucugcugaauaauaauucuaaauauagaagagccagucuauaaaguaaaagcuauuaauuaucuugaaggaaaguauuaaauuguuugaauaaaucuuaggaacaaauagagaaaacaaccuaaaagaacuuggauaaaucuauggagaggaaugggcagcagaauaaggaaauaacaacauucuaaagaaaucuugccaaagaucaaauauaaacugcuggagaaucaaaguuuugguagggcaggauauacuuucucucuuucuuucaaauauuacaggagauacauguuugauuauuaauauaaggaaaggaacaaaugauaaauauaaagcucugaaauguaaucaauaacuucaucaaauaaaaauaagaaaaaaggaaaaauguaaagaaaacagguaguauacauaucuacaauguaucuuauuuccucaaacuaugcaucuguauaaaaguaagacaacuauuaaauacuuauauuaagauugucccuagauuugauuuuaagaaaucuaauuuucuuuuuauucaggucacaaaauuggacaauauuauggucacaguucuucuaacuuguuuuuuuuuuuuuuuuuaccuaaauaaguucuugucucauuuccuacaugauuuggcauacucauaaauucaaauuuccaugauucauacuaccuacacuauauaugaaugauuauguaugcaugguaaauaauauauuaauauauauuuuggaggacauucugaaggaauauguguuugugcauuuauagaacugaaugucgaugggauuaugcuucccuguaaauuuauacaauagucucacagauguuuuaaguuugcaccugauagacucacaauucaagcagcuuuuaauuuuugucauguuuuauuuauuuauuccuaguccauucauuaagaaaguuaauuuuuuaaaucaauugaauccaauugagcaaaacuuuaaaaauaaucaaggaauuauuuuuaaaagcaaaugauauuuuaaaauuaaaaaccuuauccuuuucguguauucaacaaauuuaucuuuugcauaaucaguuuuuagcuuuguuauuuaaauauaaaugccuuuaauugacagauauacccuuaauugcccuuuacuggaacauacuuggcacauauaugcucuuacugcacaaaguucuucaucauuucuaauaaauuuuagauuucuucuaaauaaguuccugaaauucacuauauuuugcaauccaauugugaacugacuugggaccaauuuacuaaugcuaacucuugaauuccaaucacauuauuccccuugugcuaccuuauaauaauacuuaaagcaacaacaacuacaacauuuaugcaaaggugggaugacuuccuccuccucucuccauuuuuuaccuauaaccucuuuucuacuucucccuucuugucuuccuuaucuucuucuauauaucucauuuuauuuugagcaaugaaguauuuuucuuuuuuaguuuuguuuuugauuaucacugagcucaugauauucugaaugcuuuuuaaauuuuaguacauagugaauguuuacagcuguauuuauuacuuaugcagcuaagauuuaagaagucacuuuugaaaagcaaugauaauuuuuuauuuccaaaaauaaaaaagacaaacauauggcacgauccuuuuacguaaaauuuuuaaauauguacuaaauuuauauaugaccauaaaggaaaagguucuugcaagcaguggaaaagaagucaauaggaaaauucaaauaugugcuggaagcaaagcuggaaaaaaagauugugcagggaaauaauuagugaugaucugcaagagagaaaaaggugaagaagugcaacauauuuuuaauucucuggcucuugaaacacauuuguaccgugucuccucagaaaauucuuagcuagauuuuaagaugucuuacauguaaagccuuucuaaguaaugcuguaaaagaucauucaaucugaauacaaagauauaauuuagauaaaauuauaggcuaauauacuaaaauuuguauucucuauuuuuuuaauuuuuaaaauaguaaugcuuucagguaguuaaggcugguguugaacaacaucuagcuucuuguuucacagaccuucuuucagauuucuccaaccuggauaaacuaaauaggauacacacagaugguaaaaccuuauguuauccuagucugaaaagauuagcuucauuaaaaugaaaauuagauaccaccugcuaaauauguuuugacaccuacuaaguggcauuccauaaaaaauucacaaauccuuuuuuaaaccuucaaagacgccuuggaaguauuuugaagcauuaaagugaacaacaaagucucaaagauuuuuuuuuaaccagaggaaaguuauccuaucucauuucccacucuccaaacuauugcuuuuauuuguaaaagaagacuaaaaguaaucuuugaacuaaggacuaaagaaagauuuaugacuuucuuauauaaauauaagguaaaaaauaggggauaaaugugauuuuaacuauuuguuucccucugugccaauuuuagggaacuagaaacaaauaacuuagcagcugaaugugaaaaaaagacaauauuugaaaguguauaaauuaaguaauuuuuuuuuaauuucacuggaaaaagauaucuggaggaucuuuuaacaaacaugucucauauuuagguggugugaauauaugucccuucugguuagccacagugucauuucaugccuacuguuuuagcauaaguauuaacaacauucauuuucauuuucacaauaaaacuguuuaaaugucaaauuauauuauuauccuucauuuuagucauauauucuauaagaauucuaaaaaaaaacuccaauaauuuaauuuaacauaaauaaacaugguugggaaagacugaaaaaaggcucuauaaaaucucucuggaaagaauaccauaaauaaacuucaacuucucuuucaauuuaguccuugaauuucuguuacaguuuuagugaugauuuuccaacuuuuacuuguagucagauacaugaaguucuguuggcaaaaggcaaguucugcuaaaucuucacucagaccuucuuuacugcucauuuauacaagaucuaagaaguauggcugucuguuuuguuuuguuuuguuuucagauuccaguaaacugaaaucuucaaagguaggguauaacuagaaggaggguuagaaacugauuucugacauccacaaagaaggaauacaagguaaaggagaguguguacauauauugaaauugugugucagucauucugaaauuaggauaaauaucaguuuuuuaaaauaaauaaaaauuugcaauucauuuuguaaaggaucauuuucaaaauauucaacauuaauuuaaaggacauggugcuuacaugguaagcuuuacuuauuugaaaauaauaaucagugcagaauaauuuuugcuaaaggaauaguaguuuuuuucugucuugaggaaauacaaauucaguucauacauauuuacuuuaaagccucuauaacuuauuuagccauaaagauggcucauaguugcaucaaaaguuugcaugucuggguauaguugccaaugucauggaguugaauacuaucuaaaaucuuuccgaucucacuagagaagcauaggaauauguucugauguuccuuccucuccacaacucaccuaucaggagguucucagaucagaaaaugaccacccuacacaauuacuuugaauuuuaauuuagaacuaacucuaaauauggucauauauuuuguaauguuuuauuuauauuacauuauauuuuuauaauucuaaacaaucaauauccccuuuaaaugguacauuaagcugcugugauuauucauucagccuccaugaugcuuauguacccggaucucauucaaucuugccuacauuucuguuaguucccuuaauuucuguauaacuuccaacauucuacucuuaugccugaacaguauaauugugucaauccugcuaauugucucuauggcaaccuaaaauuaucagcaucucugccugugauccucuuagccaccuaaaauuauuucauucuaccuguuuauacaagagauccucuaccuuauuucuucauuguauaacagggaaucuauguugcuauuguguauguugaguauucccccauagcgacuagcccuagauucuaggaaauaguuucuucucagugaccaauaaccagaugcucagagguaaaauaaaccuacugggaagguuauaugaacacagggagcuugaaauguauuccagauaauuuuaugguuaagaaacugaagaaagaagcaguuucuuugaucuagacacucucucgugaggagaauucugguuuugcuugacuggaaacacauuauaauagauuccacaugaaugcuuucauuucucuacuacuacaaaagugauuuuuaaauacuuuucacuuucuguauauuugaacaaaguuugauaauauuuuuauuaauuuuucucuauucuggaauuuuaauugugcuucaucccaauaauauaaaauguaauagaaauucacugcauaauuuuuaucuaacaauggaggaaaauguaaagugaaauuauuuuuuaagcaauaauuuucuuuguauuuuauuaaaaauggcaaaaaccacaaugacuuuugcaccaaacuaaaaauguacuaaauggcuacuguguacauagccccuuuuuuaguaaaauuagaaauauuacugauacaaugaaaaaaugaaaugcauaaacauacuacaaauguaaagauaaaauacacauuuggcaaaucuuuuacaacagagccauuuuaguacaguguuuaugugugccagcaauuauaucagcagaauuagacuugauucugguacuuguuauccugguaaccuugcccaacucucuuuuacagauuugugaauauaaaugagauaaaacaaagccuagauacaugcagaaguuuuuuguaauuaauauuaucaaaacaauauuauuuuucucaugugacauguaaaauaagaaacacacuaaauguuucugugucuauauaauguaagcuaauucuaauacuaaugaccugguuaucuaaauacauaggaauaaaauucccuccuuuauacauguaaaaguguauuacuaaaaaauuuuccugaaaauuuuuuaguaauuuaguaauuuccuaucuaggaauuuauaaaaaggagaauccauuaaauuuauaaauuucuaauggcucucucuccaaagaauaaacaaaaaaaccaaguuccacagacacaaauauauguucacaucaacauaauagaguuuuauggggaagaaaaaucuugguaauauaggcaaagcaauuaugaaaaauuuucucaauagcagauguaauugguuucagauaauuuuggauaccauaaugaauauagcacaguaacuuuuuggcucugcaacaaaaauguaaaaaauaauaguuaaauagcugaagugcaaggagcuaauacuaauugucuuugucugcauuucuuuuuguuucuucaaaucauauugugucuuauacguaaacuaaaaagacaguguuaagucaauguaugugauguuuucuaacaaaugcuucuguuuugaggaaaguguuuaacugauugcuuuauaugguuauuucuaguggucuccuauuggaaacagcugaaggcuaaaaaaggucaaacuguucaaaaugauagcaauaauuuaaacaaauuagauagcuagaaaagucuagauuucaaaaauaugagcguuuagccauggcaaucacgcuuuauccuaaggccaacgggagucaaugagagacaaauaaaggaagugaaauaauuagauuuaaaauuuuauuuuagaaauugauuagcagcagugugugggauagaaaugugagugaugcacaaggaugcaagacacaccucuaagcugcugcacuugaguuuagagcagcugacacacuccgucauuaauugaagguuagucucagaaagauuucauucauguggagaaugaaguagcuuuagaauuuuaugagugcugggcuaugucucucuuguccacuaugauuucuggcuggcuucagcuacuaagcugauggugaugcauuacccagcauagguaucagguggaagaaaguuaaauaagaauauuuuugaaagacaucugaauucauggaauuuguagagucgggagucugugcuucuugaagacuuaauagaauaguuuuauaaugcccucuuuuaggagagugacuaggauaaaaaccacuuuuuucuuagcgaaauaguaacauuaauccuuaaaacuuuauucaauucaauucuuuuuuuuuuuuuuuuuuuugagauggagucuugcucugucccccggcuggagugcaguggcaugaucucaguucacugcaaacucugccuccaggguucaagcaauucuccgaccucagccuaaugaguagcuggaauuacaagcaugugccaccacaccuggcuaauuuuuguauuuuuaguagagacgggguuucaccauguuggccagguuaaucuugaacuccugaccuccagugauccgcgcgccuaggccuccaaaagugcugggauuagaggcaugagccacugcgccuggccuaaaacuguauuccauuuagcccuggguauuguuuacuuaguuauuaugcaaccuuuuaaacguuuuugauaauaaaauuuuuuugguggauuucagauaugacuccuuaauaccuauugugccaugcaucauuuuaaaagcuguugguuccuaggagccuuugagcuucauauucuguguuuacagagauaccacuuacucugagaaacauggaauaucuaugccucagauaucauauggaaauagacugaaacuacauaaaggcuuuguagauauaaaaaugugguucuguucucuauccaagaauaucugaaaggauguucuaauggaauauguggaugcuaaccaaugaucacuacaaaauaauccuugcucuaacucagaaugauacaugcucuuauguaucuauacaauugccugauuacagaauaaugcuaaauguuuacacauguaauaaacaucauuuugucaaaaaauugucccacuuuugcuaauugcacaacauuggggacgguuaaaaucuugagacuauuuuaccaagaaagaaucuucuaaccauauauaauaaccaaauagugaaggaagagaauugcucuugacaguucgguagagucuuucuuuccagaauauacucauaggaaaacaacaguuuuaauaagaucccuuucuagauucaaagacucuguuuacuuuuuaauaggagaauaaucuuccacauuuaaaauaccuguccugaugagcauacaaagccuuuuaggauagauauaacuaaaauaauauuuaaaaaugcaagcuuaugaaugacuaaagauucggauucugggaauagacugaugucagggaaagcccauccucacagaaaauguuuucauucauuuuuguauccugugcaaaauuuaggaacauguacaaugcacaguuuggaaaaggcauuacugaagugguuuaaauaauuuugauccaacuauuaaugcauaucuccaaaaaguacucuauaaagugauaugagaaauguuuagaaaugguaaugcuuuuaucauccacugaagaaaccauagaacaauuaaucauaauuuauguuuauccauagugaaaucauagaauauugaaaaugaauuacuuuauucuguugacaucauguacacacacacacacacacccaauaaggaaacagcuauuuauuaacaaauuccaucuauccaugaggcauauacaagacaaaugugaaacaugacaaugaaaaaaaaucaguuuaauaagaaauggcacaagucauugcaucauuaauuucaaauggcaagggaaagagaauguaguaaaacaccaauguuuuugagcuagauaucaguuguuaauuuguuacuuuaaacaauuuggaagugauaaagaacugagcuaaccugaugacaauaagaaaaguacacaagaaggcuuauguuagacuuggggaguauacaguuauagcagaagauaaaagcaucaauauccagcacaaaacaggaccggagcucuuagaaacuguggaacuggaagcauagcugauauuaucuaagaccccuuaaccaagaugucacaaaugcaagaugcauauauaugcaugugguagacuuuucauucaaaaagucuccuuccaaagguuuacaaauaaauguucuuauccagccauuuauuauuuucaaaaauagugauucagcaaauauuuaucgggcuaauauguuagggaaaaaugccagguggcuggaaugcagugauauauaagaucuacaauuuacuauaaauugcuuauugugcaauagggagaaauuauaaguaaacagaaagauaaaauacaaaagagcaauacuagcuuaauaacuccaguugcauguguuuuucauuccauucuauuuuuguuuuuauuuuuagauagauacuagauuuuauguuucaauuguauggauuucucaaugugaacacuuacgguuaaugaugcaaaacaggcaucauuuguugguauuuuaaauuuguuucuucugguuuuucuuaaagguuaacauugaauuugaggagaauuugaggagaaucauccccagaugcuuuauuuggggacuuuggagaggacggccucuuaugaaaucccccauaaagcucaugcugagauggaacuguuucaauaagggauuucauacugggaauucagaaucagcauuucauuuuuucccauguuaaugaauguaccacgguaauuauuccacacuacuucuucaauaugauagaguuauagugucuaauggaggugagaacaauaaaccaacguaaaauaacuauccagagucuaaaucaucuugggaacauaauggcugcaauaugcuauucacuucaauaaagcauuuguccauuugcuguucagcuuaauaaagccuaaugauaaauacacuaaacugaucagagcaggaugcuauauaagggcucauaaaaugaacaaaaauuacaagcacauaagaaaacuggcauuccagguuuuacaaaucaauaaagauaccuauaauuuuuucuucuaacucuauuucuguguucucacaaaccuacaccauccaaaugcaucuuuuaauuuugaauacgauaaagguuacaaacaggcagauuauauuuccauauauuugcuaucuuauuaauuuuaacugaauacagaacauagagccaaaaaguuuuaaugauaucaucuauuacuauaaagcaugaguaacagaauuuguaguuccaaaugaaauucuuccucaacaacacuacaguuaaauaaguuauuuuauuaaaaagugaucccugugacuaauuuuaaggaaacguacuuuugauuuuaaggaaacauauuuuuaguuuccuuguuuggaacacauccucauauaaagaaguagcuccaaaaaugcaaagacuuccuuaauuuuaaacuuucaugaauuucacagaagaacagucaucuuuuacucuaagugaaaucauuuacuuuuuuuuuuuuuuuuuuaaauggagucucgcucuaucgcccaggcuggagggcaguagcacaaucuuggcucacugcaacuuccagcucccagguucaugugauucuccugccucagccgccugaguagcugggauuacaggcgcgcaccaccaccgcuugcuaguuuuuguauuuuuaguagagacgguguuucaccauguuagccaggcuggucuugaacuccugaccccaggugauccacccgccuuggccucccaaagugcugggauuacaggagugagccaccgugcccggcccuuauuuacuuucaauaaugaacaaauuagaugaaucauuucaucauuguucaaucaaagacaauuaaacuuguaccaugauuuuauuuauuauuguuguuacauggaaauauuccucugcaccaaucaaaagcauucaauaauuuugaggaauauuguuacaaaaucgagauuucaaugagaugugugucuaaauaugcuuuugauguaucuaauuauauaauuuugauguauuuugauuucuuaaauaacauuuaggacauggauguuuuaaaaauaucugaaugaauauaauuauuucuguugaguuuuuaaguuaaaacagcuucauuaaaaaaauuauauuguuaucaaccauagagugcaauguaaacuuccuaaaucugcauauuuauuauugcuguuuguaguuacaguagaaggggcaaccauauuuauuucauauuuaguuuacucauagggaguauuuuuguggguaguaaugucuucugaggacuuacccaccuauacacuguguuuucuaucuauugucuaauauaaucaucacagcaauacuaugggaaauguacuaucacuagguaugcuuguguuauaaauuggugguauaaauuggguaggcucuguuguucuacuguagucgcaguuucagacaagcacagagagggucaugagacuccuugaguagaguuuucucagcaugucuauuccccaaagaagccaaaccuugccuuuauuuuugaucauucuuaaacagaugggaguuuccuggucuuuccccaggauuaucagaccugugcuugcagaaugcagaguccugagccccagaugauuucucacuucuccuucaggcacaagagguacguucuuuuacccuuccucagcauuaacauuucuuugauuaaaucccaugggcagcaugccuaccccagagacagaaggguuuuugguuacauuuugaccucagaagcaguggaauuuugccuugcuuguggagauuaguuuguuucccauuucccaguaacauaaagauuuugcuucauaugagagucuagaaaaguagugcaagcuucccaaugaucccucagcaguuaccuccuucaugccagcaccccaaauccuucuaaaaagcauccaguggaggcauaagaagauaaguugugaaugagugcuaaguuuccuugugacuggaucucugcuauuucaaagugacauacuggggaaguugauuuauuuguuugccuugugaucucagcucuucgauggguugaauaauaguuauaauuuuguagauuauucagcuuuuucucacugguugucagaaccgguguccucuuuuaacuuuuuauauccccaaaaugaauguaagaauuuaaccaaacauuugacaggaauugaguauuagauuaugucacauuauaccuuuauagaaaguguagcauucaagcaauagcuacauauaagaaucaugacaucagaguuucaaaauuccaucagugaauucaucaacagaaucgacacaguugaggcacugagccugaaucugaaucaaaagaaguucuacaaacugaaucagaaagaggaaaaacaaagaauaaauaaaucagaauaucuaacagcuauagggcaauaucaaauguuauaacauauaugaaauuguuuucuuagaggagaagagcaauaggacagaaaaugaucaagaauuucauaaaaucaaugaaagccaaaaacaaaacacacaaaacugccgauccaagaacccaagacaacacuauguagcaggaaaaaauaaacaaacaaacaaacaaacaaaaaacccacaacaauuuaaaaacacacaaacacuuagagaaaacauugauaaauuguuggaacugaaagaccaagagaaaauuaguaaagccagcaaggguggggaaaacaggggagugggauauagcauauagaagaauaaagauaaaaagauagaaauucuugcaagacaaagacaauguaguuauuuauuggauauguugaaaauacuaaaauaaaaucacuucaucccacagucuauuaucuaguggaaauaucuuucaaaaaugaaaagaaaaugaagaaacuggcaaaaacuugagagauuuuaaugucagaaggccuguucuaguaguaguauucauuuuucagcacgaguauaauaacagauagaaauuggaaucuacccaaaaaauaaggagcacuagaugguaaacauaaaaguaacucuaaaauguaucauauuaaauguuuaaauuuaaauacaagaaauaauauaauaucuaugcuucuauauuaagaaacuggaaaaauaaauuuaggucuaaaaaauuagucuugaauuaaacuuucuguuuaaacgaaagaaauaaaugagaaauaaaucaaugaaauauaaaucagaaacgcaauaggaaaaugaauuaaaauaaaguuauuuggaaagaucagcaaaaauaguauaccuguaaccagauagaucauaacaaaaaagagaauguacaaaucacaaauaucagaaauaaaagagacauuaagaggcuaagggaggaagaacauaaacaaauguauaucaauauguuugauaauuuauaugaaaugaacaccaaaaucuaaugaagaaaagccauaauuaaacguuccuuuggguuauacuguauauccauaucucugagcuguaucauugcaccaaaaccuaauauuaaaaauuuuuuagagauguuaagcaucuguucauauaccugugggccauuuguaucucuucuuggagaaaugucuauucauauccuuuaucuauuuuuauuugaauuauguuuucugcuucaguuguagaguuucuuauauauuuuggauauuaaucccuuaugacauauaugauuugcaaguauuuuccuccauuccauugguugucuuuuuacucuguugauucuuacccuucuuauuccuacuauauuaucuguguuugugugugugugugugugugugugugugugugugugugugugugaaagagagagagauuuauaaggcuauuuuacaucacuuuuugaaaggacagaauguaaauuucagcaaacauaaauauuaaucugguuuucuaugucaaauuggaaaaguuauguuaaacuuucaaguuuuauuauauuuacauauaugacaaggaguauaugaaaggaaaaauguaagaagcucaauuuauauaaaauaugaggcuuaugaaugauguaccccuuuauuucuauuuuuuaugcuguauaccaaagggcaugauauuacauuaauuacuuauuuuuuacuaugugcuucuaaugggaugauaaaggugauuaccggucagcuaucuuuaguuuuuaagugguuaaaaauaaaaacuaauuuuauauuuuuuuauuuuauuuauauuuuuauauuuuauuuucauuauaagauuuacauacuggcuggaauguugaauuggccacuuuauguuuuagagauucaaguuuacaaauagaaaccagaggucagguaaucuaauuugaguguuaaugagaacccauuagcauaguuuucuugguggauuucacaaguuccaucauuuuuguuaucuacuguauauuuacaugauuaguuuucacuauacucauuauuucuacaauuucaaaucuuguuuccaggcccagaaaauuuuuagaaagcuauuuauguaaaauuccacguaaaauuuauguaaaauuuuaugucagacauacaaacauaaaauuaaugcagagcagaugauacacugacauaugcaaagucugaagcuuaaaauucucaaauauuuuuauuacagauauuuuugcaaauuguuuuucucucucucauuuuucuuuauuuauuuuuugaggcagagucucauucugucgcccaggcuggagugcaguggugcaaucucagcucacugcaaccuccgccucacagguucaagcaauccuccugccucauccuaccaaguagcugggacaacaggcacgugacaccaugccuggcuaauuuuuguauuuuuaguagaaaugggguuuuacaggcuagucuugaacuccugaccucaggugauccacccaccugggccucccaaagugcugggauuacaggugugagucaccaggacuggccuauuuuucucuuuauaaugguccugaauuauauacacacacauacacucacacacacacacacacacacuauauauauauauauauauauauauauauauauauauauauauauaugcacacaccuuauuuauuauauauaaggacaauauaaaucauaaauaaaagccauauaagcaaauaaauuuauucaauuagaaacauuugaauauucucacugauuccuucccaauccccaacugucauccuccaggauuaggaugcuucauccagccuaaauauauuugccauaaacguccucaaguuauuagcaauaucgaaaauaagaguaaugauaauauuaaaauuauaaaaauaacaauaacaaaaugaccugccuguagcagccacuuaaauauuuguuuaauaaauagauaauucuuaaauguaugguaagcaccaugauuagaucgcuacaugaaguuuuccauguaauccuccauauuacauauuuccauguaauaugaaggaaauauuuucauuaaucugaguuuaaauaugagaaauuauaaugcauaauaauguaaaauagcuuaagaucaaagcuaaaaagugguagauaugagauuuagaucaaauauauacaacuccauaccucauaagucaaaccuguauaguacuucuucauaugacgcucuucauaaucauccuacuaucucaauaucuacugaacuagacccagaauuuuuagucugaaucuuaaucucuccauuaacuuauucugauguacugcuucaauuuuaugccauauucuucuuuauucaacaaguauuauauaaaauauuauauaaaauuauguuggcuuugcauaaaauauugaaugugucucuccaccuuccuaaaccaucaucauuuagaaucuguuuggaaccauugaucuuccagaaacucuuuucugaguacucuaugaagaugugguuaauuaauauucacaauuccuauaauauuuuauuuccugcuuacauacaguauauaauaaaguauauuacugcuggggcuucuggaagucagaaaugacauuuuaucuuuaccuucuuuuuauaguuacuaacuuucuucaagggaauuacugaaucauuaugcagcuuggaugaggcaucuuggugccuugccuguagcagugaucuuucaauaaccaacucuaguugugucagauaccaucuuugugacuuuggguagguuacaauuacuauaaaugaauagaaacauuagguauagcaacuauugucaguuaaaauguucccuaucaauuuguaauguuucuuucucccccuccauccuuccaccauagauuuaccuuguucuaucacagugugaauaaaaacauacaaauuugggaguggucaguuuuacaaguuaguuuacauggagagcaccuugcuuuaucauucacguaguuuaaucuucuuuccuaugccauaucagagagguuaacuaacugugcguucucauaugcaauauuuccauuucuuaaaauucuucaaaaauguauaagcuaauuugccacacugucagguguggcaggaaacaccaacaggggcauucugcuacuuaacauuccaaagaggcauuuuaauuuuuuucuguugcuuguuuaccucccuaucccuguagcagccugaaaaggcucccucagacuucuaaauaugacuuucauuauucugauuuuaguuuggcaaacuuacuuacaccuuccguaucuacuucauccagauccuauucuccagacaucugacccagcuugguaaucacauucugaaaucugauugcucccugaaucuugugguugguguuccugacccaggauuuuacucuagcuuugaucgucccagugauauuuauucaguaacgagagcuuuauugcuuuucccaacauacauauugacugucuugauaaauuaaacugauaaaacaugacaucacuugaaaaggggaaaacuaacucaacauucaacuggcauccuguauaaaucaaaauucucugagcaguuauaagcuuguauuguuauugugguuauuauuauuaguauuauuauuauugugagacagagucucacucugucacccaggcuggagugcaguggcacgaccuuggcucacugcaaccucugccucucagauucaagcgauucucuugccucagccuccugaguagcugggacuucaggcaugugcacuacagccagcuaauuuuuguauuuucugcuagagacagguuuucgccauauuggccaggcugguuucuaacuccugaccuugugauccgcccaccucagccucccaaacugcugagauuacaagcgugagccacugcgcccagccaagcuuguacuuuugaccaacuaugucaguugaacaacaaguuugucuagaugugucuaguguauucugucaaaauauuccauguauggauacaauccuauguugcaacauauuauuaguauuuauaguucacagauguugcuauuaaaaauaaauuucuaaaacaaugauagacauagaauuuagagaauaauguuaauaauaaaaauaagcauuuaauauuguaaaauaauacauuguuuaagugauguauacugaguuugaagaauuaauuaguaacaucuucuuccguuagaguuuuuaaguuaugcgucucuagauucuuucagccagagacaagucaaucacaagccagaauugagcaacaaucugcccugugauaugauuugauaagaccaaauuaacaaauaggcucauauucugacuuaaauuaaucucgucuuaaaaaaaguagauuuuaauuggguaacuauuguauuuucuaaaacaguuaacauaacuaaauggagucaaauuauauucuuauuugccuuugaccaauucaaccagaaggagaaggugcaagaauagaauaauuauuuuuauuucauuuuauauuuuuuaauuuaacuuuuaaguuagaugcagggguacaggugaagguuuguuacauggguauauugcaccccgguagugagcauaguacccaauaaguaguuuuucaacccauguccuccuuccucccucugcccucuaaguaguccacagugucuauugcucccauuguucccaaguuuauguccauguguucucaaaguuuagcacccacauauaagugaggacaugcaauauuugguuuucuauuccuguguuauuuugcuuaggauuauugccuucagcuccauccauguugcuacaaaggacaugauuucacuguuuuuuuauggcuguguaguauuccauaguauauauauaaauauagauauauauaaaucuugaauaaaucaaaauucucugagcagcuauaagcuuguauuguuauuuuauauauauauauauauauauauauauauauauauauauauauauauauauaucacauuuuauucuccaguccaccacugaugggcauauggauagauuccaugucuuugcaauaaugaauagugcaguaaugaacagacaaaugcaugugucuuuucagcauaaugauugacacaaauaaauugaaauacuuucuaagcucauggauugaaagaaucaauauuguuaaaauggucaugcuucccaaggcaauuuacagauucugugcuauucuuaugaaacuaccaacaucauucuuuaaauaauuggaaaaauaacaugaaauucaucuggaaccaaaaaagagccugaauagccaaagcaauccuaagcaaaaagaaugaagcuggaggcaucacacuaccuaacuuuaaucuauacuacaaggcuauacugaugaaaauuuuaugaugcuaguacaaaaacauacauauagacgaauggaacagaauaaaaaauucagaaacaaagcuucacacuuucaaccaccugauuuucaacaaggucaacaaaaacaagcaaugaggaagacuccuuauucaguaaauggugcugagauaauuggcuagucauacuagagaaucauuuaaauagugucugugauucacauaaauuccuuauuaccauucuauuaaaugaacacuuauccuggaguaauuaccucuaucuuuuucuuuccguaauuucuuaaaauagaagaguaauacuucucuacuuccaggaacuuuaaggguacucuauaagauuacagaaaaaauuagaagccuauaaagguauaugaaauuaaagauaauaaacaauuuucucaagaccuuugaguaaauuaaacuuccaauuuuguguacuugucaguacagcuauauuaauucuggcuuaccauguuuacgucauauacacauucagccuauccugcugacuucagaaauuuaacucuauugagaggugauuucacuguauugagaucauacuuacuacccuugucagcauguagagcauagaaaccucacgaaacuagacaccagcaagaauaaucaaaugaguacuuuuaaaagcugaacaagagaguugacaacuuccuaagagcuacaaugaaguagaaggggagcauagugagcaagggagcucuaaucacagguagcagaugaaauagggauuuugaagaaagcucaaaggaaaagaggacugaaguagguugagggauggcacccccaaaagauaugccuacaccuuaauuucuguaaccuaugaauguuacguuacuuagaaaaagaguacuugcagaugcaauuaagguuagagccuugagcgaccacaagucaaggaaaaccagugcagccaaagaaaggcagaaaagacaaacaacauauucuccccagagcccugcagggaucacagcccugccaaguuugaauuuuggacuucuagccuugagaccugugagagaauacauuucuguuguuagaagccaccaaauuugugguaauuugguacaacagccucaggaaacuaagacaggcacuguggcaagagaaaucacuucauaauuuuccuggaguucuugaugauaagcucacccauaguuauagauuaucuuuccuacuaaggagaaaaauguaaaaauguuauauuucaacacuauauugacucaagaaaacuauuaaguaaucucaugcaaacuuaugaaaauaaaauuugauuaaugauuuuugugauuaucauaagaaaugacauucacuuaaagcaagacaauucaaguaaguuauuuaauucucauuccauuucuuuccuuucuagauccugaugguuucuuaugcuuuuacucuaacaaauucauguaaaacauucauuuuaguagaacugagaagauacguguauuuuuugacaagaaaaauuauuuguaaucauuauuacacagaaauuguaagaaaacuaaucagaagggaaaacauguuccaaaauaacaauaauaauaauacucauuaugcaauaaacaauuuuaagcuaguaauuacaauguuucaaagaaucacauucuaucaauuacgcuaaaacuuaauuuaugaaaugcuuuaauaacauuugauauuuauuugaauauucuauguacucacuccaacauuaugucucccuaauugccucucuauuuucuccaaaguccagaucaagccugucuccucaauaacauguuuuuagcuaacugaagcccacagaagucuccacuuuuggaauuaauuuauauuacuuaucaaucauuuaacguaguuuguuccuauugaucaauuaaucuauuuccugauucaccaaauaaaauugaaaggucugaagaauacuccucaauaagcagcaacuuuauaacuaucucuuucauuuucaaaaucugguucugcuuuuccaugugaacuuaaugaauguaucugugccucaguuuucccauauguaaaauaaagaacaucaucaaaucuaauaauauguaagugcucauuuaaacagaacaauacggagguauugaaaaugcuacauauuuguugauuaauauaguuaaaaaauccaaauaaacacauuuuguaaaacuuucucuggaaaauuuaggcauuuuuuuaauccauauaaccacaguuuguaauagguaaaauuuuauuaugaauuagacuuggaccauucuaacaguuuaccauuuguaguacacuaaauccacuuuagcagagcaaagacuaaggaggacuauguaucuuaacaacuuuuaaaaaaccauguaauuauuuccauagcgugcacaaacuaaacuugaaguaaguccacuaauguaucauaauuauacacaagguguaauauuucccaccauuauuauuuuuucugaaaucacuacauuguuaaauauaucuuuaucaauaaccacaaauaucuaaauuguauuagcuuuucaacuggcucauaugagauacuuauucucacuguaacgaauuuugacacugugaugauccucagaaaugcagccacaccauaaagaaagucagcuccacaaaggaaacucauaaauccugagaaaucauuggagaugucacacugggccuugaagaguagcauuuuacccccgcaaagaauugcugugaguguuccuagccagaauuaccuuauuagcaaacauuucagauagggagauguggacagaaaauugaugacaaauuugaaauucuauauugggagaggcguacagaaggaagagaacgucugcagaaacaagauggaaaaccauaaagggaaaaaaagaagucagauauauuuaaaaguguguccaagguaagccauuuacuuaagaaugucauagaaguaugaucacagcauggugaucaaaacuauuucauacuuuugcuuuggcaauuaagguccuaaagaacuuguuuucaauggccauuaaaaaaugugcaaaaucuaaucaucugacagaguuuugauguaaauaugagcauacagcuucacagugcuagggaagacacuaaagaaaaaugcaugaccagcuuuaugaugauguuuuaaagacagguuaagcugucuucuaucauuaagaugcauaacuaauuuauuaagcacaucaagucaugcuacuaaaaugcaauuuuauggagaugaagcaaauaaugccuuuucaggacuaaguuugaaauacaaaauuuaaguuguagggguaaagccacugacuacuuccaaacaaucagacuaagaagauuucauggugcuauacuuuaaaguaacuuacauuuuuuauuuuaguuacauuuagcuuaggcaggagagacaaagagggagagcacuagaggaaaaagauaacugcacaaauaagagguuggugguaaagaaaaucaaagauaugguaauugcaguaauauagaaaauauuauucuaugauauuggaugggauacagucaauuuuuuaauguuauuuagaucaauuucuaggccguuuccucauuugcuuaugcagucauuuagucaacaaauauuucuugaguuuauacuauuucuagggccuauguuguucuguaaaagauguaacucuuguauaguaccaauaacacaguuuaugguauguguauguuuguuuuucaauuuguguaucucuaugugugugugugauuaugugugaauauauauauuuauauauauuaaaauauauauuauuuuaauuauauuaauguauuauauguauauuaauauaauuaauauauauaaaagaggauauauaaauauauaaacauauauacccuguuuaauugauggacauuuugucaaaauaauguuuccuucagaaauaugauuuacaguauuuaucucuuuaaaauauauauauauuaaaaccaaauauagccaggguauuuaugacauuuaaggagcagccaaaauagauuuauguguugugcucauaugcccuagaggguuagagugauaaauggugaguaugaugcauagauucacauauuaaagguauucaaguauaaacugacacaaucaagcauacugucucuggcucaguaaucacugaaacaguguuuggaaaaccuagagugaaccacgacaguaguaugucaaaaacugggucacuggaaacuguaucuauaaacuucaaagaugugucuguccauuuagucuaaacuaaaugacuuauuuuagauucagauugcaacuuucuccacaguaauacuaaaauaagguuaaccauugagaccuuaaauaucuuugcauauggaaaaguaagugcugcauuagcaaaccaaaacaguuacaguuaaaaaaaaauauugugcuagaguuuucaagugccugcacugcugauuaugacaaaaauauucuuccauucuuaaaagauuuaaguacauuuucauagucuaacaauacuaagcaaacacacacacacacacacacacacacacacacacacacacacacacacacacacacacaugaaguuaaaucaaauaguuuagccaucuguuuuugcaaaggauuuuuauccuaagaaugacaguguuuuaaauaacuucauuucauuguucuuuggaccacuccaccagucgguaaaguauauauuauuucaauuuuauuagccuuauaaauuaaagauagaaaagucacauuuucguuccuaaaugaauuucacugacauauuuuuaaaauuccaucauuaugcaacaccacauuuuaagcauucauauuugacuacauguugugauaguaauuaaguaaaaucauuaugcaauauauguaaucuuuuuuagaauacagcuuuaaaugcuauguuauuuagaaaaacauacgaaauuuuuuucuuuaguuagugguuauaaguagauucugagauauauauguuuucauuugcuacugguaaaacauuuuauuauuuuaaucauuuuaacuagguaaaaugauuggauaaguaaagcaacacagagugaaggauaucuaaucauauaacaucuuuacucaaaaugccaucauucaauuuuaauaucuguauggguuuacaaaaguuauauaaaccucacccugugugccacaguuucauccucuauagauaaagaaucuacuacauuagauuguugucguguuuaaauaagacaauauuuuuuaaacuuuuagaaaauuaucuuauguuuaauguaaagaagaauugaauuucagccgggugcaguugcucacgccuauaauuccagcacuuugggaagccaaggcgggcggaucacaaggucaggagaucgagaccauccuggcuaacacggugaaacccggucucuacuaaaaguacaaaaaguuagccgggcauggugccaggcgccuguagucccagcuacucaggaggcugaggcaggagaauggugugaacacgggaggcggagcuugcagugagccaagauugcgccacugcacuccagcuugggagacagagguagagacuccgucacaaaaaaaaaaaaaaaaaagaagcacugaauuucuuaaaucaguagcauuucuauacacuaacaacaaacuauccaaagaagauuaagaaaacauuuccauuugcaauaucuacaauaaaauaaaguaaaauauuauauuuaggaauauguuuaacuaaggagguaaaagaucuguaaaccgaaaacuauauaauauugacaaaagaaguugaagcuacaaauaaaugaaaggauaucacauauucuugguuugaaauaauauuauuaaaauauucauaauacccaaagugauauaaaaauucaaugcaaugccuaugaacgcccccaugauguuuuacacaaaauuaaaaaauaauccuaaaauucauuacagaaccauaaaagaccccaaguagccaaagcaaucuuagacaaaauaacaaauuuggaggcaucucucuaccuggauuucaaaaaauacuacaaagcuauaguaaccaaagcaacaugguauugacuuaaaaucagauacaugugcuaacagaacaaugcagacagacuagaaauaaaauccacacauguacugccauuugauuuuugaccaagaugucaacaacacacaauggggaaaggacauucucuucaauaaaugauucuaggaaagcuggaaacccacaagcagaagacugaaauuauauccuuacuucacaucauauacagaaaucaauucaacauggauuaaagauuaaauguaaguccugaaaucauaaaacaucuacaagaaaacacaggagaaaaguucuaugacauugaucuuggcaaugauauuuuggacaugacuccaaaaacacaggcaacaauuuuuuuuuuaaaaggcaaaugggauuaagucaaaauaaaaagcuuuuuauuauuauuauuauuauuauuauuuauuauuauuauuauacuuuaaguuuuaggguacauaugcacaaugugccaguuaguugcauauguauacaugugccaugcuggugugcugcacccauuaacucaucauuuagcauuagguauaucuccuaaugcuaucccuccccccuccaccccccccccaaaaaaauuaaaacaaucaaccgaaugaagagacaaacuaugaaagguaaaauuuaaaaauugcaaauuauauacuugauaagagguuaauauccaaaauacauuaggaagucaaacaacucaggaaaaaauaaagaaaaaaaccuaaauugauauuucuccaaagaagacauacaaauggccaacagguauaugacaaaaugcucaacaucacuaauccucacagaaaagcaaauccaaaacuacaaugagauaucacuucacacuauuguaaauaaggaaaaaauauaacuguuggugaggaaauggagaaaagggaaccacuguacaguauuggugagaauguaauugauaccaucauuaugaaaaacaggauggagauuccuccaaaaguuaaaaauagaaguaccuuaugauccagcauucucacuucuguguacaaauacaaaggaaaugaaaucauuauuucaaagagauauuuguacucccauguccacugcagcuuuauucacaauaccuaaaauguggaaucaaccuuguguucaucaguggguaaaugcauaaugaaaaugugucauauauauacaaucagguguuauucagcaucaaauauaaguaaaucuugccauuugugacaacauggaugaaacuggaggacauuaugcuaagagaaauaagccagacauagaaagauaaaaauauugcaugacaucacuuauacgcgcaaucuaaaaaauccaaauucauauaaacagagagcagaaugaugguaccaggagauaggaggguaggaaaugggagagauguugaggucaagugguauaaacuuucauucauaagaugaauaaguccuggagacauaauuuuuaacauguugacuacaguuaauuauaauguauuuuauacuugaaauuugcuaagagaauagaccuuaaguucucaguuguugucaucgcauacguacacacacacacacacacacacacacacacacacacacacaaccaagauaacaauuugaggugauggguaugauuuuuagcuagauugugguaaucauuucacaauauauaaauauauaaaaucacauuguagaccuuaaauauacuaauuuuuauguucaaucauacaucaauaaagcugaaaaacuuaaacacaauuucaucaucaaaaaaagaaacaaauuauagaaggauauuucaacugucucucucaguaagacuugaacaacacuaucauccaacuugacacuauugaugguuuuagaacgcgauagcuaacaacagcugaacacauauuucuuuucaaauucauaaagaauauuuaccaaaauagaccauacucugagugauaaaauucugaggauccuagaaauagaagaaaaauuacuuaaccugaaaagggaaucuaugaaagaccuacaucuaacuuuacgcuuaauggugaagauugaauacuuuccuguuaagaucaggaaaaagucaagaauuuccacuauucccacuucuauuaucauuguccuggauguauugccuagugcacuaagucagaaaacauaaauguaagccauuaaaaagugaaaaaauaaaacuuuccuuauuauaagacgaccgauguguaagaagaaaauccaacagaagcuacaaaaagccacuggaacuaaaaaguguuuugcaaguuuucaggauaaaagaucacauacaucaaaacagucaaauaaagcaauaaaguagaauggagaaucuaaaagugaaacacaaaauuacauggucaauugauuuuugauaaaggugugaaggggauucagugaagaaagcauagccuuuucaacaaaugguacugacuauacguaugcaaaaaaaugaauuuugaucuauaacucauaagauaugcaaaaauaacccaaaaucauucacagagcuaaacauuaaacuuaaaacuaugaaaugucuagaaauaagcauagaaaaaaucuuuguaaauuuaggauagguaaaaauuuuauagacacaacgcuaaaauaaaagcccauaaaaaaugaaauggacuucaucaaaauuaagaauuucuacuuugaaaaacacuguuaaggucagccacaaaugggugagaaaauacaugcaaaucauacagucgacaacaggauuguuuccagagcagaaaaauaauguucaaagcuugauaauaagaauacaaacaacccaauuuuaagacaggcaaaacuuugaagagacauugaaacaaugaaggaaaaugcaugacaaacacaugagaagaugcuuaacacucuuugucauuagggagaugcaaauugaacccacagcgagacaucccuaugcaccuacaauaaugucuaaaauuaaaauguguaaccacaccaguauugaugaagauguggagcaacugaaacucuuauacauuaccagugggaaaguaaaauguuacaacucauuuaaaacaauuugaaacuuucuuaaaaaguuaaacuuauaccaaccaaaugaacucaucauuccauuccuagguauuuacccaaaauuucaaaacauauguuccuauacagacuuaaguguaaauguucauagcagcucuauuuguaacagccaaagcugaaaacaacacaacuguccaucaacgugugaguggauaaacaaaucauaguauagccauccaaugaaauaguauaaauuuauaacaagcaaugaacuauugacauucauagaaauauggauaacggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagcugggcguaguggcgggcgccuguagucccagcuacucgggaggccgaggcaggagaauggcgugaacccgggaggcggagcuugcagugagccgagaucccgccacugcacuccagccugggcgacagagcgagacuccgucucaaaaaaaaaaaaaaaaaaaaaaaaagaaauauggauaaauccccaaauaaguaugcuccguuaaagaaacaaggccagaaaugcaauguagauuguaugauucuguuuauauaagccuguauaaaaugcaaacuaauacagugaccagaaaaaaaccacguuuuccuggguauggaauugcagucaggaagugugggugagaagaauuacagagaagcaagggaguuuggggggaaugaugacuacuuuguguuuacaauuuuuaaguaugucaguauuuaucaaaguguacaauuuaaauuuguuuaaguuaguauaugcuggucauacaauaaauauuuuaaaaugcauguguaaauuauuuuuauuauuucaguugguuguuuauguuuauuauuaaaauguuaacaguuagaguuaaaaagcaagaacuuuaccauuaucauuauaccaggcaguaugauauaggagaaaacauaaugggaaaaaagaguuuggagauuuggguucuaguuuugcuauuguaaugacuuacuuaccaacagucuaaccacucaagccuuuaacuuccucaauuauaaaaugaaaggguuguacaaggucacugguccucaaucuuguuuggagucauguaacauuauauaguauuaguauuuuaggcuggaugcuugaaaggauugaaggaugcccaauagaauauuuugcagaucaacaauaauuaaaacaugauccuaaccuuauaccaauaccucagaauguuguuuaaaugacucacauuuaaguugccauuuccuugggguuuuuacuguaccauucgcucuuacaugaugcucauauauacaaaaggcaaaguucucauaugucccagaaaauguauuuccuuggaauuggcuugaccucaccauuauauuuaccacuugcugucaggauuuguacccuguguuacaauauacuacacaaccuacuuaaaguuguaccaauaauacuguauguagacaguauuagaaaaauuauaauguacauugcucaaaauuagacaacauuccugugaagcaguuaagccuacuuugaaagcaucauuuuuaaaucuguaaaaugggaaaaaucauauauauuauucuggcuuacuguguuaaagagauaaugacuauguauuaugagucauaacugacacacaauaaauaauguucaccuagugggcacucguaauuuuaugucuuuggccauuauugaaaauacaaauauaauucugaaugauugcagucaguucuugcuuagagcuccuuuuccuguuucuaaugcaauuuaguuugaggcaauacuuuauuuauugguuaaguuacggcaaacauuucuaagaacuccagccauauuuuuaugcuuacaaaaauuuugacaaauauagugucuauuaaagaaggaugaggacuugcuuugacauuacagaaauaaaauucuaccucuuuuuuucagaaauaaaugaaagaaugcauauuuuuagugaauagagacugguauuauuuucuaaguuaaaauuuugaauuuuggccaaacucaaggaauucuuuuuucacaggggguuaaaauuaaauuaaaaaaaaacauguuugugucucucugccaauauuauauguuuuacgcccuuuggaaguuuuuaaugaugauuuuuuuuggaugauaaaaaagagagaacuuuagcauucugugaaaauucucucaaauugaguguuccacauccaauuauagcuuaggaucccaaguauggagcuguagaauuuccaaugagaauguaucuuuuucuagucuccuauuuauuuucuucuaguccauccuguguuaaaaauuuucacaccuguuuuuauaaaugccuuuuagaaaaauuuuaauauacuuaugagacauccauccuuucaguaggguuuguuauauaauacaaaaaauauuucaugucuguauaggauaacuuauagacuacaagaaaucauuaccuccuuauuaauauaauuacauuuaaaauuuuguauccuauuaaacuaauuugcagcuuuacuauugugaaaauauucuaaaagcaauuaacucuucucuguuacuaaacuuccucagcuuuuuuguuuuauuuuauuuuguuuuguuuuuucuuccaaguaucucucaucaacucuuaaucauaccuuuaagaaaaaaaaauuaugaaacuugaaucuaacuaaguuggguuauuuuuguuguggcuuuuuuguuuguuucauuugucuuuuccuauuuuuaugccuuucuuucuauuacucucuuuuugauccgauaucgguuacaaucggccuucuguauucuuggauuccacauccauggauucaaccaaccucaggcugaaaauauuuuuuaagaaauaauaaaaauaacaauacaacaauaaaaauauacaaauagaaaacaugguaugacaacuauucacauagcauuuacauugauuuagguauuauaacuaaucuagagauuaucuaaauggaagaugugcguagguuauaugcaaauacagugauaccauucuacauaaggagcuugagcauuugcagauuuugauauccaccugguuccuagaaccaguucuaucugcugauacugagggacaacuauauucuaaccuucuucauucucauuggauuguugcaauacaggaaguggaaguuaucuuuuaacgaaaaacaaaucuucaacagaauauaaaagcacuugacacugaagaaaaaaauaauuccaaaaagaaaguuuucuuugauaaggaguuuuccugacgggauaauaauagccaaagauuuuuggaaagugaaguuucuuaaguauguuagguagucucuucaaaaauaauagaaauuaaguaauuaaaaacaaggaaagcaacaaauggcugucaaaugcccaggcagugacauagguugagcugauuuacuuccacucagaaaugugugugguccaugauugcuacuccucaaacaccaaaaucccuucucuucacagugccuugucucuggaacuaccucucuucgggccuccaucugaccucaguuugacuacuucaacagccuuuuaaauggacucacuauucucagcugaaaucuucuucuucguucauguccagugguuauaauccagccuaaaacauuuuaauggcuucccuucaguaagugaauaccugcuaacuuuucacaaugaaacucagacauaauauauuuauggagccuugcauaaaacuucuagaaaguaaaaauccaaaaggaacagaccacucucucuguacaaagccacaaacuuagagguguuuguuuuuuuguuuacauggcuuucucccucuguuauacuguaaguuccucaagaacaaaaacuguaucuuacuuaaacuuuguuuaaauaaguguuuaauuaaguuuuuuaaaaauaaauaaauauuucauuaaguguuuguuuaaauaagugcuuggcuccaaauuaaggaugccaccaaguagguaauuugaaguaauuauuuauaaaaccaauaaauagcauaaugguuaagaaagauuggugauuuucuaagaacugggauccaaucccaguucugccacuuucuacuagcaggguaauauuggaaaaguuauucagucucuguaagucucaauuuuaucugaaaaauucagcuaguaaaaacaccuagucagggugguuauuauggaauuguauuagucaaugaucuaaagccuuuaacaugauaaccacuugaaaauaagcacucaguaaauauuaaauaauaguauuucauuuguaucuccaaaccugguaagauaauugaauauaauuaaauuuccauucauguuggguggaugagauagcaucccucuuaguauggaaaaaagugacacagucuagguucaugacaaacucuuucauauacacauaguauugauaauccagcuuuccuugggcccaaguuuucauguagucauagguaaguuuacaugucacauuagugugguuuuacuaugaucauuccauaucacucauuuccaaggcauacuauacuuaaaggauuucuaagauuucauuuguucagauaaguuuuuggggucaauuuuaagccuagcuucaauuuucuauauccccucuuuguauuaauucccaauauuaaaccuggauucuuucauugaucacugcauuauuuuuuuccauaacauguguacacauuaauuugaguguucguucaaguuacagcaccuuaauuuggaggaagaaaauuaagagaagagaugcuuuuccauacuugguuggauaucucccuguccccuaccccuguucuagaugcacaaaccagcccacucaugcuucaucuaagaaaacagaaauaagagaauguggaaagauuuuuuucgaauauauccagaugcauacaguacuuggagcaaaauuuaaauaauauaaagucucacucaagggguaguggucccuuuuuacauauuaguguguaguaguacaucagucuaguuuagauuaaaauuuucugaaugaaaaacuuagugaaguguuauuaacgaaguaucauuuuaaaaagaauguaagccucugaaaauuauaacguguuuauaaacauuuuguaauaauacauaauauauaagguguuuagaaacacacauauacacuucuacauaacccaguugcuuuucaacauuuuuaaaacuuaaaguuauaaucaacgugauaaauaaaaaaauucauacuucauagguauuuucacauuugaaaaauugaaaacuucaaauaaaauauuguguaaauccuaaaacauuuuuaacauucgcuuuuucaacuuaaaauaggauuuguguuuuucuaaaaaaguaaaauuugauaacaauaauuaaaauguucucuaauaguaauaacuuugcaaugaaaugagaguauuuauuugaagaauuaucauugauaauuaagauuuuaaaacaaauugagucucucuacaccguuaauucgaggaauaaggcaaaaacuacuuucccauuauauaaaauaaggaauuaucguauuagcccuguaugcaucccauuaaggugguauguuuacauauauauauaacacacacacacauauauauauauauguauguaucauuuagguagauauauauucauuuaccuaacaauauuuugauaucaucuucuaacagaaauaugccaauccacucuaaaaguaaucaccuaaauaacugugucauagguaaguacaauauagagaauggagaaugaauuauaaaagcuaaacaaaagcuaacugauuuaauagggaaacgacuguaaaagaaaccaaggaaaugaguaauggcaaauaauuuuaaaaaaugaauagauagagaauuuuuuuauuuuuaacuuuugugaguacauaguagguguauguauguaugggguacaugagauguuuugauaaaggcauacaaugugaaauaagcauauuuugugguaucuaaaaaucaaaacaauugaagucauggacguagagauuagaagcagaaugcugaaaaggaauugcaaaaggaaaaaauguacagacuaaauauagaaaaagaaaaauaguuuuaacucucuguacaaacucugaaaggcagugaaaaucuaccacugugggaugacuauagugaacauuaauauauuauauaguuucaaauagcuagugaguguauauugaaugcucccaacacaaguaaauuauaaauguuugagauguuggauaugcuaagcauccugaucugauuacuguaacauauauauaguguaguaaaauuaacuguccauuauauauaguguaauuaaaaguaauugcaaaaacugcaauuacuuuugcaccuacucaacauaucuauaaauauaaacauugguauguaccccccaaauaugugcaauuauuauaugucaauuuaaaauauguauauuauuauuaaauauaaaaagggggcugugagacucucagcuucugccuguauaugaucauuauuuucuuuauguuuucuacuccccaguaguuguaaauaaaugaaauuuacaauuuuguuuguuuauuaccacaucuauaagucaggauuuaugcaaacauguuagaugcuuuucacauugguggaaauggguagaaaauugaacugaccucuguauuaacaucucacaaucucauuuauucuaauggccccuaauuuaauagcaagacuaaauacaagaacaugucaagcaggauuuucaaacaaaugagaugauguugcuuuaugaacugcaaauaaacauuuaauugcacaauauuaaaaggaaaaauacaauuagaggaauguaaccucuucuucaaugaaaauuuugagcaaacuacaaagaaagugccaacaucaucuacaauucuacuaguuuuuuauugcuacugguauauaauugugaauuauagcucuauauaaauaauuuguaaugaguuccauaauaucaauaaaaagcaaauuaagcaauccggugaaauaauucauaucagaaaucugccauuuuucaguuuugucauauauguaagcccauuuccaaauagugucuaaugaauucaauuaugaauguuaauuacauaacauuuucuugagucuguacuuguucucucugccugaauuuuuuuuuuuaaucucacucucuauuuuuugccugugagauauuccuaguuaucuuuuaaaacucggcccaggaaucucaacuuuuaugaaucacuugcuuugauaucuguauuagucuauucucacacugcuauaaacacauaccugaaacugaguaauuuaugaagagauuuaauugacucagaguuccacaggcuauacaggaagcauggcuggguggccucaggaaacuuucaguuaugguggaaggcgaaggggaagcuggcacaucuucacauggcagagcaagagagagagagugaagagggaaacgcuacacacuuuuaaacaaccagaucuccugagaacuuauucacugucacaagaacaccaagggggaaaucugcccccgugauccaaucaccucccaccagguccuuccccuaacaucgggaauaacaauucaacacgagauuuggguggggacacagagccaaaccucucauacuaucuuaugagaauuagacauuuuucuguauaauugcuaucuuuuauaaauccuuucuuaauuauucuuuuuaacauuuaugugcuuauauuucuagcuccacuaauagacuguaagcugcuugagauuaaugaacuugucuuuuuugucuuugauucucuaaaugcugggauaugcuauuuuauggaguugaacugaagucauguauuaccuuuuuuuaaggauuuuugaaagucuuaaaacucacucgaaauauuagcaggcguuauauuauuuugccaucagaagaaaauaauuaacauauauuggccuaauacuuccagucuacucuaaaguggguagagcaaaaaguuaauauaccuacucaaaauccuucugguauggaagacuagagcuuuauuucuaacauuaaagagaacaguauuucuuuuaacugaacugagauggugugaagucuuuauuugaauugggguuaggacaggaaaagaacgguaguaaaaauccuguuagaauacugugggguugaguuuuuacuaagagaaagggcaagaugaaagcaguuuuaaccagagcugugcuauuuccacuaucuuucucauucuuuugguuuuugcugugacacacuugauucuuaauuuacucaucacagauuauaacauacaugauagaauaggaaggaauauuggaaaugagaggaaaauuacaugcucuacaauuuagaaaaggguauuuuaagaauguuugagaagaauaggguaggauugagucucugaaagugacuuagcauauuaaaagggagggaaaauauagucauuucaauggaagagaaguagagaaaaagagcaaaugaauaaaaaaaaauguuuaaaagaaaagggaaaaaaggaagcagagagaugggaagauaagauucucaagauagggaauggugacagcaaaguccauagacaucaaugaaucuaacuucaguaucccacuuacuaccacacaagaaauauaggcaauugggaguuaaauaccuauuaaaauaguagcagcaguaggcuuaaaucccaauauucuugaccuuuuaauacaagauucucuacacaaaaaaaagcugugagaaaacaccguaagaagauagaacaucaguacagaagugaauaaacagugcccuucaguuuauuuuuguaaaucacuguugacaauuucagugaacuggauuugauaccucaggauugaauauacagauuuaucugaaacucuugacuucacugacauaagaauugaggcucacuguuuuuaaacuucucagagacaguggaguuuugaguuuauuuuuuaaauguuuucccaaaaguugucugaaugaugaaaagcagggccuaauuuaguuaaauuguuaucauaauaaauauggugguucaaaaaauguuagucaaaacucugugaugguagaccuauaggaggagugguuuuauaauuaauggcacauauuagauacaagugauuuuacaggcaagaggccuuaaagaaaauucccaauagauaagagcaaaauccuuccuuugagaggauaauuuacaccuccuagacugaugauaauuucugaaacagaaauuaaaaaacugaaucuccaucaguuuuaaauaaaaauuuuacacuaacuaguuacauauuuuaggacuuuuaaccuucaauuuaaaagcaucaugccaucaaaaagcauguaaugauagcauuucacagugauagucauaauauaaaacuucaagcuguuuuuauauauuauucaaugguuuacuuuauaauguuauacauuuauuucugucucuuauguaaacaggacuuuuguggaaauugaaauaaauaucuacgcaaauuagaauaagggacaauugugucuuucauaguaagaaagcaccuauuucuucuggucacauggcccuccauagaaaagggagcuuucucugacaucacaauauaguugaguagccacauguaccuguauaacaagucucauugguuuucuugcuuguuuuuaauauuucaguaauacaaugauauugauucagaagugucuuauagaaaggaauuuacuuuuuuuuuaaaccgaucacuuaacauuuuaacucauaaaacuauuuuaggaauguguuuugguuagggaguccauuaaauuacaaacuauaggaaaucaucuccauaaauagcaagccauuuuuuuauccuuaaucaauucugcuugaguugucagaaaacaaaaacaacaaaaaauauuuuuaaauagugaccuuuaucacaaauugagaacacuaacuuuauuuucaaggcaaaauauauuuuugcuuccagcaaagagccacuggaaaaaaaucaacagccacaaaaaaaaauccuguuuauaccauauguuuaagugauagcaaagaaugaaaggcaguuaauucucuccuacuauuuacuuauuuccccucaauagauaaggauagucagcaauccugcuugaguagcauacaauuaaagguuaagcuuucuccuugggagacugugaugcguaggcaacuacagucuuugacaucagccauaagcacacuucuauuuuagcgaugugagaauaguaaguuguaauuguauaaugcuauuuauugaucuuucuagaaagaaacaaaaacauguuugcuuuggguuuuuaaaucccuggccaggugcccuaaaggaaguauauugugaauuaaagaaguacauuucaaaacaauaccuauuacuauuugaauacauaacaauuuuaaauaucuuguaaugcuccaugcauucuauuuguauagaaauagcugugacacaaaaaaaugucagcugucaaagacguaauacaacaucucaggaauaauuggugguaugauuuuaaaagcccagaaaguugcaguagacacuucuaggcugaugaagaucucacuuaggaaaacuacuuaugcauuuccugcuaacugagcagaaaaugcucuccuuggaaaagaaccacuguguaaaugucuucuaauauauuaaaaaagaugaaaugauuauuagcacacaggcuauauuuguaaccauaugccagauuuaaacaacaacaacaacaaaacccuguaauccacgaugauuuaagagaucaggaagaaaaugaaaguauaauuaggguaaguuuagguuuuauuuauuaaaaaaaggcauuuuauuagcaauucucauauaaaauccacaauuauacagaaaguagcuauauuauuaucuauacugaaauuaucugaguucuuaugagaaagauaucgagaaagcauauugaaggguuugucauuucaaguuucuuagaguuuuuggcuagaaaaaaauggcaaacacaacacguccucaguuaacauugucaauagguucuuagaaacugugacuuaagcaaaacaacguauaaaaauaccaugcuuuuucucaacauuauaagaaaaugauguugagcaaaaugauguuauucaaggaccugcuguauguccuuuugcuuaaugucacaguuuccaagaaccuaucaaugauguuaacuaaggacuuaccauguaacauuccuacgauaaaaguugacaaguuuaauggguauacuugauguuucauaaguauaccugauaaaauauuuuacuuuaaacacuuauucuuucauuacucaguuaaaaaacacauauaagaaagaaaguuauauaaauauaugauuuauauacuauuuauauaaaacuuuaaaaauuaaaacaauagacagaaauuuauggaaaaauaaauaugugguaaaauagauacauaugaggaagaagggaggaaaauagguuagcguuauauauaugaagcuucaaaugucuuuuauguaauuuuuuucuaaagagaucuaaaaaugucaaaauaguaauaacaauaaaccuaauuagauugcauuuucccccacauuauucucuacuguuuuuaaauauuauaugucuuuugaaaaagaaaaacagugagguaaaugcucaauuuuacuaaauccaguaaaaaacuuucaggagauauauuuccaauucaaagaguuuagacuuucaaaaugaguccugaguuaaaugccuucaucaaaaauauaggaagaucacaaaucuacaaccuaaugccacaauucuaacaguucuauauguuauaacuauauuuacacuaaaagugugagcaagacagaaaggaaaacaacagcaguaaguguaaaaauuauuugagacaaaaauucuaucaguaucagaaauaacaauuguaagagucaguucccuuccauuacagauggauagguuuuauuucaucacccaaaguucuguguggaacauuuauucaaauaucuagaaucguguacaugaaauuucggaagggagaaguaaagagaggcuggauaaucuuucugaagaacugaagcauuguaggguucacugaauucccucuguaaauuuaacuaaugaguauuuaacuagcauacuuguuuacaccagugcuucuugucucuggaagaauaucugcugaccccauuaucucgaucacacaguauuugccuucucaauaucugugucacuguaucacaucacauauacauugagugacuuuucugguuugggcuauuuuuguuuauuuguuuguucaaauuauuauaagauggucagcacuuucugggcccugaagcauauauuagucagaguucuccagagaaacagaaccaaaaaguuguguguguauauauauauauauauauauagugagauuuauuuuaaggaaugggcucaugcaguugcggaggcuggaaguccagagugcagggcaggccagcaggcuggagacccaggaaagagugacaguuugaauccaaaggcaggcugcuggcagaauucucucuucuuccauggaggucagauuucuucuacuaaaaccuccaacugacuggaugagacucacccauacuauagagggucaucugcuuuacuguaagucuacuuauaaaugcuaaucucaucuauaccuucacagaaacaucuagagaaaugcuuuauuaaacacuuggguaucuugacauagccaggcuugauacaugaaauuagccaucacaaguaaauacauauuucaauuacaacagaauaaaauuuuggguagacaagauguauguauacacauuuuuaggcacagaaaacucaaaguuuaaagaaagguaauagaaaggaaaggagagaauauacuaauugacauagguaaucaacugaaaccuaagacucuggaaagcaacauaauaagacguuuguauuucuuuacucaugcaguaguacuuuucacuccaaaguuguccaacuaaauauugaagguagauugcaaacaaagugguuauggaugguuugcauauugccagacauuuuucacuauauuaauuauguuacgcuaguauauaauacacuucaggauguuaaggucuuaguggauauaucauguggacuuuggcauauguauuuguauauuaaauuauuuauaacaauuauaugacuuacauauuugaauauugauuuauuuaaaacacguuuccauuuuuauacuugcaucacaaugaucuucauacuucuuacaaccuauaaauuuuaaguuacuguuuuaccucuuuugcuaugaguuaaaaauaguguacuguauuaaauuaaguaauguaugcaugaugacaauuuuuuaaauacaaaauguuucaaagauaacuuuucaucaggcauuugcuuaaaaaauaaugauacugaaauaaaaagugcuucaguucuaaaaccaaguuugagaccauaggacuuaaaccaacuugcauucaucuccuguugugggaucauuaccugcucagagcauggaagaaugaagucucuaccuacauucuuuaaggacauuuuauuuauauuucugccguaacccuuaucacauggacuuuuuuucuuagauauuuuccgaauagauuuugaacucugacaccuuuaaauuuccaaaacacuggacacagcaguuuuuacauguagcaacuucuuaauaaauguugggugagugaauagagcaauaagaaaaaugacaauuaucuuuaucugcuacuacccauguuccauaaacaaguaaaaauuaagauugcuauaugaaacccagaagugauuuaaucuagaauuuuaaauuuguuguuuguuccugucacgaaccuauuauaaagggaauuuuaacaaacaaaugaaacagaauacaaaacaaacacaaaaaaugguggagccuggcacccuaggccaccccuugugagguugcuucucaagggacuccaugugccacugugacuccuaaaagcaguuuaaaauuuaccauuaaagacuaaucccuaaauugugcagauaagguuccugaggaugaaaauauuuauaugaaaugacaaaggucacagacuuaaauauuuauaugaaaucgccaaggucacagacuuaauuaaguggcugaacccaggccuagaacuaggaucaucugauucacagucucuuuuuguucucaccgugccuaucauagagacuaauuauuuuugcaaaauuuagcuucccuauuuauuuuuggaauaaaaucaaagaaaauuuaagguacaaaacauuucauucuuauuuuagaauaaaaaagacaugaccauuuuucagccaggagaacuuuucagcauaguucaaacguaucaguuguguugaaagaaaaguccuucaugcuauucuaaaugcacaauucaugacugauuuaaucacuucccuuuaugucauaaacucuuacugaaaaauaacuucacuuauucuaggugcugaaauuauuugcaaaaaaauuuacaauggcagaaauuauuuuucauuucaaagcacugaaaauuuguaguagagaaauuucuuuaagggggaaggugcaagagugcuacacaaauccuugcaaacagacaggcauagauucaucacaauuacauucugaagacacuuucucuuuguucucugcuugugaugcuuucgugccuuuucucuuggaggcaaaugccacauuuuuaaaaaaaaggucucagcugaagauuguuaucaaucuugaauucacaagcuacacauauaauguuccugucccauaggugaugcuguacaauuacuuguggaaugcaacuuuaaauaaauuauaaugaguaaguuauugcuaaauuauacccuuccucaggaugagacaucccuuaaucaagucagcuaaauacuuaaguccgacuuguguauguagaugaagccuacaucuuucgaugcgcauaaaagaaauauauuuuucuucucauauauuuauucauucauucuauacauauuuacucuguauaauuacuaugcaagguacuaagccaaaugacucagagauaaacuuugccuucaaguuccuuacaaucuaacacauaaacauaaauaauucaauggaaaaugugaaaagugcuauaaaaacagcauaacuaauguaucacaggaauucuuugaugagaagacagugauuuuucauauggguaaggaaaaggcacagaguuuaagccaauugaacuugguuuuaaagaacagucaaaaacugaggugauagaggauaguaaaaauagagaacaaaaaauuacaaacagaaaaaauaaagugaccaaaaaagugaccucaagguaagaaaaccuagaauaucuagaaacuauaacaagaagcucaugccaguuguaaggaaugucgaaaauaagccuagaagauaaguuggagacagaaauauacacauacacauauaaauaaaugugugugagaguguguguaaagagaaagauaaauauuuaagaauuuuaggcacaaauauuucauaacauaccuguuauuuaagaagaaaaaugcacgugugucuaagguacacaagaaagggauacaggaagcaggaugacuaguaguuguuaucauaacauaguuaaguuguuaucauagcaugccaggaagaaguaaggagaaauggaaccuguguucccuacuaauauacaguagcuuguauauugcuguaauuuacauauugcuuauuauuccaaacauaaggcauaacugucauaucauauagaucccaaaagugauacauagauuagaucuuuuuagauuagaucuuuuguuuuaaagccacaccucacacauaucuuuucuuuuucauuauguagguugguauugagaccuuuuccccugaguucugcauccucuacacuaccuaguguauucagugaacaccaacacuguagguuugaauuuaguagaaaaagagacuuccuaaucaccaaacuugacuagucucucacguaucaagucuuacuuuuaaaauagauuuuaaacuuauauauaaaccauucaauauuuuuuuccgugcagaauuggcuguuauugucaaauuucucaugggagugcauuuucccauucuacuagagccacaagauccuaaaggaauaauggaagaaaauuuaguuccuaauauauauuguauaauaguucauauaagccucuuaugugaguuuauuuuacauuauuuauaauuuuccccuacucauuuccaaaaaugcuagagggauuuuuuuuuuucugggaaagcugccaaaaaaguucauuuuauugcuuccauugagaaauaccuuuagcacuuuagagagaaagcuuuucacugaaauauaauuuagcaacuuggaaagaugggagaaaguucuaaauuuuugacauaucguccaccaacugauauaacccguuuccaaauauaugaaauaagcaaccuacauaaaagauacaaucuuugcaaacugcucauuuaaaaaaugcaacaaguggcagcaguuugucuuuuguaaaagagaaaaaucacuguaauuaaucaaucaaaucgcaggcagcaauaagaucauacaauuuacuauugcauucuaguaucaaagugugaccuaaacuuuauuaggcacugccccuccacaagcauaacaaaauucaucucagguguauucuugaguuacaugaggaugcauuuagaaacucuuccccucucucgugccucacugcccaccacuccgguacugcuuuccaaacccuaccuagacacaauggucucccucauuuccuugagcacaugcuccucuccauuucagagcauucuuccauguuucuauuccugcucaccagaacgcucuuccugugcgguuucccucucgcucacaccucauucuucugacaucugcuccaguaccacuuccucaaggaccucuccccaggcccaacacuagguucacguuauauccucuccugaugguguacuucuccuucucacauucuucccaguuguaauucacauaauugauacucuggugggucguuugggguauacagaguauuagaaaauaagauuuucucugaauauaagaauccuggaauauaaguuucacaagaacacggaaaugucucuguuguccacccggcacuuaguaacugaguaguauuuuggccacaaaccucaaaaaauacuugcucaauagaugcauuaaaacauuacuccaaaugaaaaauaaauaaaauuagaaguauccuuuuuauuucacauaaauucuagugccuuucaaagauaugggcucuauuaggauuuuucuauuuuaaaguaguuuuaaugaauagaaauuuacagcggugcuauauaaaaguagcacuaauuuucauuccauaaucaugaaguuguaaaacauuuacagcuagacauacaguagaaucuuaaccaaguaggaaaacaguuuaaaaucaaccucuuagaaauaauuuuuuuuaaauacucuaguuugguuuuaucugaguuuuugggacaacauaauaugugaauaaucggaaaguaauccagagacauugcaggggugcagauuuuucuuuuuuucuuuugagacggagucucgcucugucccccaggcuggagugcaguggugcgaucucggcucaaugcaagcucugccuccuggguucgcgccauucuccugccucagccuccagaauagcugggacuacaggcgccugccaacacgcccggcuaauauuuuguauuuuugguagaggcgggguuucaccguguuagccaggauggucuggaucuccugaccucgugaucugccgaucucggccucccaaagugcugggauuacaggcgugagccaccagggaugcagauuugaugggaauguuccaugccauauagcaaccacuguguuuguauauacauagcauucaccuaacauuuuucagagguuaauaaauguauuaauuuuaguuauauuuaugcuucauuugaucaauaaaacuguauuuauauggagaaucacaagauuuuuaaaguugaaaaaauuuauauaaggaaacuuguaagauacuagccaaauuuauccuuaugcauaaugcucauuuucauauaguuaaguacuuuucucuguauucuuugcugaucagguaaugaauaauuaauagaauuugaagccagguguccaauaaguggaaaaaacauacaaaucuaauuauuuugucauuguuuuaaugugggaaagaaaaacacauuuaugacuuagacacucaaauuuuguaaguaauagcagagaaaacaaugugucauuauuauuuauauuucucuaaaaaaguaaauuaucuauaugucauguacuauuaugacauaguacuguuuauuuaaacacuaagaggcauuuuuggagaaaucuaauuauguuuuggcuguggccaaagugugcaugcugugguuuagugcacacauauuugcaaucauauucaguuuuguaauauugucuuugagccauaaucacuauuuugauuucaguaagaaagaaacagucaguggucuuaaguuuuuaaggacaguauaauuuagcuuuauuaaguuauacauuauauuuaaaaaaucucaaacauagcuuaaauguuuucuacuuguaaaaaaaaucaaucaauauuugagaggaaaauuaaaagguaagccguaaaauuuaauuucuggaugauaaaagccuuucacaaacacuagguaacucucuucaacaaugugcacuccuagguaauauuacgcaucuuuuuauguccucuaauauaguacauggaaauuuuaaaacauaaaugaaagaaauccaugucuuuacaaauaacuuuauaugcauaagaguaacacaacgaauauguuucaacauguacauuaaaaaucauuuggugcaauaaauauacaucgguuuuugauacuuauguaugcauauauguauaugaauacauauacauaugugaauauacauacgugaggccauacucuguaugaacccauucucugcuaaugacugagcaagauagcauuagcaagacagguccauuucuaaaagauguaauacuccucugacaggcaacuuuggcacaaugacucccuguuggccuggccaaaauauuuuaaaaacuaugcuucauccaagauucugucaguccaacucuccuuccuucucuccccuccuuucccagggaucagaacugcuucaauguuugaugguucuuccugccuccuuuauuucccucuccuucuucuuucacaggcauuuucccaauaaaucucuugcaugauaaauucugacaugguauuugcucuuuagaggacaugauuuaaugcauguauacacccccacacacacacccacacaaaugccacauauucauaaguagaaaaucauacauaaguuacauggauacauagacuaacaaaugcauaaguguaugcacacacacacacacacacacaccugucagucuaucucuauguaucauauauagaaacauacauauauauauaugguaaauauauauauaugguaaaaaaauauauaugguaaauauauauauaugguaaauauauauauaugguaaacauauauuauauauacauguaucauauauauuugcuaucuacucaugaacgggcagguaacaauucacaaacuauuauuaaguacuuccaaauacaaguucucacaaauuguuauuauauguauuagucucacuuucaugcuuaaaauagcacagaaaacuucauaaaaaacuuacauuaaaaaccuaaagagggccgggcaccuuggcucaccccuguauucccagcaauuugagaggccaaaguggguggaucaccugaggucaggaguucaagaccagccuggccagucauggccaacauggugaaaccccaucucuacuaagaauacaaaaaucagcagggugcaguggcaugccuguaaucccagcuacucaggaggcugaggcaggagaauugcuugaacuuaggaggcagagguuacagugagccaagaucgugccacugcacuccagccugugugaccaagugagacucugucuaaaaaaaaaaaaaaaaaucuaaacagauuuacccuugcuaaauuugcuaaccaaagcaugacagaaaggcaauguugacauuaauaauagagaacauuuccauauauacuauaaagaacauuuauguggcauaauauuauuuuuauuaaaacuuucacuguuagggcaucuguguucaauagccaaguauauaaugguagcuuuccacaaugauguaugccaugacacugcuuuaccugucuuuuacacuuauacauccuuggcuuuuugcaauccugaauggauaauaaauuaaaugaugaaugaauggaugacuauguagugauucaacaaugccagcagagucucacauucauagaaaaacaugguuuacaguggagaaagccaaaucacaagacagccuaauccuggauuuguuuuagugcuuaucuggcuauauuacaaacaucuuaucuugugacccucccaaagucuaauuuucuaggcucaauuugagaugaauacuuaggcucuuuugauauuuggacaauacaggauuauuuugugaacauacccuucugccuaauuuuccugaauuauugcucaauguuuucuuaaucugaauguuccaaauugucaaugugucauaauuuaagccugaaaccaaagaugaacuccacaaugaagcacucaugcauaucauuggugaaauggguuuccuuucuuuguagcacucaaaggauuugcuucuacuucuauuaugaguuuaucaaauucuauauauuaaaauaauuuauuacuucuacccugagcacauucauuaaaaugugggaagugauuguaccucauugaaauucuauuguaugcguguaucugcauguuguaagugauuuauauacuauaaaaaaauguaaaugccuaguggucaaauaauuuuucuuacucuguuuuaucuuucaaaauauuggcuucagcuauucugucuucauucccuuagaugaauccuuucuaaauugagcgugauucuagacaaauuaugaugauuuaauuaauaucacuaauauuuagaauuaccggcuuucauguuccacccagaauucaucagucugauucaaacacguauucuccaauuaucugugggcacuguacucagaaccaauguacauucuuucuuugucagcuccacggucaggcuagucucuucaguucaaguucuacucucuaauucccauaaauaagaacuuauaauuaaaggccuggggcagaaccuaagugaauuauggugcuugacaacugcaaaagugcauugcauugaaaggugcugaauauauuuguuaaauaacauuucuuuaugagugaacugaauagaaacaacuauuuguuuuguauggucacuauaauaaauuuaaauuaaauuuauuuuaauuuaaauuuauuuaaauauuauuuuauuuuuauuuuauuugaauauuuauuuaaacuuauuuaaaaauuaaauuuauuuaaauuuauuaaaauaaauauuuaaaaauuaaauuaaauuaaaauuuauuuuuaaauuuaaauuuauuaacacacuuuuacacauaaaaacuugauugacacagaucaacauaaagaaagagagagauuuaaaggagguuauucagaaaaguaccauuaagaauauugaaaagugaugauaucauaugaguagaaaaaucaagugaaaaaaaauagucucauugugcuaaaacuaugccaucaaagcccaccucauaacaaauacaauuuaaaauaaaacacaaagugaagcugaaaaaacagagaauggagcacaacaaagaacaggagaauacaacucaaugagcacuguaaaucaaugaacuuacacuggucuaucucugaagaugaaugagauaaaaauggaccuuuuuugccuucauugauuuuuacuguucauugaguuggauuucucuguuccuucgaggucuuaucauuugauuucuacuucuuuuucaaccccuaagcaagacuuuuggcaauccuaaaggcauuaugaggacaugcuuaaugccucacugcauucuacuucaggaaauucaucuauucauucuacuauuauaaauucugcaccuauuauacaucaggcacaagauagguacaccagaagaugaaaauaugacauuauuauaauaucacacuauuauugauaaaauuuuuguuuuuaaugacuaaaacuacuuuauuuuccaacaugaucagagcuaaacuuuugcuucuaaggaacagugaccaaacuuagcaaaguugaaaacaaagcugaaauuacuuuucauaucugacauauuugauacccaugauagaauauuaaaacgcugaaucaagaugaauuauguuuuacaugcucuuacugugagccaagauccuaauuuucuuuuaaucuaauugcuuucucugaaauucaaagccagcuuugauggaauugcuuugauaaaggugcuuuuccagaaggagccaacuuuucucacugacuaaauuacucauacuaaccucuggugcucuaaagccaugacuuaaaaauuaaauauaaugguaggaaagaguuaaugaagcuucuagagauuccugacuguucugaaauauaaaugaauuuggcuuaaguguuauauauauauauauauauauauauauauauauaucaguaagaaaagauagacauauuugauuauauuacaaguaaaaacuugaguauaauuaguaaaauuaagaauaaauaugaauauuuuugcaguuaugacagaguuauuauuauaugaagaguguauacaaaugaucacaaaauacugaaguuccuauuuuccaaaaagacauauuuuagaggagaaaggcaaauguauuucccacacauggaaaaaaauuuucaacucaucuccacuaauacaauaauuuguauuucacauggaucugaccaugaaauauuauuuucaacuaucauauuuuauacaaacuauaaaagaugagcuccaaauucaaggaaaaaguaaggcuguguacuggauguuucccuaucuugcuggcagcacuguaaguuauggaaaucaacuuugcauuacaaaacaaaaacuuaaaaauguugagucucuuuaauaaucccacuucugaaaaauuauccuaaggaaauaauccaaauaugguaaaaccuuagugacauggagaucuaaagcaguccuauauguaggagcaaaacccaagaguaagccauauauaauguauaauuaugggagaaauagcuaacuaaaucauguuacccaauaaaauauugcacgauaauuucuaguuauauuuaugagaaauagguaauaauguagaaaauaucauaauaaaauauuaguuguggagagggauuaucuauuacaugagcaauaugacuauaauaaucuuuauaaauaaauaucaaggaugaaaaccugaggcuccagaauacuggaagugauugugaggaauaaugagauugaaauugauuuuuauguauuaguuccuuuaaaacauguuccuguuaauuaaaauguuuuaauaaaauauuuaaauguguuuaugcuuuuuacccaaauauaucuuacauaauuuuuaccucauuuauuugauuuuaauaauugaaauuuuuggaauuuuucaugaauuccuaaaaauaaaauuuucauaaauuccauaaaauuaaauuauuaaaaucaaauaaauguaguaaaaaaugucucuuccauuuauguaaauguuuauuuuuuuagauguugaucuuaauauggauuuaguacuuguguacuauuuuccuaacugggcuaguuacuuaauuuguauauaauuugguagggaugugaugaaaaaauuuacuuuaaaaaucaauacuacucgggcuggguaugguggcucaugccuguaauuccagcacuuugggaggccgaaguaggaggaucacuugagguuaggaguucaagaccagccuggccaagauagugaaaccccaucucuacuaaaaguuagaugggcaugguggcauguaccuauagucccggcuauucaggaggcugagacaggagaaucacuugaacccgagagguagagguugcagugagccgagaugguaccacugcacuccagccuaggcagccugggugacagagugagacugucucaaaauacauacauacauacauacauacauacauacauacauacauacauacauaaaauaaaaaucaauacuacuacucuacagaaaagcuuuacccaagcaugucuuugcacuggucauuucauguaaguuuacuugaucaugaggucuuauguuagaaaugccuuauuauuugacuaguuuucaacauaagugauauguuuguuuuuguuuauuuguuuaaagcacuucagcuagucagcaaggguucagaauauuugaauuuuugauccuccuccaccccaaauuucugcuuugaaauucuaacccauaaggugaugguauuaggagguggggccuuuggaagguuauuaggucacaagggcagagcccucaucacuggaauuaguccuuuuauaaaagagaacucagaauguuagcuugcuucuuccaacaugagcagacacagcuagaagguacugucugugaaccaaaggacaagcccucaccagauuuggaaucugcaagcacugugauuuuggacuucucagcauccaaaacugugaaaaauaaauuucuguuguuuauaagcuaucgaguuuaugauauuuuguucuagcagcccaaguggacuaagauaagaaguuaaguacuguaagagccagcuauucauaaagcaaagauaggaaaauaauagaacugugugggcugguggaaaaggcaacuacuacuugguuugggaaauaaaucuaaagggacucuagugugacucagagcacuugacacccuucagcuguuuuucacuuacauagaugcacacaaucugcccuuagaaggucugccaauaguuugccuugggagguguuaccauagccauuucugaagauaauuuuaucuuccuuuuccucuaaggggucuuaacccuuuauuucauuggacuaguuuuuuucacuuauagaaggaaaccauauaaacaaagcaaaucuauuuuugaggucuugagguaauguauuaucacauaaauacaaacuggaauauauuuuaucuaaaguuauuuuugcaaacccaaugcauuacuaucugcaaucuuauuuaugguuguuuuaaaauauuaaaguaauaucacaguuauaaaaguacuuuuaaagaggauaaaaauacauagaaucauaggauucugaguaagguaaucuaauuuaguguuucugaacccuugcugacuagcugaagugcuuuaaacaaacaaaaucaucaggcuuuauagcagaucuguuggacagaauccaaaaagggauggugcaggagcaaaucaaggaauugguguuacuucgaagguuaucagguaaaacuugagaacuucugcuguuaaucauucaugcagagcagauauucuuugcaugauauucucugcauuucacccaagugguccaccaaucuaugcaagguguugcaauagaacaggcuguagacuuagaaguaacucuauguaaguucuccaugagucaaguaaauauacaaaauguaguggagcuagagccacuggauaguaacuaaggagaccucaaaaacaaguuccaacaguguguacagcuugggguucacucuaauggaggcuagcuagcuuggauucagauugaaucucccauaucagagaacuuuacaauagguccucuaaagaauccaugaaugagccucauaggagagccacacagaagucugcaaagcagagaaagcaaauaaaugauaguauuaguaaauguugaauaaagauacacuuaacacuuucugcucucucuucucugaccuaacauacuggagcaacuauauaucaaagagaaagaagagacauuuaucucagagucagaccuugugguaguucuuugccacuccaauuuguuagggucucaauuuggguaccaagaagagguaagaacauacaauuuaaaucaaauaugggauaaagccagguguggaggcucaggccuguaaucccagcacuuugggaaguugagguggccugaucacuugaggucaggaguucgagaucauccuggccaacauagugaaaccccgucucuacuaaaaauacaaaaauuagacagggcauggugacguaacccuguagucccagcuacuccagagcuugaggcaugagaaucgcuugaacccgggaagcagagguugcagugagccgaaaucagugccacugcacuccagccugggcuacagagggagacucugucucaaaacaaacaaacaaaaaauaugagauaagaguuuuauacugauuuuaguaacaaaacauuagaaaaaauuaaaaauguguucacagugacauuaaagcaugggaaaugauuaacaauagcagagcuaaaaauguuaauuggaaaaaguuuagaauuacgcacuaaccaagguaagauuauucaauaaauaaauuacaacauagaaaugcagccuaccuaagauagaauuuguuauuuggggaaccacaccacgauggggcuagucuguaucauaaucccuuagaccucuucccauggcuuguuccuaaaucagcucucuccuaugcucuacuuguuucauggguuauuggauucaaggguagcaccuuacauuuaucccugccauauuuauuguuggauuuccaccauugcuccuuuugaauaccaaaacugucauuuuacauaucacuuuuuaaaacacucuuucagcuguauacaacaugaaaguuuaauaaaaucuccuucaauaucuccauggcugaaaaagauuucaaacaaauaauauaaacuucaggcaaaagccuugaaccuucacuggaaggcaucauccuucacuuuuauaugcugauaugguacuugaagggugaaggcaaagauugucaggaaugaugcaucucaauuguuuagcagcacgacauugugauuauaaaacuaauucuagggcaagagagucugggacucaaauuacccaucugcuacuugcuagacuaauuuuacucaucaauacaagggcaaaaaucaaaucaucuacuuuguagcacuguuaacaagaucaaaugaguuaagagaugugaaauaauuugaagaguaucuagcacauaauaagccuuauauaaauauuaaauauuuuuacuagaugaugagugaucaugacucgcuaaaguccagauacaugaugucugcuacaguugccuaauacccaaaauccuuucacaaacaaacaaacaaauauggcauacgugacaaaacuugugauuuguuaagccaauaauuucucauagauuugucugaaaaaaaagucuucacuuuuugagaaaauauuuaccuauuuguuuaaauaccaaaagugauaccaaaaauguaucaauccuccaaaaauauguaagggcaaaaauaaacaucuaaguaaacccacuguccacaugugcuaaauuuuuaggauauauucuggcauuugucauuuauuauguugcagcagagacuucuguacggauauuuaaaaagagaagacaaacgcccccuuuuuacauuauauccauaguacgaaaugucaggccucugagcccaagccaagccauugcaaccccugugacuugcaccuauacucccagauggccuaaaguaacugaagaaucacaaaagaagugaauaugcccugccccaccuuaacugaugacauuccaccacaaaagaaguguaaauggccaguccuugccuuaagugaugacauuaccuugugaaaguccuuuuccuggcucauccuggcgccaaaagcacccccacugagcaccuugugacccccacuccugcccgccagagaacaaacccccuuugacuguaauuuucguuuaccuacccaaauccuauaaaacggccccacccuuaucucccuucacugacucucuuuacggacucagccugccugcacccaggugaaauaagcagaugugucgcucacacaaagccuguuugguggucucuucacacagacgcgcaugaauuuuggugccaugacucggaucgggggaccucccuugggagaucaauccccuguccuccuguucuuugcuccgugagaaagauccaccuaugaccucagguccucagacugaccagcccaaggaacaucucaccaauuuuaaaucaguuaagcggccucuucugacucucuucuccaaucucucucacugucccucaaccacuuucuccuuuccacucuucaaucucucccaucucuuaauuucaauuccuuccauuuucugggagagacaaaggagauacauuuuaucuguggacccaaaacucuggugccggucacagacuggaaaggcagccuucccuugguguuuaaucauugcagggacgccucucugauuauucaacccacguuucaaaggugucauaccacgcagggacgccugccuugguccuucacccuuagcggcaaguccugcuuuucuggggaaggggcaaguaccccaaccccuucucuccuugucucuaccccuucucagcuuuuccgggcacagggcaaguacuccaaccccuucuccuucacucuuagcggcaagucccgcuuuucuagaggagaggcaaguaccccaaccucguaucucugugccccaaucacuuauuuccacgucccgaccucuuaucucugugccccaaccccuuuucccacuuuucuggaagguaagaacccccaaaccccuucccuccguuucucuacucucucuuuucucuaggcuuccuuccuucacuaugggcaaccuuccacccuccauuccuccuucuacucccuuggccuguguucucaaaaacuuaaaaccaauucaacucacaccugaccuaaaaccuaaaugccuuauuuucuucugcaaugccacuugaccccaauacaaacuccacaguaguuccaaauagccagaaaauggcacuuugaauuuuuccauccugcaagaucuaaauaauucuugucauaaaauaggcaaacggucugaggugccugacguccaggcauucuuuuacacaucagucccuuccuagucucugugcccagugcaacucgucccaaaucuuccuucuuucccuccugccuguccccucaguaccaaccccaagccucgcugagucuuucuaaucuuccuuuucuacagacccaucugaccucucccuuccuccccaggcugcuccucgccaggccgagcuaggucccaauucuuccucagccuccgcuccuccacccuauaaucuuuuuaucaccuccccuccucacaccugguccggcuuacaguuuccuuccaugacuagcccucccccuccugcccaacaauuuacucuuaaaaagguggcuggagcuaaaggcauagucaagguuaaugcuccuuuuucuuuaucccaaaucagauagcguuuaggcucuuuuucaucaaauauaaaaauccagcccaguucaugacuuguuugccagcaaccgagacacuuuacagcccuagacccuaaaaggucaaaaggccaucuuauucucaauauacauuuuauuacccaaucugcucccaacauuaaauaaaacuccaacaauuaaauuccggcccucaaaccccacaacaggauuuaauuaaccucgccuucaagguguacaauaauagaaaaaaguugcaauuccuugccuccacugugagacaaaccccagccacaucuccagcacacaagaacuuccaaacgccugaaccgcagcggccaggcguuccuccagaaccuccuccccaaggagcuugcuacacuugccggaaaucuggccaccgggccaaggaaugcccgcagcccggaauuccuccuaagccgugucccaucuguguaggaccccacugaaaaucggacuguucaacucaccugggagccacucucagagccccuggaacucuggcgcaaggcugucugacuccuucccagaucuucucggcuuagcggcugaaaacuaacaccgcccgaucgccucggaagcccccuagaccaucacggacgccaagcuucagguaacucucacaguggaagguaagcccguccccuucuuaaucaauauggaggcacccacuccacauuaccuucuuuucaagggccuguuucccuugccuccauaacuguuguggguauugacggccaggcuucuaaaccucuuacaacuccccaacucuggugccaacuuagacaauacucuuuuaagcacuccuuuuuaguuauccccaccugcccaguucccuuauuaggcugagacacuuuaacuaaauuaucugcuucccugacuauuccuggacuacagcuguaucucauugccucccuucuucccaauccaaagccuccuuugcguccuccucuuguauccccccaccuuaacccacaaguauaagauaccucuacucccuccuuggcgaccgaucaugcaccccuuaccaucucauuaaaaccuaaucacccuuaccccacucaaugccaauaucccaucccucagcacgcuuuaaaaagauuaaagccuguuaucacucgccugcuacagcauggccuuucaaagccuauaaacucuccuuacaauucccccauuuuaccuguccuaaaaccagacgagccuuacaaguuagcucaggaucugcgccuuaucaacaaaauuguuuugccuauccaccccguggugccaaacccauauacucuccuauccucaauaccugccucuacuauccauuauucuguucuauaucucaaacaugcuuucuuuacuauuccuuugccccuuaaucccagccucucuucgcuuucacuuggacugacccugacacccaucaagcuccacaaauuaccuaggcuguacugcugcaaagcuucacagacagcccccauuacuucaaucaagcccaaauuucuuccucaucuguuaccuaucucggcauaauucucauaaaaacacacgugcucucccugccaaucuuguccgaccgaucucucaaacccaaacaccuucuauaaaacaacaacuccuuuccuuccuaggcaugguuagugcggucagaauucuuacacaagagccaggaccgcacccuguagccuuucuguccaaacaacuugaccuuacuguuuuagccuagcccucaugucugcaugcagcggcugccgcugcuuuaauacuuuuagaggcccucaaaaucacaaacuaugcucaacucacucucuacaguucucauaacuuccaaaaucuauuuucuuccucauaccugauucauauacuuucugcuucccggcuccuucagcuauacucacucuuuauugagucucccacaauuaccguuguuccuggcccagacuucagccucccacauuauuccugauaccacacuugacccccauaacuguaucucucugauccaccugacauucaccccauuuccccaaauuuccuucuuuccuguuccucacccugaucacgcuugauuuauugauggcgguuccaccaggccuaaucaccacacaccagcaaaggcagguuaugcuauaguacaagccacuagcccgccucucagaaccuccauuuccuuuccaucguggaaaucuauccucaaggaaauaacuucucaguguuccaucugcuauucuacuacuccucagggauuauucaggcccccucccuucccuacacaucaagcucgaggauuugccccacccaggacuggcaaauuagcuuuacucaacaugcccugagucagauaacugaaauaccucuuagucuagguagacacuuucacuggauagguagaggccuuuccuacagggucugagaaggccaccgcagucauuucuucccuucugucagacauaauuccucaguuuagccuucccaccucaauacagucugauaauagaccagccuuuauuagucaaaucagccaagcaguuuuucaggcucuuaguauucagugaaaccuuuauaucccuuaagguccuccgucuucaagaaaaguagaacggacuaaaggucuuuuaaaaacacaccucaccaagcucagccaccaacuuaaaaaggacuggacaauacuuuuaccacuuucguuucucagaauucaggccuguccucggaaugcuacaggguacagcccauuuaagcuccuguacagaugcuccuuuuuauuaggccccagucucauuugacaccagaccaacuuagacugugcccccaaaaaacuugucaucccuacuaucuucugucuagucauacuccuauucaccguucucaacuacucauacaugcccugcucuuguuuacacugccgguuuacacuguuucuccaagccaucacagcugauaucuccuggugcuauccccaaacugccacucuuaacucuugaaguaaauaaauaaucuuugcuggcaggacuaugcugaaucuccuuaggcacucucucaucagauguccugagucaucccaauucuuaaaccuuuuaugccuguuuuucuccuucuguuauuccauuuaguuuuucaauucgcacaaaaccguauccaggccaucaccaaucauucuauacgacaaauguuucuucuuacauccccacaauaucaccccuuaccacaagaccucccuucagcuuaaucucucccacucuagguucccacgccgccccuaaucccgcuugaagcagcccugagaaacaucgcccauucucucuccauaccacccccuaaaaauuuucaccaccccaacacuuuaacauuauuuuguuuuauuuuucuuauuaauauaagaaggcgggaaugucaggccucugagcccaagccaagccauugcaaccccugugacuugcacauauacgcccagauggccugaaguaacugaagaaucacaaaagaagugaauaugcccugccccaccuuaacugaugauauuccaccacaaaagaaguguaaauggccgguccuugccuuaagugaugacauuaccuugugaaaguccuuuuccuggcucauccuggcucaaaaagcacccccacugagcaacuugcaacccccacuccugcccgccagagaacaagcccccuuugacuguaauuuuccuuuaccuacccaaauccuguaaaacggccccacccuuaucucccuucgcugacucucuuuucggacucagcccaccugcccccaggugaaauaaacagccauguugcucacacaaauccuguuugguggucucuucacagggacgcgcaugaaaugcaagacaccaguguuggagagaaggcaggauauacuguaacuaucucacagugcuggcaauaaucuagaaaaccaaauguugauauuguuucaugggauauuacaugaauagaugcacaggggacauugguaaaagaauaagcauucauguaucuacagauuuucuucuugaggguuauaucagaucaaagaagagaauucaaaaauacaacuuucuccuagaacgacugggauucuucaguuaaaagaagacacuaguuaaauagauuccaugguagccaacgaagaguugggaaaaacagcacgaacaugugcccauggcuaaaauacuaguauagaaacacacacacacacacacacacacacacacagaagguaaacugccaaaugaauauuauuuuauaaaaauuaauagaauccuuacaguauaaugccaauauugacuuuagaugccucaucacauauacacuauuaaauaaaaacaaagaaaaugacaagaaaauugguguuagauauuaagauaaaggacagggauuaugggagcacaaaaaaaaauaugcgauaagaugauaaucaaucauugcaucugaguauaugugcuccgagauuccuggcagccuauuuuucuuuuaaugacaaauacaucauacugucccucugcuuucuuuuuuuaaaguaagcuuugugugacauaguugguuuaguguuuagaagcacaaaccagcagauaaauuguauccugauauuaagaggaaaaaaaaaggugagauauucaugaaauuuauuggcauacauuuuuauguuauuucuggcauauguacguauaaaauaacuacaauaccaacgauggaaagucauaaauagucuuaggaaauacuuaacagccuuaaauacucuuggagauuauuuauuguggcacacuaagcccagcuaaaguccaaugaauaaaaucagaaaaaugaacuuuaaaaaaugcauguaaucuuggcucaagaaaaaaaugcuaguaaaaagaguucaaagaaagacuguauggaucugaaacuaauacugagauauaaaucauuuuaauaagcaacaaaacaucuaagcaauuuuguuuucuuuagguauuaauucuuaaaguggugguuuaccuugagccgaagcaauccaauuuauuggagccucaauauccacaaguugccauguagauguaauauagaaagaaggaaguauuaaauguguuuucaugucugaguaauaccuucuguauauugauuuuguuagugaaaccuuugagguuaaacagaaaaggacauaugaauaaucaaauaucagcauauuaaagacguugauuccagaaccacucaaacauuuaauaauaguccuuuaagcagucagcugggcccaguagcucacgccuguaaucccagcacuuuggaaggccaaggcaggcagaucacuugaggccaggaguuugagaccagccuggggaacaaggcaaaacccugucuacaaaaauuagcugggcuauuugaggcaugccuguaaucccagcuucaugggaggccaagacaugagaaucgcuugaaccugggugggggagguugcaaugagccaaaauugugccacugcacuccaggcugggcuacagggcgagaaucugucucaaaacaaaaacuaaaaauaagcauuccuagagaaauauaaaugaaucauuuuuuuuccaaucauucgucggugaaaugcuagucauagcccaaguucagugcaccgaauauuuauuuugaauuuaaagaaucuuacaauuuaaaguaaaauuucucuuuaauugguauaagacccacaugauucaaauacgaacaucuuagucaauuauagacacauaacuuauaaauuaacuagaaucuguccuucaaaauuuacucacauuuuaagaauuuauacauuuguuugaguuguuuaaaaauuguuauagccaaaucuacagcuaaaucaaacuugcuaauauauuuuauacuauuguauuuaguacauaaagcauucauuaccuauuauuucauaugauaaacauuauacacauaauuuuaaauaaauaugccacuuauuggcccaacagacauuauucuuauaucauaaauaaaucauuccuuaauaaauuaugaaaguaucaggcauuuaggagauuguuuuccuuugucuucaauauuaaauguauguagaaauaagucuaauaugucuaauacauauuuaacacacauuuauagcuacauauauacauucacacacacaagcaaccuaagagagauuccauaaccauuaugaugcaauguauuauucuuaauaaucuucuaguagauagcacuuguucaagacuaucuguacacuucacaguuagaaaaacaaaaugauacuuaugucaguuaaacaaauucaaaaauguaaacaaaccaaaaaaaagcugagaaaauuuaaauaguaguagcauuucauaaauaaaauaaaaucagaugcccagaaauguguacugaaaucuuuagcccuauaauaacaaauugauuauaauuuaauauugaaaaugggaaaaugucaagacuuuuuuuauugccacaucuuuaguauuuugagaaauuuuuaauucauugauauaggauucucugaauuuuugguaaggucaacauuuaguguuuucauauuuaccuaguuaaauguuuguugcccacacacaaaagguguuuuaaauaaugaugguuaccuguacacauugccauuauuuauccuccaagaauuauuaauuuaaaggaaacugagaauuuaauagaauaauuuugcgguacacuuucauagcauguaggauccaccauuaguaauauuccuuucacuaugaagacauggaauauaauccuuaauucccauuagucaacaaaacuuccuugugaagucucauaugccugcuauuaucuucucacauggcacaccaauuccagucucuaaaacuauaccaaacaaucucagauacaacaacaaaaucuaucauaagguccaaaggaaaugcaaggauaaaaagaacguagucugucaagcuacucugauaaaaucucucuaugcaauauuccugacaaauauauccuaugucuagauacuuccagugauggagaacaaaccacuucuugaggcagacaauuccagaaucaaucacagagaguucuuccucacaaugaguuagucuuccucacuacacuuucauccauggacccuaguacucuucucugcaauggcauggaaaaccuaaaguacauuuuauaugaaagcucggaaaguucuuguagaaaauagugaaaagcuuuucuucucuaggcucaacaugcuagcaccuucaaucagucaucguauguugugauucacauagucucacucugguuuauuguauuccagacagggucucauuccagacagacucaaguaggguaugacauaaaugaagaagggaacuauuaucuacucuguucuagacagaugaauacucaugacacuuguagcacauucuuccacuguaaaaggcacaucuaucuucuucacaucucccccaucaucuccauggauacugcuuccaguuaaguuugacccuuucuguuuugaauaguuacauuuuacuauuuucugucauaaacuccuucgaucacaaagcuacacucagguugaaauaauuuacauacccuauaaggaaauuugugaaaugucccaaggaucuuaucaacccugauaaugaaaacacaaauccgguuugguggcccaggaacagaaagaaaccucuaggaaaacugcagauggggugcccacuuacauagggcucaguaaauauuaaaaaugaagagguacauaauccuguguaaaugaaacauagaagauauacugcuaucauaaagacauaauaaucuuggauauaaauaugcauuuuccuacucuauuuagccuucauaguauaaaaguaagaauacuaacauuugaauuguugaauuccauucccaugugaucaacgacagcaaguaaucuucuauuuuuaaauauucgaauuuucuacagcauuauagggauuaaggggugcuaaauuuucauaugagcauuuucucacauauccaguaggaaauacaguugacuucagagagaccuaucaaauuauaucuaucuaucuauauauuauauuaauuucccuuuuggaaaaauuuguauuauuagaaaaugcuuuauuuaauuugcuauucauuuuucaaauauauuagaaguuauuuaaaccaccaaaacugauauaugugaaaauuaaauaauauaaaauuacccuaucucuauucuauuuaauugaccuccaaaggaggucaggauagcuucaaauuaagcuguuguccuuucuaggcucucuauuuuugaccuaaauauaugacaccuauaaucucauuuggauuaucuuuuaaguccuguggucugacuuuaacugacauuagaauuuaccauaggcgcaaggaaaacagcagaauuccgaaugcauuguuagguuauguuuaacgccauuuaagagaacauuguuucagaaauaaaaaagcuacuucaaaucccaaauauacacauacuccuugauccagucagugaggaaaugccucuguuacacucuacaaacuuauaaaauugcuuuggcuggaccaucuuuugcuguguggccaucagagacuacacgcaaaaaaaacaguccaugaaaaccacuguggaaucgccugaaaggauguugcugagaauaauuguauuaugucacacagugucuggaauagccgcuccacuuggaaaauuucuacucugauauuacuacugaagaaaacugagaacaacguauuaucucaaagaauaacugguuguuuuaaauuuacggacaucgugaauuguguaacaauuuugacguggguuuauagaaaacugaaaguuaaauccaugaucccacuguguaaaguauaugauaugcauuauuggccucauucuagguucuucuuuuuuauuuauucuuauuucuguucuugcuugcucucuuuuaauuuucauuaaauauguguauguuaucuuuuaaggaaggugacaaacuaauuacugauuugauaaauuaaaauaugauuuuaggaaagguagguagagcaagauggcugaauagaacccuucaguauucauccuccccacaggaacaccuaucuacauaagaaagcaccuccauaagauacaaaaaucaggugaucaaucacaguaccugguuguaacauuauauugaggacagaggcacugaaggggguggaaagacagucuugaauugcuaaugccaccccuccccaacuccccagcagcagguggggagagaaucugugugcuugcaaugauugugggacuuggcauuggaacucagugugucuguuccagcagaaagcaacacagggcaaaauucagcuggcacccacagaggaagcacuuagaugagaccuagccagaggggaaucauccaucccagcagucggaaccuaaguucuggcaagcaccgccauugcaggcuaaagcacucuggcaaccuacauaaacuugaaaggcggucuaggccgcaaggacugcaauuccugagcacagcuuagugcugugcugggcccagagccaguggacuugagguguacaugacauagugaggcacugccuugggugacugagggaguccuugugucacccucccccaaccccaugcaguacagcuugcagcucugggagagucuccuuccuucuacuugaagagaggauaggggagaguaaacaggauuucgucuuggaacuuggauaccagcucagccacauuugaauaggacaccaggcagaguccagaggcccccaucccaggucccagcgccuggaugauacuucuagacacacccugaacaaaaaggaaagcugcuacuccuaagggaaggaccguuuuuggaaggauucaucaccagcugaauaaagagcccuugggcuuugaguaaacaucagcagaugaaggcaauacucauugcaggccuugggggagaccuaguacccugcuggcuucaggugugacccagcacauucccagcugcgguggcuauggggaaaggcuccuucuguuugaggaaagaagagggaagaguaaaggggacuuuauauugaagcuugaguagcagcucagccacaguuguguagaguacuaagcaggcucaugggguuccugauuccaggccuuagcuacugaauggcauuucuggacuugcacugugccacaggggagcccacuucagugaagagagagacucaggccugacaguguuuacuacaagcugacugaagagcacugggccuugagugaacaucagcaguagccaaguaguaccccacaggccuggaguagugguggccaugaggaaagacuccuccugcuugaagaaaggagaggaaagagugggaaagccauugucuuucagguuggcugucaguucagaagcagcagaauaaagcaccaaguagauuccuaagguuugugacucaggccuugguccccaaacggcauuucuggacccacccugggccagcuggaacucccuacccugaaggaaaggacaccagccugcauggauucaccaccugcuaacuaaagaacccuugggccuuaaaugaccaucaguaguagccaggcaguggucgccaugggccuuaggagagacccaauacuguguuggcuuuagguaugacccagagcaguccuaguggugguggccacaaagaugcuugugucacuccuccccuagcuccaggcaaaucagcaugaaaagagagacucugcuuguugaggggaaaguaagggaaaagaacaagauuccccgccugguaaaccaggcaguucaccuggauuucauucaagaccaccaaagugguaucucuacaagugugcaagagucacagcauuacugggcuugggguucccccaaugcagacacaauuacagugaugaccaaagacuuagauuauaacaugcaauucuauuugacuauuuggaaagccuuuuccagaagaauggguacaaacaagcauaaacugugaacacuacaauaaauaccuaacucuucaaugcccagaaaucagugaacauccacgagcaucaagaguaaaacaugacuucaccaaaugaacuaaauaaggcaucagaaaccaaucugggggagacagagaauucaaacuggcuguuuugaggaagcuaaaugaaauucaagauaacauagagacggaaagucuuuuuuucuggaaagucuuucuuauucauguuugaaggauauuacacuguuauuaaaaaaaaaaaaaaagacacgucaaacaauaaauaaauaaaacuacaggccaauaucccuguugaacacugaugcaaaaauccucaauaaaauacuaguaaauucaacaauauauuaaaaaaucauuuaucaugaccaaauggguuuaucccagagaugcaaggaugauucaacauuugcaaaucgaugugauacaucauauaaacagaaugaagggcaaaaucaauaugaucauuucaauagaugccuaaaaaguguuugauaaaauucaacaucccuucaugacaaaaaccaucaaaaaacuggggauagauaaaauauacugcaauacaauacaagccauauaugacaaauccacagcuaguaucaaauugaaugagaaaaaucuaaagcccuuccuuuaagaucuggaauaugacaaggaugcccacuuucaccacuuguauucaacauuguacuggaagugcuagcuagagcaaucagacaagagaaauauauaaagggucauccaaauucuaaggaauuaguuaaauuauccucguuuucagcuuauaugaucucauauuuggaaaaaccuaaugaguccacaagaaaacuauuagaacugauaaacaaauucaguaaaguugcaagacaaaaaagucaacauacaaaauucagcagcauauguauauaccaacagcaaacaaucugaaaaaggaaucaagaaaguaaucccauuuacaacagcuacaaauaaaauaaaauaacagagaauaaacuuaaccaaagaagugaaagaucuguacaaggaaaacuguaaaacauugaugcaaguaacugaagaagacacaaaaaacggagauauucaauguucauggauuagaaguaucaauauuguuuaaaaguccauacuacccaaacuaauccauauauucaaugcaaucccuaucaauauaccaaugacauucaucagagaaauagaaaaaauaauccugaaauguauagagaaucacaagacacaggauagcuaaagcuauccuaagcaaaaagagaaaaacuuuaaaaaucacaucaccugacuuuaaauaauacuacagagcuauuguaacuggaacagcaugguacuggcauaaaaacagacacauggaccaauagaacagaauagagaaccaagaaccaaaacaaauccauacaucuacagugaacucauuuucaacaaagaugccaaaaauauacuuuggagaaaagaaauucucuucaauaaauggugcugggaaaacuagauauucauaugcagaaaaaugaaacuaccccuaucucucaccacauacaaaaauaaaaccaaaauggauugaaggauuaaaucuaagaccucaaccucugaaauuaccacaagaaaacaugggggaaacuuuccacgacauuggucugugcaaaaauuuauugaguaauaccccacaagcacagacaaccaaagcaagaaugaacaaauuugaucacaucaaguuaaaaagcaucugcacagaaaaggauacaaucaaaaaagugaagagacaacucacacaaugggagaaaauauuugcaaacuaucaaucugacaagagauuaauaaccagauauauaaggaguucagacaacucuauaggaaaaaaucuaauaaucugauuuaaaaaacuaggcaaaagaucugaauagacauuucucaaaagaagauauacaaacaacaaacagguacaugaaaaggugcuccauaucauugaucaucaaggaaaugcaaaucaacacuacaaugaucuaucaucucccuccaauuaaaauggcuuauauccaaaagacaggcaauaaugaaugcuggcgaggguguggagaacacagaaugcuuguacacuucugcuggggacuaaauuacauuaguacagccacuauagagagcaauuuagagguuccucauaaaacuaaaaauagacuaccauaugaucuagcaaucucacugcuggauuccuuuccaaaagaaaggaaauuaguauaucaaagagauaucugcacucuuauauuuauuguaacacuauucacaauagccaagauuuggaagcaaccuaagcucuucaucaacagaugaaaggacaaagaaaaugcaguacacauacagaaugggguacuauucgggcauaaaagagaauuaaguucuugucauuugcaaugacauggauggaaugaaaggacauuacauuaagugaaauaagccaggcgcagaaagacaaaguucacauguucucacucaugugagaucuaaaacuuaaaacaauugaacuuaugaagacagaaaauagaauauuuacaagaggcugggauauuggauauuugaaugaaauaauggacacugcauuuacccugaugugcuuauuaugcauuguaggcuugcaucgaaauaucucaugcaccccaucaauguauacaccuucauucucagcagauuaacacaagaacagaaaaccaaacacagcauguucucauucauaagugggaguugaacaaugagaacauggacacaggaagaggaauaucacacacuggggccugucgggggguggagguaagggagggauagcauuagaagaaauagcuaauguauaugacggguugauggguacagcaaaccaccauggcacauguauaccuaaguaacaaaccugcacguucugcacauguaucccagaacuuaaaguauaauuuaaaaaaaauguuuguggaacauguauauaaauaaauucauaauguuuucaaaaaaauguacacaccuacugugcaugcauaaaaauaaaaaauacuaguuuaacuaucauggaaguggcauaauaaaauaaacauuaaaagauaggaaauguaggucuuagcuucacaaaaugucucugacauccauguguuuaauuucuaaaauaugguaaauaaaauguaaguuaguuuacuuacauguucuuauuagcaaaaaacauaauaguuauaacuuaauacucaaagcaaaauguucaauaaaaagaaaauuaugauaaaugcuaucucuucuuaauaucacagggaaagaauauacgggaauauaccaauuguccacaaggaaaaaauaaaccuguuauaguucuauucucuuuuguuuuccuuacugaaaauuuagaaacuguaacaggauuaccgaaggaaauaucagaaguuaagagagaaaaaagaaaacaaaagaauaagaauuaaagaugaauuucuuacaaugccuccaguaaauucuuuagaaacuugaaaaauaaaugccaaacaaaauguuuuucaaaacuauuauuauuauuauuauuauuacuuugugaggagucucguucuguugcccaggcuggagugcaguggcgugaucucagcucacugcaagcuccgccucccggguucaugccauucuccugccucagccuccugaguaacuaggacuacaggcaccccucaccacgcccggcuaauuuuuuguauuuuuaguagagacgggauuucaccguguuagccaggauggucuugaucuccugaccucaugauccgcccgccucagccucccaaagugcugggauuacaggcaugagccaccgugccuggcccaaaacuauuauuuuuauuagcauuaaucaaauauugaaaacaaaauaauucuaaucuccaaagaagcacagaguagauuguuucccuagcaauagcuugauuuuugguaagucuuucgaauauuuucuauuuuucaauuagaguagaaaacacaacaaaaacuuugcauucauuaagauaagaaaaucuauaaaacuuauuuacaauaaaacuuuguacuguguugggcuuauuauauucauuuaauuaaacuuaaccaacugaaaccaagauaacuuggucuauucgcucuauuuguuaacauuuuguugcuauuuugauaaaauguucuaguugcuaccuuuuaaaaagucaucuccuuaucaugaucucuuuauuuacauuuucuuaaaaauugaauuuuccaucuacaauuauaauaaggcaaaauagaaggucuagggaccauucauuguacuagcuuuuccuaguauauuuuucuauauaacaucugagauggacugaaaauacagcauuuaacaacaagaaaacaguuuuuuaucaauaauguggguugcaauuuaguccauaacucaacaaaccuauguuuguaugcuaucuuuuucauuuucauggggcuguuuaucccaaccccuucauuuauucauucauucauucaucaaaauauauuugucauacguuuuagggaacauaauagaucaagaaugucgucuaaauacugauaaggucccauaauuggaacccacuaaagccaaacccaauaugaaagaauacaagauuaacuaauacaagaaugaaaauguauguauuauuuggagcauccuucugauauuuugagccggaucagaguauaggaaguuaguaagacauuaagccaaaaauagaacaaacacauaaaagccugaauucaaguccacuauuuaauaauucaaugugaucugaguuccuaguaggugagauugaagggaaaugacauuaacccagugauuuugauaccauuggucaaaaaccuguguccugacacuaacacacauagguaugcucacccuccuccauuuuaaaacaugagcccuuggauggcucaccuacuaaauaugauuuucaugucagauaaucuaggaagguuucuucuaggaggugaccuuaugcuuuuugcauuucuaggguuuauauaguaauaaaagagagagaaggucccuucagguccaugaacaaaugcuuguaucaguggaaagaaaaggugaaaaaaauguaugugauaauuucacauaauauauaauaaacaguuuuucaacaaaucaaaggaaagauauuugcucuuguucuuugugauuguauuuccaaaggggaagcauuucauacuguugcucuucauauacuugaguaucuacagaaccucacuuaagcaguaucuucuggauuuagaugaagcuaucauuucuguguaucugaagguugcacuauguuuguaauuccuuguuuuagcauuaauacugauugcugcugucauuuaaaauggacagacuagaucagguagacaucuacaauuauugguuauucccaacuguguuacauuauuuaucacauccuuaagcaaagcauauaccuuuucuacccugaauaccauuuuccugcuuuagcucaucacaugaaaguucuuuguauaucauguuaccauauauuccguggaccaagaaguccuaggaauuuguguuauucuagguauuucaguauugguggucagagaaugacccaaggucuuauuauuaguuauaguuucauuaaaugugacauaacuuuggacauaugaaacugaucaaauaucugagaaaacuacaugccagagauguaugaaguacaaguuaccauagaaagccugaacuguguguuugaaucauaaaguauucauugcauuguacuaugcauacagcaguugcucagguguccaagugagauguuaaagagaaagaaaguaggugggauuagguuaucuuucagaggcuaaggaagagagagcuauagaaagcuaaagaagauagaggauaauuuuccugauuaaaaaauacaaauaauaauaacaccuaauacauauugaguaguuacagauuggucaaugcuuuaaauauauuaauuugcauaaccaccuuguaaguuaguuggcauuuuucaucucuuucauaaauuauuaaaugaagguacagagaaguugauuacuuuaucuuaaaucacacagcugggacauaauggugccagaauuuaaacuaggcaaucuaacuacagucuauuuuggcacuucaguaaugccugcccaauccaugugggaaaguaggcaguugccuagacagaauaagcuacacaaacauacuacagaagagguggucagaaguaaaacacuauauaauauggauuaccuuauuuugcuacuauguguccuaaacagcacccuuuucaaccuugagaagaaaucaucguuucaugaaauauccagcuaaaguauaaaaguucaagcaaguaaaauauugugaugcaaguuaaaauuucacuuuguggugaucagucgcuagcuaacacuuguuuucuuguuuuuauuccauuguguuuuugugcuuguguuugacauuuuuuggcagucuuguuaauuaagcagaaguuaucccugauuaauguaguaugagcuguuccuaaaguacuauaaauaaugcagugauuaauugccauaucuaaacgagccacccuuuagcacacuucaaagauggauuuucuugguuguauuugcugucgucuacuuaauaaugauacucauguggaaaaaaaucaucuuccuuacuucucuuucuacagaaaauuguauuuaaacuauuugaaauaauucuuuuggcuugguagucaagaaaauucaucuuauaauuauuauaauaaccuaaaagauucugcugaauucaacacaauuaaaaauuuaacugccuuaaaaauguuuaauaacaauacaagacuuaauuuuaacauuugaaauauaauuuagauagucaugagaacuauguuuuuuccauucauuaaauuauuuuauccuaguaaauacuuaauaaugauuauuagcuccucugguuacaagcaacuuuugaauuuuuguuuaaucagaggaguauaaaaaguaguauuuuuuguuguuaggacugcuguuguaaauagacaauuuuuauugaaauaucagaagaaacuagaagcuuguccuugugguuuuuuuuuuucaguucaaaagccuauuauuacccuauagaaauagugagaaauauuguuaaauugacucacuuauugauguugagauuuuuauuucucauauucauuacacugaggguuuuguaaauuuuaguucuuuuauagauguuuuauaguuauuccuaacuaccacauguugguggcuuaugugucauuguucauaaaauauuacuuccaguuuaucacuguagucaucaucaugagcauuucuugacuaccaaaauauuucucacucccaaaaguuuggaacuuaauuuaaaaauccaauuuauuuuauccaaaggaguuggucauccugucauaucaacuacgaucacagggaacuuggaguauuguccaguuguaaguuuaacaucccaaggaauauagaaaaauauaauacaugguaucauauguuucccacauaugaacaggaagagaaagaaguacagguccuuugaagaaagaauaacucuuuccuuugcaauaauuaucaaacuccuaguugagagaauuuuguggaagauuaccugaaauaaaugaaguuuaucuuggaucaagacagacuacuagagaauuaagaacuuguauaaaacugcuugggucccuguaggacuguuuuuauugaauuucauuucaguaacauaaugucacaagaauuccaaauaucacuugccauacuauguaauaucaucucagacaauucaaaggaaauugguuuaacacuacuugaagagcauagaagcccagagccuucgcaaauauuuucagagcaauucuuccuuuuccauuucucuuuuuuauuuuuuaauuuaugaauauuauaaaucuucuaacaauuugacuaauuguguugcuccucuuguuuuggacacugcaaaaaaaucugcagcucaucuucaucaucauuucuuuuuaauacaccugugcuaacuuacuuucggcuacaaaauuuaacuacccugguucucucuugcacccaacuacccucuguuugcauuuuauucuggagugccaaaaguauuauugaacaucagcucaaaucuguugugaaggaaaauaggauauaaaucagguuaugcauaagaagcauuacucccuccagguaagcauaugccauaagaauguaacaacacuucucuuauuaaguuguacacaaucuuugccacaagaauaucacuucucuucacuuuuuaaacucuauaccaucuuccccacugauuuucuaguaucgugucccuaaacacauuauggacuugaauaacuacaaaauguacaccucaauauccaucucuccucgcuucaccucaauuccuuucuuuguaacugccuaaucaacacaaaaucucuaacuucuaauagaaaauaauuuaucuccuaaacucacugguguuccauucuuacucaucucugcaaauacugccaaaacucacuuauuugcuaaaaaaauuaggaugauccuuaacuccauuugcuuuuuuaacaauggucuauuagcuagucuuacuauauagcucuaccuacaagguagauucaggauauauuucuuucuaccacaucagcuagauucccaguuugagcuaucauuuuucauguagacuccauuuuucucgcguuggcucgcuagaaucuacucucuacaaagauggcaggauuugucccaucuucauagccuacaccauaagacugagguguuuuaaaacccaaagggagggauugaaacugccuuugcaaaauuaugacugagacaguaaaagagaucuaaccuaacaggcucuaucuuguucuccaagcuguccuuguucauuccugggcguaugcugaacuaacuuuggggggaacuuaguuuauaguuuaaaacaaagaugguaacaguucuuucccaaaacaaaucucuuucuugccuggggacuagacugcuuuugcgggacuaacaaauuagccacaagauuagaaauuaugguuuaggaguaaugcagcuggaggcuacaagauucugacccucccugaacugcuugcuagaucagugcuugagauauuuugcagaccuugcacuugauggauuagcuggcaccacccagauggguuaacuggcuccucugaucuuguggcccccacccaggaacagacucaacacaagaggacagcuucaauucccugugauuucaucuccuaccuaacuaauuaacaccgcuggcucacuggcuuccccuuccccaccaaguuguccuuaaaaucucugauuccugaaugcuuggggagacugauuugaguaauaauaaaacucuggucucccacaaaaauaaaauaaaauaaaauguaaauucaaacuugucucaucucugcuuaaaacucuccaguggacuccuaucauacacuguccaaacucauuucaugccuauaauguucucuuugaacgaaucccuggaaaggucucuaaaucugcuccuagaacucuccauuucacucauucaacuuuagacacacuacccggcucuuccaaaaaucaccaagcuuuuucccaccugcugccuacccucugccaguacugaucuguuuuagguagcugaaagauucacauuacaucacugaggucucuaaggcucauuugcauuuccuuagaugagucuuccucauccaccuuacucaaaaagggaagccucaucucauccuccacucaugcugcuccaaggcaucauucuccauuccuuucucugcuuaauuauuuuuccugaacuuccacugcuugacauuaaauaaaauauuuauuauuuucugacucuaccacuagaauguaacugcaagaagcgaggaacuuuuucugucuuuucaccacugaaucccaagcaucccuugcagauuugaacuauuggcucucuaauaguuaagcuauuaacuauacuacccaguguucuuuucuuuguauaguucuggauuagaguugaacagaaaaggaacuugugcaagauuugggauaggaaagugaagcagugggcauuacucucuaaaccuacaucagacacagagagugacugaaacagagcgcccagcaaacucuagcuuguuuuuacucucuucugcuuugugucuaauucuuauucucaucuauuaguccuguuugaauaacagcagccuuggacccacuaccagacucuuagcagugggccuacagcagauagaucuuacagggucaaaagcuucuaacugacuuuucuacaaacuuucauuugcagucccacuucagcaaccaaaugugcuuggguucucagcauucucaugccaaaggugacagugcuuugggaagacugacuggugaucuuuucucaaacuuucuccuuuuuccaucuguauuuccucagcuccucccacaauuguauaaggucuaauuccuauaacacauccauuguuccacuguacugaauucaaguaccagauauauagaaugaacucagcagguauuuacuaaauuaauaaauauaaaacaguccguacagaucuuaacacauacagagcacucaacaaacaaauaauuuaaauaaccaugauuaauaaauauaaauaaaauuaauaaaagauaaagcucucagagcugaucauguaaaaggugcagcauuuggaaacuagccauaugaaaaaguaaaugauggaacugaaaaaaacaaaaagaacuguucucauuuaccuuuuaaguuguguaguaacugacagagaauuuacauuaaaaaaaacuucagugugagggccaggcagcuuggcucaugccuauaaucccagaacuuuuggaagcugaggcaggcagaucacuugaggcuaggaguuugagaucagccuggacaacacgugaaaacacuaucucuucugaaaauacaaaaauuagcugggcaugauggcacgugccuguaaucccagcuacucaggaugcugaggcauaagaaucacuugaacccagaagguggauguugcagugagcugagaucacaccacuacacuccagccugggcuacagagagacacucugucucaaacaaaacaaaacaaaacaaaaaacauuucagugugggugauguccaugucugcuucaucuauuugaaaaguuaucauuugaaauugguaauugauuuuuguauugauguauuaugugaaggacagacuagggauugaaauuaggagaagacaaaucaaauaugaaaacaaaccuuguaaacaacaaaaauaugauuugucuuauaacacaagcaugugcucucccuuuuauuauauuuaaaauaugcuaauaaauggucuucagugauaaacagacuccuguacuaggcuggagcuuagauaggauaaucauaaaauuguaaucaaguuauuugauucuauaaauuuaaaaauaguuucuaugugcaucauaacaccauauuagguguuaaaacuuacuauuuaaaaguuuaugguaauaauuuccagacaaaugcaauaaauacauaaauggaucaauccaauuaaguuuauauuauaguuuaguauuauacaugcucucuagcaaagcuauagcaaagaauugacaagagugaauuuguagucacagcagaauucuccaaagggaaauaaauuuuccagugauacauuuugugaaaccaauuuuuuaaaagaagugcuaaaaucccuucacugcaaacaacucuauaauccccaauaauaagcuauaugucaagacuauauauuuguucuaauucaugcugaaaauaucauacuuuauaauaaugacuaagaaacuuugaugaaauuucauuuuuauauuuucagagaacaacagcguaaaauuugaaauauuuaaguaaauaaaauagguauauuuuccaauuuucagaguauauuuucugaugauuacuauugacuauauaaauaaccacugaaauaaauguccuagaauuuuucuagugaaucauuuuuuccucaaguuacagcaccuaaauaaguguuaguucuuagagauggguuuuuaagguaaaaaggaaggaagaaggugauuuugaaauuuccugcuaucuuuuuccucucaagcuuugcucauucucuucccuuuucuaacuuuuacucaacuuuaagaagcaguuaaagaaauaucucuuccaaaaaguuauuucccacuugaaccugcccaaucaccuaacaagaccagaaacacgagauaugacuucaaucuggcuucuuaccauuuucuaaaaucacaaauauaauguucauguuguuuaaauuuauuugacguauuuuauccgucaucuuaauuuaccagaacugacacucaguugugauuagaugcucagucuuaggcuauucaccuaccucucgauucuaucccaaggcagucucauccauauccacagcuucaauuacuucuagaggcagauuacucauuuccugagcuacauguaagaguuuuaggagguuuaaaucacauucccuuucccucauaaguuaaaagccaauuaagagacagucacaggagaaagauaaauggaagacugaaguguaagcuuuauuacugguagacugauuagaguacaguuuaucucugugaccaaaaugagcuuucaacauacucuaccugaaaaugacaaacuugucuacauuuuaacaagcaagaaggauaauucaaaaucuaucccacuauagcagaggcaaauuaagcuuuuaagcuuucuggaaauauguagaaauaccccaaaccuucaaaagaaagagacgagagaaaggaaagagagggagagagauaugaguacaacauuaaccuccaaauuauuaaccagauaauuuuuccaucuucacuggagagcacugaguaagaaguaaaaauaaaggccaacauguuauuauuauuauuuuuugaagcucuucucuauagaaauaugaggccagagaaauggagauuucuuacuaacaggaccuacuaaacaugucauuuaugguaucuaaacaaacauuaaccuaauguccuuuuuagggggguguggaaggaggagacccaaacuugaugaaugauaucauuaucauuuaauuaagcuagccagaaaccuagauuuuguccuugacaucuuucccgccucuaucuuuuuacucauuuguuagcaauucaucucuacuuugucucauauuuaaaucucugaucugccuccaauucuuucuguccaugccaccauuaucuuguccuugcccacucaucuacuucuaucaccauuagcccucucuaaucuuuccucuacacuacagccaguguaacauuuuaaaaucccaaaugcaaucaggucacaauuccaccacucccaccccauccuugucuugacgcuugguguuuguucccuuuacagagcuaaggucuucaauggucugcuccuuaucugccacucagccucauuuugcaguguauuccauuucagucuuuccaugagccauuuuggccaucucccagcucacuggauucaccaaacccauuccagccauagaguguggggacaugcucauugcucucauuuauacucauucuucagauuucaacucagucacugcuucuucagagaagcauguaugaacaccaaaucuaccucagacucuuccaugguacaacauaguagcuccauguauugauccuuuucuucauguauaacuguauuagucucuucucacacugcuaauaaaaacauacacacgacugaguaauuuauaaaagagguuuaauggacucauaguuccacauggcuggggaguccucacaaucauggcagaaggcaaaggaugagcaaagucacaucuuacauaguggcaggcaacagagccugcacaggggaaaucccauuuauaaaaccgucagaucgcaugagacuuauucacuaccacgagaacagcaugggaaaggcuugcccucaugauucaauuacuuccuacuggguccgucccaugacaugugggaauuauuacaauucaaggugagaucuggguggggacacagagccaaaccauaucaauaacuauuaugauuuuauauuuuuuguuaaucauuugauuaacauccaccuccucacauuauacugcaaccuccacaauggcauguaauaugauaauuucugaacacuauuauauauagugcuuaguacauaccugguacuuuuuaaaaauguugaauagcgaugauauugugccuuuaccuuuuuguuacaauuaauuacucuacuggagcguuaguuccucaggggguaauugcuuuauauuuucccuaucugaauccuuaugagccuuaugagcuaaucacaucuucaagaccucaucucacaacacuguugcacugagaauuaaguuuccaacacaugaauuuuggggaacauagucaaaccauaacaauugucuuugggauuacuuuucagaguauuuugcucucauuuuauuuucauagcccuucuaaauucuccguuacuuauauuuauaccuaggacuuuaaaagucaaaucugaaauguguucuuuauggaagcaugauuauuguguauuauuuucccauuuucaaaaacaaaaauuuauuuuuauuaacuauuacauugccaauauaaacuugcagacaauuauuuuugcaccuucuuugagcauuaaaauuacauauauuugaaaacacugaugaaagaagucauagacgacacaaaugaaaacaucucaugcucauggauggguagaaucacuauuguaaaaaugacuauauugccaaaaggaaacuacaaauucaauguaauucccauuaaaauacaauaauaauuccucagaaaacuagaaaaaaaauccuaaaauuuauaugcagccaaaaaauaccaugcauagcuaaagcaagacuaagcaaaaagaacaaauccagaggcaucacauuacccaacgucaaacuauacuacaagcuauaguuaccaaaacagcaugguacugguauaaaaauaggcaccuagaccaauggaacagaauggagaacgcagaaauaaagccaaauauuuacagccaacugaccuucaacaaagcaaacaaaaacaugaaguggcaaaaggacacccuauucaacaaaugaugcugggauaauugacaaaccacauguaggagaauagagcuggauccucauuucucaacuuauacauaaauaaacucaauauggaucacaaacuuaaaucuaagaccugaaauuuuaaaaauucuagaagauaacaucagaaaagcucuucuagacauuggcuuaggcaaagagcucaugaccaagaauccaaaagccaacgcagcagaaacaaagauaaauucgggggaccuaaucaacuaaaaaguuucuguacagcaaaagaaauaauuagcagaauaaacagacaacccacagagugggagaaaauauuugcaaacuaugcauccgacaaaggacgaauauccagaaucuacaagaaacucaaacaaaucagcaagaaaaacuaaauaaucccaucaaaaagugggaaaaugacaugagcagaugauucucaaaagaagauauacaaauagccaacaaacauaugaaaaaaauuguuccucacuaaucaucaggaaaauguaaauuaaaaccgcaaugagauaccaacuuuuuccugcaagaauggccauaaguaaaaauuaaaaaauaaacagauauuggcguggauguggugaaaagagaacacuuuuaaacugcuggugggaauguaaacuaguacaaccaccauggaaaacuguauggagauuccuuaaagaacuaaaaguagaacuaucauuugauccagcaagcccacgacugaguaucuaccuggaggaaaagaagucacuauaugaaaaagacacuugcacaugcauguuuacagcagcacaauucacgauugcaaagauaugaaaccagacuaugaccaucaaccaaugagugaauaaagaaaaugugauauauauauauauauauauauauauauauauauauauauacacacauacacacacacacacacacacacauacaugcgcaugcacacacacauacacacgccauggaauacuacucagccauaaaauggaaugaaauagugacauuugcagcacccuggauggagcuggagaccauuauucuaagugaaguaacucagaaauggaaaaccaaacaucauauguucucacuuauaagcaagagcuaagguaugaggaugcuaaaccuaaagaaugauauaauggucuuuggguacuugggaggaacugugggaggagggugaggaauaaaagacuacacagguacaguguacacugcuuggguaaucagugcaccaaaaucucagaaaccaccacuaaagaacuuuuccaugcaaccaaacaccaccuguucucccaaaacuauuaaaauaauaauaauaaaaauaaacaaaauuuuaaaaaucuauauuuguuguagaguuuaauguaauuaucucuacagaagauaauacauauaaaaguaaucugucagugguaaauuaugguaagaauaugaauuauugcuaauauuaucaacaauuucuguuaagauauaucaguaauuauucaugaaaauaaaauauuagaugaaaauuuuacaagauaaaauuugcuuuuuauuuuuaagaaguuaugaaauacuuaauguuauggguuuaagaugacaauuuaucuuguucuuuuucaaaaacaaaauaauaauaauaaggcagggugaaaagcaugcucugacuaccguaacaucuugucuaguauaucuagauaccaacaugaaugaaaacuuucauggaauaaugaagcgagacaaauuuccacugcaauauaaucagcuccuaagauuuuaaauucagguuuuaguuuuuauuggaaaauauaccacuuagugaggucuucugcuguauaaauggaucuaacccuauaauaaacaauaaauuuaauguuagacuaacauagucccaguagaaacuaaauauaaaaaaaccuucaugcagcauccacauguuauucuauagaauuuaugaugaaaaugacugcuggcaacaucacaguauuuaaaaggagguguuacuuucuaggcucacuguccacaaccauauguuugccuuuguaccauuuacuaggauagcucaucacugucaauggcaccaucagccagaauaaaugacuccuuuuugcuuucucuccuaaaucaaauuuagauucaauuuaguguuccaucccuuugacuaucaucugaaaaauguuaacucuauugcuucucuuuuuguuuauguaauauuaauuaugaaaacuccaaacuugcauuaauaucaccauguauucuccuuguuuccauagccagucuacugagggccacuggagacaaucacgaaaguuuugcagauuugugugcccacagauucugugcauccagccucauuuuugaagaugcacggcuaucugaacaucuuucuauauaucucuaguauguuuucucuucucacuguaagagaagaugcuuuuaacuuuuaccauucuaauaaauuguuagcuucccacuagcuauugucucagacaguaagauacaaggugcagcaagauucucaagcuaaucauuuccagucuacaaacuuacuuaugaugccaagacuuuauuauguaucaccauugucagugcaaagcugcaacuucuacuuaccaaacaauauauuauucccauuuuguuauuuucaauauuuccuuuuguucuuuuauguuaaccucauucuaaacuauuuaucuaaaguaauauucuuuaaguuguuccuacauuuaaaaaaauccucugucaaccccauauccuucucuagcacaaucuaguguguuccucuucaaaauuuguagggaucaucucucuuuucuuaaaauccauuuaucuuucaaaauacuaaaauuucuucacauuacagcagugaaauuacuaucacuaacaucaagaaugucucccagaugcauauauuuaacacaauaaacagucauuucuuuuugagauucccuuucccuuucauuuuacagaauuacaacuucucccguguuuccugcagcauuucucaucccauccuuuuggaauccuucccaaacacuuuccauauguaaacucauuaaaugauggaauuucuuaagauguagguauugcugcaaguuuaucacuuuggacaccuuucuuccuuuugauuuucuccuuauguguaaucuuucuccaguggcccacaaucuaaucuuacuacugacuuggauaguuaacuggcacucaaacucaagguguaaaucuaaacugcuaauauucuucuuccaccuucuucaucacucacauuaccaauggguauuggccuacuauuuaaguccuucuaugaaauggaucauuuuuaaaaaaaacuaacauacauaguuuaauuucaaccuaauuuauuuuaagccuguauacaaucaaugaaaauauaggaaaugcuaugacuggguaaggguagagcaaugaaaaagcuacaugccuccuaucaagaaacucacuaaggaugggaggggaugagggaugaaaaauuguuuaauggguaauauuugggugaugguuacacugaaagcccagacuucacuacuaugcaauauauccauguaauaaaacugcacuuguagcccuuaaauuuauacaaauacuaaaaaggaaacucacugaaauuuaguacaguacaauguaauaaacacaaauaugcacacauguaucugguaaagagaaauacagaggaacacuagaaguaacacaaaggaaugcucccuuggacugucaguagaaaauuucuggaagcaaugaccucugauuugugauguggaggucacauaggauguguucuagugaacaaaggagaagaagacauuugcuacaggcagaggaaaaacagguguaaacagauaaaagucugaaaugccagggugugcuuggugaccuguaagcaauucagaguuucugccuuguaaagugcaacaggguauguggaugggcuaauagaaaugcuaaguaguauggcagggaugaauaguuauuuuuauuacaaauucucagugaaugaaauuugaguguaaugaauuaaugugaaaguaggaaaaaaugagaugugcuaaacucauauaaaaugauuuguuucuaauuuuaaaauuauuuuacaugauaaaugaaaaccuuagagguuaaagaagagggaaaaauauaaaaauuacaaaucaauauuguagaaaacauuguuuucuagagaaaaauauaaauguuguccucuuauuuuucuuuccuuuguauccacacuucuaggaauaggugauucagaaaaaaaaaauauucaaagauuuuuacaauguguauugcaaagaaguaaagugacuuacuagugaaacacaaauauucuuuaaaaauaugcaauaaauaaguuggcacauagcuugguuuccaauuuagaaacaguuuuuaugucaauauggaacuguaauggaaacauguagcuuacuucuugauagaaaucagaguauaaaccaugauuacuuuucuaggcuaacucacaagagccaauugaacacacacaccacacacacacacacacacaggcacaaaaaacacgauauauaauugcaauuaaaauugaaaauaaaaauguauaguaaauagaugaugguuauuggauuagucuaggaucugaaaauaugaaggagauagaaaaagaagaaauacacucuguggccuguaaucccagcacuuugggaggccgaggcgggcggaucacaaggucaagagauagagaccauccuggcuaacacagugaaaccccguaucuacuaaaaauacaaaaaauuagccgggcgugguggcgggcgccuguagucccagcuacucgggaagcugaggcaggagaauggcgugaacccgggaggcggagcuugcagugagcugagaucgcgccacugcacuccagccugggcgacagagcgagacuccgucucaaaaacaaaaaaacaaaaaaaagaaauacacuguggguauauuucauauauauauauauauauauauacacacacacacacacacacacacacacacaugcauauauaucuauauauaaugcacaaauuuauucuuuaugucuugauacagagaggcuugagacagcauaugaaaauacaggugaaaaguuuaaaaagugaauuuauuaaaaaucaggaaaaggugguuaaauauuguaggaaaugaaagaacguuaagaauaaaguaacauauuuaguuuauacagugaagccuuguauuuugcuggagauugaucucuauuuuguaagauuucuaccagucauugcacagaaagacacauaaucuauaacauuaagguaaauaugaagcaaauaauauagucagucucacaagccuccguuucauaauauuuccacauaaaaauucuaaagguccauucuguaaaaauaauuugaggagaaguaaggugucaaaugaaagcaguucacguacauaaauaucugcugguaugguugagucaauaauaauuauuuuacuuucuaaagaaauagccaggccaauucugauauuaauaacaaguaagaacccaccacaugccagaaucugugcugacaagacauaaguugucuucuucaagugcuacauauccauaaacacuuagcuauaauccugaaauccaaaaacaugaugaaaaccaguggcugcuuuuauuguugcuguuuguuuuuuucagaaguuugacauuaaaacccuuuuauugucaaauacuguugaccugaacugaggugagacuguuuauaaucucuucuuauuccacugagagugacuauucauguguuucuuugcaaaaaaaaaaaaaaaaaaaaugcuuuugcagaccuacuuagguuguuaaauauuacaccgauauguaccacauuaccuuucuaaauauacaauuuuuucugaauucugaaaaauaucugcccccaagaguuucagauaaaggauuauuaaucuguauugcuaugugcacuuuacaaaugauguaagagaggcucaagaucacacaucuaaaaugugcuugaaguaggauuuaaauucagguacaacuucagaauucaagcucuuagcccaccaugcauguugcuucuguaugaaaacuguaucucuaguagaauguuagcucugugaagccagagauccuguccaaauuguucaaucuuaucuugccaaugcacagaaugguaucuggaggauucacugcauacaaaauacgugugcaauaaauguucauggauauaugaauuguaucucucaacuaaguuuuuuguacauauucucagacacugaguucaaaauauaguucuuagcaagaauagcuaucuguguugauaguuaaauguacugccuuacuuuaacagucaacaaauguaguguaacacgaaacaucucugucaugggaagaagccuaaugaaaacaugugcccauauagaaguucaguuugccccacuacacaaagaaguugaagcguguucaaggacagauagaagaugcuucccggaaagucauguuggguguccuccgaaacccaaaaaguuuaauggcaugugaaggauaugcuaacaaguagcauagccuugaaauaggcugaagagauacaucaaacuucaauauagcauuuauauuuucuuauucauuaaaucugagaagucucacaaacuagagagacuacuccaagggagaacuuuuauuauagccucauccuucucucuuuauuagaaguguagaugacagagaaaagccagugcaauauccuagggaaaggugauacagcaaagguuccacaagaaaaagaccagcacagucugucccaggccacacccuguugaacaaacucuaaguacauuguaacucucuuuccucucucccagaauuucugcagggauguugaaacuaaauauguagaagggaauuucauauucacuuaaaaauuauuggaucaacuauauuuauuuuauaacccaggaagguauagaauauuuuauuauguguauuuaaaauuuauuuuuaacauuaguuuacuuauuauuguauguucggucauaccagcagccgaucccuuuacaaauccaaguuccugaauguucuauaguccuaauuuugagaaauauaugucugaaauggugacuuauaaauuuaccuauaaaaguaauacuauauauuagacaccaugauugagugacauaaucuaucagaaaguaauaaauacuuaaaaaugaaauacucuauccacacaaaacauauuauaccauucucuagaguucaucuucaggucucuaggcccuugugugauuuuuuugaacuggacaccuuauagaguaggaaaauacauuuaauggaccuaaaaugguaacucuguaaugagggaaauaagggaaaagaaggcugucucuucaugccucuguuguuaugacacacuucuuauuuuugguauuacagccaaaauacacgugaaaagcuuucaauaacauccaacaucccuucauguuaaaaacccucgaccaacuaggcaucgaaggaacauaauucaaaauaauaagagccauauaugagaaacccacagccaaaucauacagaaugggagaaaccucaggcauuccccuugagaacuggaacaagacaaguacgcucacucucaccacuccuauuuaacauagcacuggaaguccuagcaggaacaaucaggcaagagagaaaauaaaauaaaaagcaucaaaauaggaaaagaagaagucaaucugucuuuuucaaugauaugauucuauaucuacaaaaccccaaagacuccaccuaaacauucuugauaaacaaauacaguaacguuucauaauacaaaaucaguuaaaagaaaaguagcauuuuugcacaccaauaacguucuagcugagaaccaaaucaagaacacaaucccauuuaucauagucacaaacaaaaugaaauaccuaggaguuuaucuaaccaaggaggugaaaaaugucuacaaagagaacuacaaaauacuguugaaagaaaucagggacaaaaaaaaauaauaauaaauauuccaugcuuauggauuggaagaaucaguauaguuaaaauggccauacugcccaaagcaauuuauagacuaaacacucucccuaucaaaauaccaaggucauuuucacagaauuagaaaaaucuauucuaaaguucauuuaaaacaacaacagcaaaaaaaaaaaaaaaaaaaaaaaaaaaaaaaagagcuugaauaggcaauauaauuguaagcaaaaaaagcacaaagccaaaggcaucacauugccuaaauucaaacuguaauguaaggcuacauuaaccauaacagcaugguaugguauaaaaacagacacaucgaccaguggaacagaauagagaaucuagaaauaaacccacauaccuaaaaccaucugaucuuuaacaaaaucaauaaaaauaagcaaugggggaaggauucccuauucaauaaaugguucugggauaaauggcuagccauaugcagccauugaaugaggucuaugaaacuagaacccuaccucucaccauauaugaaaauuaauucaagauggauuaaagauucaaauguaagacuugaaacuaugacaauccuaaaagaaaaccuaggaaauauccuuuucuacguagacuuuggcaaggaauuuauggcuaagcccaaaugcaacuucaacaaacacaaaaauugacaaguaggauccaacuaaacaaaagagcuucugcacagaaaaagaaauuaccaacaaaguaaacagacaaccuacagaaugggaaagaauaauuguaaguuauucagcugacaaagaucuaacacccagaaucuguaaggaacuuaaacaaaucaacaagcaaaaaaccacauaauccaauuuaaaaaugggaaaaguaccugaacaaacacuucucaaaagaaaacauacaagcaaccaauaaacauaugaaaauaugcuuaguaucacuuaucaucagagaaaugcaaaucaaaaccacaaggagauaccaucucacaccagucacaauagcaauuauuagaaaguaaaaaauaacagauguuggugaggcuggggagaaaauacaaugcuuauaaacuuuuggugggaaugcaaacuaauucaaccacugugaaaagcaguuuggagauuucccaaagaacuuaaaaaauaacuaccaugugacacagcaaucccacuacuagguauauacccagagaaaaauaauucauucuaucaaaaagaccuacgcaccuauauguucacugcagcacuauucacaauagcaaggacauggaaucaaccuaugcgcccaucaacaguggacuggauaaagaaaaugugguacauauacaucauggaauauuauguagugauauuauuuggcucugucuccccauccaaauaucaccuugaacuguaauccccagguguugaggaagggaccuggugggagguguucggauuaugggggcaguuucccccaugcuguucucgugauagagaguucucaugagauaugaugguuuaagaguggcaguaucugacacgcacucucucucucucucuaucuccugccaccauguaagaggugccuugcuuccccuucgcuuuccacuauaauugcaaguuucugguggccuccccaaccaugcagaacugugagccaauuaaaccuccuuuuuuauauauaaauuacccaguuucagauaguaucuuuauagcagugugagaacggauuaauacaugcagccguaagaaagaacaaaaucaugcccuuugcagcaacauggauguagcugagggccauuauccucagcaaacuaacuuaagaacagaaaaccaaauaccacauguucuuacuuauaaguaggagcuaaacauugaaaaugccuaauuguaagguugggaauaacaaacacugggcaucacuagauggagcggaaaagaagggguucaugggcugaagagccaccuguugguuacuaugcuuacauccugggugacaggauuguugggaccuuaagccucagugucauacaauuuacccauguaacaaacuugcauguauaucucuuaaucuauaauaaaaguugacauuuuuuuaaaaaaaggaaaaauacccaaaacucuagucacuuccagagacacaauguccccauugauuugcacacaauguccucauuuucuguucuaggccaguaagaacugugcacauguuuucuaaaaugaaaucauuaauguacauuacugggcauuugacuguaacauuauaaugauaguaacuuuuuuaacuuugacuuuugagugcuucaaaaacuaaaggccuaaaauuuaagggauaaaugagauuuuauaauuuuaaaguuauguauuaguuuuauuaauuguauugugaugguuaauauggagugucaacuugauuggauuggagaaugcaauguugauccuuggugugucuguaaggguguugccaaaggacauuaacauuugagucagugggcuggggaauguggacccacccuuaaucaggugugcaccaucuaaacagccaccaacaaauacaaaacaggaagaaaaaugugaagaggagagaugggccuagccucccaaccuacaucucucuuccaugcuggauacuuccugcccuugaacauuggacuccaaguucuucaguuuugggacucagacuggcucuccuuucuccucagcuugcagacggccuguugugggaccuugugauuguguaauuuaauacuuaauaaacuccccuuuauauauacaucuauccuauuaguucugucccucuaagagaacccuaauucauauaugauuuauaccguauuucuaaaaauacuuugaagugaugauacuaaauuuccauuagaaauaagaccucaugaaauaguuguauaagcugauuuuuuuuuuuuuguauuacugaauguaacuuuuaccuacuuuucaguugagagucaggauauuuuuauccuaaucaacuuuuuucccuuauguauugcuauguggaaacaccauauacauauauaaaaaugaauuauuguaugaaaauuuaagaaaacaaauauaaaaagauuuuaacacccacagcaaggaacagaaaaagaaauacuugaauaucuugaacuaccuaaucacuuuuauaauuuauauuacuuuuuucuuuucuauguaguacuuaccaaaauugguaauuacauaaaaauuuacaugguuguuaguucagcgucuguccccgcuaauagaaugucaguuccagacagcagagauuuauaauaaauuuuaugaauaaauauaacuaacauuuuaacauuuugugugcauuaauaacaugccagucauaagcuuaaguauuuuaaaugcauuaacauguuuaauucucauaacuguccuauauaaauauuauuauuugcacuuugcauggauggaaaugcaaagcaguuaauuaacuagaccaaagucgaauugcugggaguuugaacgccauucuucaaacccaggcaguucuccaucucugacauucgagcuaucaaccacaaccauauaucugauaugguuacagaaugcuuagaaucaacuuuauuuuuaauuuaaucuaauguuaaguuccaggauaaauuugcaggaugugcagcuuuguuacauaggcaagugugucccauggugguacgcugcaccuaucaacccaucaccuagauauuaagacucucaugcauuagcuauuuauccugaugcucucccuccccaccagcccaacaggccccaguguguguuguuccccucugugugucaauguauucucauuguucagcuuccacuuuuaaaugagaacauguggugcuugguuuucuguuccuguguuaguuugcugaaaauaauggcuuccagcuccauccaugucccugcaaaggacaugaucuuguuuccuuuuuauggcugcacaguauuccaugguguguauguaccacauuuucuuuauccaaucuaucauugaugggcauuuggguugauucucuuugcuccugugaauagugcugcaaugaacauacaugugcauguuucuuuauaauagaauguuuuauauuccuuuggguauaaucaguaaugggauugcugggucuaaugguauuucugguucuaggucuuugaggaauugccacacugucuuccacaaugguugaacuaauuuacauucccaccaacgguguaaaagcauuccuguuucuccacagccuugccagcaucuguuguuucuugacuuuuuaauaauccccauucugacugguaugagguguuaucucauugugguuugauuugcauuucccuagaaucagaauuguuuuucucuuaacucuaucuucauucuuucauacaaugacuuuagaaaaguuaccuaacucuuaauuucuuuuuggaaaaaaaugaauauaggcauaccuagauuuauuguguuaaacuuuacugcucuuugcagaaauugauuuucuacaaauugaagguuuaugacaauccuucauugagcaaaucuaucgaugccauuuuuccaacagcuuguguucacuucaugucucugcgucacguuuugguaauucucacaauauuugauuauuucauaaauguuuucauuauuauguuaaucugugauuaguuauuuuugauguuuauuaucauugcuuuggucagccaugaacuaugcccacauaagacaguaaacuuaauagauaaauauuaugcguguucagacugcuccacuuuccagccauucccuaucucucucccugucuuugaaccucccuauuaucuauuuuagcaauauugaaauuaggccaguuaacccuacaauagccucgaaguuuucaagugauaggaagagugacaugucucucacuuuauuuauuuauuuauuuauuuauuuauuuauuuauuuauuuauuuauuuuugagauggagucucacucugucccccaggcuggaguacaguggcgcaaucucugcucacugcaaccucugccucccggguucaagcgauucuccugucucagccuccugaguagcugggauuacaguugcgcaccaccacgcccagcuaauuuauuuuuaguagagaugggguuccaccauauuggucaggcuggucucaaacuccugaccucauaauccgccugcuucagccucccaaagugcuggaauuacaagcaugagccaccaugccuggccaugucucucacuuucaaugaaauguuacaaauguuuaggcuuacugagagaggaacuucaaaaguugagauaggcugaaagguaagccucuugcaccaaacaccugaguugugcaacaaaacuguucuagaaagaaauuaaaaguacuacucaagugaaaacaucaauaauaagaaagcaaaaaagcuucuuccugauaugaagaaaguuuggguggucuggauagaaaauaaaaccagccacacauucucuuaagccaaagucuaaagcagaacaaggaccucucuucaauucucugaaggcugagagaagugaagaaacugcagaagaaaaguuggaaaccaguagaggcugguucauaagcauuaagauagaagccuucuucauaugaaaaacuacaagaugaagcagcaagagcuaauguagaagcugcggcaaguuaugcagaagaucagguuaagaucauuuaaagaaggaggcuacacuaaacaagagauuuuccaugcagacaaaacaucuuccuauuggaagaagaugccauguaggacuuucauagguggagggaaguaauugcugccuucgaagcuucaaaggauaugcugacucucuuguuagagacuaaugcagcaggucacuuuaagaggaagccaaugcucauuuaccauucugaacauccuaggggccuuaagaauuaugcuaaaucuauucugccugugcucuauaaauggaacaacaaagccuggaugaauguacauuuguuuauagcaugguuuacugaauauguuaagugaacugcugagaucuggugcucauaaaacaagauuccuuuaaaaauauuaguacucauuugcaguggaucuggucauccaagagcucugauggacauguacaaggagauuaauguugcuuucaugccugcuaacacaauauccauacuucagcccaugaaucaaauaguaauacaaacuuucaagucuuauuauucaaaaauacauuucauaaggugauaccugccauaaguagugguuccucugauggauuugggcagauauguugaaaaccuucaggaaaggauucuccacucuagauaccaauaaaaacguguguuucaugggaggaggucaaaguacacagaucaacagggcugugaaagaaguugauuucaacccugaugaaugacuuugagagauucaagaauucggugaaggaaguagcuacagauuugguguaaauagcaagagaacuagaauuagaauuggagacuuaagauaugccuggaguucugcaaucuuacuauaaaacuugaauagauaagaaguagcuucuuacgaaugaggaaaaaaaaagugguuucuugagauagagacaauuccuagugaagaugcugcaaacauuguugaaaugacaacaaaggauuuagaauauuucauaaacuuaguugauaaagcagcugcacagugagagaauaaacuccaauuuugaaagaaauucuacuguggguaaaaugcuuucaagcagcauugcauacuacagagaaaagauaugggcaagauagugucaacugauguggcaaacuucauuguuuucuuaugcuaagaaauucccacagccacccuaaccaucagcaaccacuacucuguucaaucagcagccauaaacagugaggcaagauccugcaguagcaaaaauauuaacgacucaaugaaugcucagaugauagucagcauuuuuaucaauaaauuauuuuuaaauguuaauuauguuuugacauaaugcuauugcauacuuaauauacuacaguauauuguagacauacaguauaguguagacauaauuuuuauaugcagugggaaacagaaaaauuugugugacucacuuuauuauuauauuugcuuuuuugauauuugcuuuauugcaguggucuaaaacuaaacccaugauaucucugauguaugacugcacauaauuccugccacaaagaauugguguuaaaacuaaauaaauuauuacauuaaaaaaccagcuccuaacauuaugcuugguucacuauagguaucugauaaauaacaauugaaagaaugaaguugaaauuacuauauaaacauguaauaucugcuuucuaguuccuuuacuuguuuauuguuuaaacuauugccaaauugcauauaauaaacuucuuugaggaaagaaauguuaaaaauguaaaugaacuucuaaaggaaaauaaaggaaucugaccuugugaccuuggauuaggcaaauuguuucuuauauauaacaacaaaagcacagcaacaacaacaaaauagauaaauugcacuucaucaaaauuaaaacuuuuaugaaagaaaggaucucaucaggaaagucaaaagacagcccacagaaugggagaaaguuuuugcaaaucauauuugauuagcaacuuauauugagguuauuuaaauaacucuuacauguuaacgauaaaaagauaaauuuaaaaauuugcaaagaauuucaguagauauuuuuccaagaaagauauacaaguggccauguaaguacaugaaggaaguucaacaucaugagucuuuagggcaagguaaaucaaaacuucaauuggacaccacacucacaaggauaauuuuuuuucaaggcaugcaauaaguguuugugaggguaaagagaaauaagaaccuucaugcguuaauggugguaauguaaaauggcgcagucauuuuggaaaacaauuuggggguuuaucaaaauguuaaacaugaaguuaucauagaacccagcaauuucacucccagguguaagguaagguaauugaaaauauagggccacacaaacacuugcacacaaauauucuuaguagcauuauuuguaauagcccuuaaggggaaauaacucaaaugcccaacacuugaugaguagauaaacaaauagugguauggccauauaaugggauauuauuugacaauaaaaaggaauaaaguacuaauacaugcuacagcaugaaugaaccuugaaaacauuuuacuaacugaaagaugcugugacaaaaggccacauauugcaugauucuauuuguguuaaauguccagaguaagcaaaugcauagagacaagaauguauguuggugguuucugggaacuggagggagaggugaacgggaagugacugauaauggauagagguuuucuuuuuuggagugauacaaacguuuuaccauuaaauagcugugguaguugcacaauuuugugaauauacuaaaaaugacugaacuauacacuuuaaaagagagaauuguaugguauuugaauuauaccuuaaugaaucucuuauuuaaaaugugaaugagacagguuauagcugcaauacuuacaguaacuacauuugacucuguauuuauucauuaugaguuucaguuuccacuacuaugaaauaguuaagacuuaucuuuaaaaucuuuuccagcucugaaauucuaaucacaaugaaauaauaugcucugcccaacugaaaaauuauauaauuauacacacaugcaauacguaaaguaacuacaucuguaacuauguauuuauucauugaguuuguuuccacuucuguaaauugaauaguugagauauaucuuuaaaauaucuucuagcucugaaauucuaauuacaauaaaauaauauguuuugccuaccugaaaaauuuuauauaauuaaauacacaugcacacaaacacacauguauguauauauauauauauauauagagagagagagagagagagagagagagagcugcuuuuauucuauccaauaaaguuaaauugugaaauauguaauuggagggucuuaauuguguaucuuuauaaagcuucaaaacuaaauuaagagaucacaaaaauaauauuugucagcgaauaagaauacaguauaaucuaaccccaaguauugaauuuagccuuacaauuaucaucuuucgauaugacuucaaguugaaaagacaacaaccagaauguuucacaggguaaagcucaacggcuguuagugggauagauggguuccaauuaggagugggccugaaggaagacgggaacugcuugaggaaucucggacuaugagcucaacggaggaagggaaaaggcagucaauggagcacaaacacaaaugugacucaccucacuucuggaaagagcaacuguccucgggguuauuauuauaaaacgguggccuguauuacgguaggaugcagaaaccugagcucauucacagaguucucaaugacauaccccgaggguccuuuuugauaucuccacauuuacuuaccauguguguuuucaugaaaguaaaauguggauggcuuacagaaacuggaugaguaauuuggucucuaacuaaaccaguuguagcucuagcuuuaaauguaaaaaauaaaaaugaauagauuaccaauucaagaaauaauaauuuuuugaguuguuacggacuuuaugagacuaucugauccuuuuacuauauucauguaguuaucacguuuaacagugugaggcagcucacucagucccacugcucauaacaugccuauuaaauuauaugcauuuuuuaacuuucacuuuguaauaauauggcugaaaauguagcaaauacuaaauaguuguacaaucaugcauuucuagucuuucuuucauuuuuuuccuucaucugcccaauucuuacuuccaguuccuucaacgaugaugacuacucuuaguuccuuaagaauaauuccagaauuguuaugaauguacaaggaaacacaaaugaaguuuauccucuaccucaccuuuaaaaauaagugauugggagcaguggcucaugccuguaaucccagcacuuugcaaggccgaggcagguagaucacuugagcccaggaguuugagaccagcuugggcaacauggcaaaaacuugucuaccaaaaauucaaaagcuagcccaguguggugguguaccccuguagucccagcuacucuggaggccgaggcaggaggaucacuugagcccaggagaucaaggcugcaaugagccgugauuacaccacugcacuccagucugggcaacagguuucaaauuaauuccugucucaaauuaauaauaauaauaauagugaaauaauaauaaaugauugauuugauacaugcugcucuuuggcaucuuguuuuauuccuguuaaaguauaucuugacgauacuuucauaucuuuauauauagauauuccaucuucuuaauugcauaugauuuuauuguuuaaucugccacaauguauuuaacauuuuaggaguagucaaaauuugccaugucaaauagcgcugcaaaugaaugucucugcauauauuauuuugugugugugugccagcauauuuguaagguaaguucuccaaaaggaauauagagcauuauuuacauuuaaaagcaucaccuacagucugaagcaccugugugaacacaaauuugcaagugauucuaguuuccccaggccacauuaacuuggaguagguauagugaugguaaucaauaccauucuuucugauucaacccuuacucaaagguguggaagaaauaaaaucguuuccauaugguucauuauuaauuacugauauguucucuucauuaaccauguacccucugucacuuucucagacauuacuguauuuuggguugcuauuguaacauuuuguccccuuccccucaugaugggagcuaugguuucaggccacucuccucuacuacuucugauauuauuaccccauguauuuucaugccacuucuaugcugcaacaguaacauaguuguuuuaugcuauaauaggagcauuucuuuucacuuucaguuuauuccauauguugggugacauaaauaauuucuuuuuucuuucucuugaucuucaauuuuccaauaguaaacaauguauuaggcaugccuucuauuauauuuuuugacucuugaaugaugucagugcuaggcuugguuaacagccuaacuccuccuccauuauuucuucugaauggagaaacacacacacacacacacacacacacacacacacacacacacauacaaacacacagaguuuuauuauaauuuuccucucagcuguuuuuucuuccuuuuaauauaguuaauaacagagagacuaaaaaaaauccuacaugauauuuuagcuuacaaagcuaaguaauuuauauaaaauauuuguggaauaaauuauccuucucaaauuaucuauaauaauuguaauauuguucugauuuuuaaaguuuuacaugauuauuuuaaagaauuucaagaauguaaugauucaacuuuuuguaaauggaccuaaugcuggcauuuuagaauacuugccuugaaaaaaaacuaaaauacuuuacuucucaacccuuguuuuaaaacgugauucauucucaugacuaauaauugauuuuuauauuucaaauaacuauaaaaguggacagcaguuuguucuacuguuaaugagcaguuuguccaugcuucagagaagcaaauaaaaaggaaaucauuuuauuuaaauuguugcuaggucaacacuacuauauuggaauuucuuauuuagaauucauccaggacuggaagcaccugaugugcugaaacuuuucugcuucucugaacuauguuuuagaucuugacuucuccuggaugauaauaaagaguaagggauuaaaauaauuucauaaaagauauugucuugcuuugaccaucuuuaauaauuacgauuuauacaccuguuggcauuuacaugcuaucuuuauuguuaacuauauuuuaugcacuagccucaucuccguaauuaggcucucacuccuagguaugacauaaucuucauuguauaugccacaucuucuagugaagugucucuccaaugguauaagcuuaaaaauugcuuauugaagaugacuguguaugaugaugauaagucauucucauaaauaagaucauuaggccauguauauaaaagcacauaucagagguacuuacaaaaagcaaucggcaaacauuuguuucgcugaauuuaucaaauauuuuggcaaauauaacaugcaagacauucugggucucauuuuucuuaaaauauaaugcacuacaagcucucuauuuuaccuuuagcacuuuaguucuauuguuuuuaguaaugaaauaaaacaguaccaugccauugaaguacauuucuuugucaccuugaauaaacauaaugcuuuaauuuacagugcaaauuucccccaaaauauuucaccaauaaucagucuaaacauuucagaccauaugucaagucauuuaagguaucacuuuauuuuaaaucaguuuggcuuuaaaaagugaaauaaauaauaugucuuaucauacuauuucucuguaucauaaaaauucuucuauuacuuaaaaagcuguguaugcauaagaaaaaucuacuaauagguuauuacguauuucaaaaucuacuuaccaaguacuaaguacaaaauguaguuuucuauaaguauaaauaaucaaagaugcagaaagauauuggccuuuaggggcacaucagcucaaaaauaauuacucauuuauuaguuacuaaacuucaguguucucaucuuugaaauaggaauaaucccacccaacucucuaagugcaaggaauggaaagaauauauuuaaaauaugacacauauguauacaauaaauguuaccuaugcuauuauauuauaacuagaguuuuuuagauauuaugugguuuuaucuaugagacacauagauagauagugccaacagcuacauagaauaaauauaucggggcaagagagcucguuauagaccagaaugaaauuuuuaaguuagaauuccugggguugagcuuugguugugcuuacuuaacauuuuggugcucuuauauaaaccauuacagauaauuauaaauuuccugauaagugaaaauauuuuaauagauauuaaguaaugaaggguuucgcaagaucaacagucaauauguuugaaaaccuuuuuuaaaaggcuguaaaaauaauauuuuauuuuauauauacauuucuuaacaauauuuuuuaucgagugaauuacuuauucauugucuucccaccuaauugugagaucaaaggguacauaaaucauacuauaucccuaccuuauuaugaauucuccaaaaucauaauuuuuaauucuauguuuuauuguaaaaauauccccauuauuaguacaucaacaaaauauguggguauuuaagcuaauuuuugaauaauuguggaaacaaacucuauauucuacacaaaauauuuuaaagaaaauauuuauguguuguucauuguuuauuuaauuuagaacuuaaaauuacuugguaauuuuaauguguuaguuacuuuguuuauucugccaaagcauauuauggauagaauuaaguauagauuccuuuuuauuaucacugugcucuaagaaugaacaacugaaaagucaacuuuugguaggaagacuaaaaauaauauuacacaaauauaaaauaacaaaauuacacacuaagaggaaacuaaauuuuaguauagcuguuaaaaauaacuuauguaggaaaaaaguauacagaucuacauaaacaaauuuauuucaauuaaggcuuguaaauaguaauuauuucacaucaaaauaaauguuuacugacagcacauauaauuauagaaaacuaauaauucuuucaaguuggaauucauagaaacugaauaaauuuuuagaauaaaaaguauuuauugcagaguuuugaaauuuauguuuaauugggcuuugucuauaauuauuuuaauuuuuaagucauuuuucagccugugacccaacuacuuacauucuucuaauuaaaauauaaguagagaaugauauaagcauuguaaccagugaacaacagacuccaaaacuagccacagccagaucaggaaguuuagcuucugugaaaaaaaguuuucuagaauuuaugauuaaugaaugauauuaguuguuggaauuaaucaaaacuguauugaacgguaaaguuuuauuaaaauuauggugcccugugcaccaugaguaaagaaccauuucaaauaaaaucagugaaaauaauuauuucuuagcuuuuuggcuaaagucaaauguagaagacacugauuaaaaauaguugauaaauuauaaugcaauauaaaaaguggaauugcagaugauuauugauauuacuacaaauacaaauaauauauuagugaucuucauuguaacaaaaaacaagaguuggacaaugaggcauuucaaugucacauaaaaccuagcagauaugauaaaaugagaucaguggcauuucugccgacucagugaguaaccuuauacaaaccaaaucacccuuugcuuagcuuccuaauaauugaaaauaugaucacugaagcagagacacucaaguuccuuucaguuaaaagugguaaccagugaccaguaccaguauuucugugacacuauccagcaaagugacaacuuuuauucaaaaugaccaacacuaauaugauagaaauauauguaacugggaaggcauuucaucagaucacuaggcuuuaacauaaaaauuccauuaaaaugaacaucgaguuagcuuuauuauguuuauucagaaaacuucuggcuaauaauauuuuacccccuuugacuggaccaauacauacaaacugguaaguuuccccaaaacuaaagagcaacuugaucauguuuguagccaggaauuagucaaauaaaacaaugaaaauugguuggugaaagaaaauaaaacauggagugaacagaaaaugaagcacaaaauuauauagggcaaauauuuccuuacauaauuaacuguaugccacauauaaguacauauaagacuauucuagauuucuaaauccaacuauauucagauuuguucagaguauauguagguugagugcagggaaguuuaggaaauaaaaauuccauaaaaguaauuuguuccauaccuagaaaaaaugauuguucaaacuugaagagagauauuauguaagauuacacugcaucauucuauagaguaucuauauguaaaggagauggaaagauaauaauugauauaacuugaauauuuguccccacccaaaucucauauucaguuguaauccccaaagcuggagguagggucuugugggagguuuuugaaucauaggaguggaucccucauggauugguccuaccuauauaauagugaguucucacuagaucuagucauuuuaaaguguguggcaacgcccucaccacucuaucccucuuucuugcuccugcuuucaccaugugaagugcccgcuucuacuuaaccuucccccaugaguaaaagcucccugagggcucuccagaagcagauguugccaugcuuccuguauagccuguagaacugauagccaauuaaaccucuuuucuuguaaguuauccagucucacauauuucuuuauagcaaugcaagaauaaccuaauauaauaauaucgaugaauguguuuggcacuauguucaaaauaaacaugaccaaaacacaccguuuucaguaacgcaggguaaggaaggcgauaaagaaauauuuaugaaaaauauuaguauguucaaaaaguauagucuuuagguaugaaugauauuacugggacacaaaauaauauuugaaugaugucuaaaguuuaaauaguaauuuugagucaguguuauuuuucuaauuuucauaauuacuucaguaauguaacugaauaagaaaauacuuuacaggggguacauacugaauuaugcaguauuaaaggguuaucauguguccaauuuacuuucagaaaaucagggaaauauaaauauauauauuuugagacagagucucacucugcugccaggcuggagugcaguggugccaucccggcucauugcaaucuccgccucccggguucaagccauucuccugccucagccucccaaguagcugagauuacaggcacacaccaccacacucagauaauuuuuguauuuucaguagagaugggauuucaccaugauggccaggauggucuugaucuccugaccuugugaccuuggccucccaaagugcugggauuacaggccaccgcgcccagccaagaaaaugcuucucaaggggugcacacugaauuauguagaauuaaaggguuaucaugugucaaauuuacuuuucaaaggaucagggcaauauaaaucauuuuuuaaaagcaaacguuuuaaaaagaugauauaggcucaggcuagauaauugaagugcauccuaggucaaucaauguaaaucuucugauuccuauuggaagcugucagugguauguuuucauaaaacauaauaaaguuuuggagaaaauacuguggauuuuuucaaaaacagaaggaagacaaagacaccaucagagaucugucacguccuaagggagggucauuuuuuaaaauaccuuuccagaauugauuuuagcagcagacaccagugugggagucuuuucacaaaagcaaagaaaacacuguaaugggagagagugagcuagucuuguauagcaaaacugccuguggcuacucaacuugcuauuauguuucaauccuucaagagaaggaagggaaagcucagaagagggguuggaccuaaaaagaucaaguuagugagaagaucaaaaugaguagagagugacauuauauuccuugaggaugacauuuuuaccuauacguguaauccacacaguggucuauuuauuccauauuuuaacauuuuauuuaucuauucuggacaauagaggaacuaugcauuuuuguuuuguuuugcaaagacccugggagugcuucuaaauguugaaugguuuuuuuuacaaucucaauauuuaucauuuucaugauauacaguaugaaugguaaguagcuauaauaagagcaaugccauaauuuucuacuaauacuguuaauauuauuuaauauuuauauucacacuaagcacaagguaacaguaaguacuuuacauauauuaugacuuuuaauccucaaaauaaugucaggaggaaggugcugaaaguaaccaugaagucguaucaauuguucaagaucagacagcuugcaaguaaagagccuuggaaguuuaacuacagagcucauaccuccuugaaacagucugaugacaauuuguaacaucauuaugacuaaaaacuuccaaaguguacucacauauagagauugauagauuaaucaaucauucugggccacuuucuaaaaugacuuuuugagaauucagcgcuccuuuggcuuucaaauauguacaauuuuaugaauucgcaaauuauaugaauacuucuuuggcuauuaguaaggaaaauacuguuugucaguaaggaaacuauuugcuagaaccaaguugaauccaauaaucucugguuugauuucauuuauucagcaaauauuuauuaggcaccuauuuuauccuggguaccaggcuuggugccaaaaaugccaugauuaagcagacauaaauccuugacaucauggaacuuuuaucuuagugagaaaaacagaaaauauauacgauaaaauuguauauuauaccauaagauaauaagagcuaggaauaaaagguaaagcagcaaaauaugaaguguuuuucuuauguugaguaaaaccugaaacucuucagauuccucucaucgauccuggaauuucucucuggagcaaaguggaggggaaaguaucuaauuuuuauuuaaaacgauagccuuucaauuauauuaaaucauuaucauauccuaccagaaaacuuuccuacucaaaauaaauagauucaaacuuauuuaaaugcacauaaugugaaauuauuuuguuuguucuucccuggacuugauccauucuauuaaccucccuccgcagucagggccagaacuaaacacagccuuuagaugugguuggaccaagggagagccacccuuuucacucuucuuaaauucuauauuucuauauuuuauuacuaacaaugcaaauucuaauugauaaauuugggaauaaaaguuagaucugacacuuauuugcugaaugaucuuggggcgguuauucuuucaauuaauuuuauuugucauuauacuauuuauagucauuucuauucacugguuuguuguugaagguaaaugaagugaguacaugaagguaacuagccccaggugugcauauaguaugcacuuaauuaauguuuguuucuaucugucuuccguguuaaauucagaaucuagcuaaacagucaugcuguagucaaaucaaauuuauccccaucuguaauugugcucuuuguuuaauugaugcuagauuuuuuuaaaagaggacuuaaaauuggcucuguuaaacaugauuugcuaaccucuaccuaauucuuaaaauuucuccauuucccagaauuucuauuuuguaauucaacauauucaacauauuuaauauuucuuccaguuucauagcaccugcaauuuugaaaagauugaguccaguguucuuacccacauuaauaaugaaccuuuagaauaauauaggggcaagaaugaaacuauaugacaaaucacuagauaucuccuuacaguuaauacaaauccauaacacaggguuaucugaguacaaacuuuuaaccaauaauaagccuacccaguuccauaucaucagugaauauuuuuccaucuggccaacaggaacacuaaaagagaccuuuguaaaugccuuauugaaauucagauacauuaacucgguuucuguucucuuagauggaaggaaauuccagugauaaagauuguagcaccuacuuagaaaacaaucaugacauucauaguaaacuacuaaaauggaaguagacucaauuagauauuaaaauggguccuuuuaacuguggagcugaacauaauaaaaguuuuaaugguuacuucuuagaguauuauuuccuuucagaaaagguggucacaugaauauuuagugaagggaaucagauucaugucauaucagagucacugauuuucuaucagacaagagaaaauuauuuaaggaaaauaguuuuugaaguuguaaauuuucaaaccccauacugucccuuuccacaucucugcuauguaugaggaauacaguaggaucaacuaaauuaucacuuuuaauaaaccauaauuucaauauaaugaucucagauacugguggccauaaagaguacuguggaaguuauuuuuacagaaauauaucuuauuaaaggcuuggcuaugaguuucuuccuaaaacaccaaacuuccuaaacuaucaacauuauguuauuaacuacuguccuauagaaauuguuauguaugcagauauguuugacaaacuuuggguuaaccaguauuaagggccgguuuccauuacugugaugcuacuuaaaguguauguugaaaggcguuguaaacucccaaagagaaugcgguauauaauauuuccacauuucauugaccacaaaaccuuuuuuuaauugcauagcacuuguuaacauuucccaauuguauacuuacaguagucauugugauuagauaauauuauuuaucaacaaaaaaauuguaacagggauucaacucugauauuaggacugagggucaagucuauuucauauauauacacaaacacaaucauagaaggcaaggauucaggaacugauuaacuggcggugugagaaaugaaugcuacggaaguagggaguucucaauauuuaguguucauuacuggaguaccauaaccuggaauuucuuaguaggaaccagucucggaaaacaaugcagaauuccugugauaaaagaugagagucuuagagccaggguguuuaaugcuaaagauagccguuguggggcaugauuauguagacuguacuuucaaccuuccucggggugaggaauuacauuaaccuucagaagaucuagucauggcaagguguaggaggcagugggaagguaaaugaggugguagcucaccagagagagagccagggauacuauuguaaccgugguauugggaauacuauugugacuucaggaaaauacugcaacugcaugcaaaauauuaugaguauauagcugagccagagaauccaaagcuuuuuucugauuuuuaaaacagccaaugaccuaaaaagguuaaaaccccuccaccuacauaagauugucuuuuucuuucuucugacagcaauaucaacgacugcccuuggcagaaugauuucggagaaaaauugaccccuuuuagaguucucuagcagaagaugagcaaacaaccuuuuuaagcagcaggcagugcugguaggaaauguaaaauauuauguccaacaacgguaacaaaaauuuuagaaaucaaacaaaauguuggaagauuuguugucuucuguuauucuauuauugagcauuuguuuuacaguaauaaauguaucucugaaauccagcuagacuuggaagggaauaaggaaaauauggaacccaaagaucuuugauucuuuuuauguuugaacuuuagcuaauuuggcuggcaauggaagaaugcugaauuuuugaauuagggaauggaauuuuuauuucuaccacagacuuuaaaacagauaacaagaaauuuuaggaaggccccuucuacauugagaaaguccuuuaaauagguaaucuaucaucuccuuguucuaguaauggcuucugaauuauuauuaagacauucuccaccagagggagcuuuccagagccacuuacacuuccuuccucccuugucuccaucaaguacauucuuacucauguuccugcuccuggguacaguuaccacugcacagcauagucucccaucuauccuggucaaauacucuagacaaauaggaaaggucaagggaagucauccucaagaaauaucccucuuuguuggucauuaaggagcauauuggaaagcaaaaucagggcuuauaaaaauacacuuugcagaguaccucacauucuccacacaacuugcuggcucuuauuuuaugcauagaugcuguuuguuauuuugguuuucaaaacaucucuuagacacaauaaaaaguaugugaaauaauucagucauguaaggaagaagaaaaauaucagaauuuaccacugaaauuuuucuagauaacaacuccaaaucuuuuuuuuucucugccuuuucuguguuucuagaguuaagauguucuuaaaaccaugggaaauuccuuacuuuuugaguauauaagguuuuacaugaauuacauuaguauaauugaaaucaggugaaaucaacagauaauucuauuaacuguuuaaacagcuucggaccaucaauagugugcuuuuaauuugauauauuugaccaaaaacgucuuuucuguuagguuuuguucagcacauuacauaugcaaucaagaaacagaguaaacacagauauguauuauacauugcacauuaucaucaguaccaaauuaaugacugauauauagaaugugaaucauuuuuucugucaaauuuauaaacaugaggcuauguaucucaaguuaaucagcuuucuaauccuccauagcauugccuguuuuucuucucuugucccuagaaaguaaaaauauuuuguauuaauugcaaauuacucaauaaauaaguaucaugaagccagaaguuuguuuuuaauccauauugucuuaugaauaauuuuaauacauaucuuauucagaagcaauacagaugucuuuaucaaauauugcuaaaugagaguuuuaauuucuaaaauugccuuaauuuaaucauaaauauauucugcuuuuucauauuuuuugauguuacaacuuuauuuucuccauaaaagauuuuuuauuuuuccuguugacaaugcuguaaguacaaugcuacuuauuaaaauuaauuacuauuuauuuccauaauaugucuuugucauuacugugcuacugcuggaaauggagaauguugacagcuuaauuuuuaacagccauacauuaggacuuuaaaauuaauagcacagcccuaguuuuccuuuaaggaaucuacuguaggauauacaugguacauacacuuugaugaucaaauuagcgaugcccucagcaugaauaaacugagagugaauauacaguaugcauuccugauaaaaucuagcucauaggucugaagggaauaaugauaaaguagcaaaauaauagaugugucuccuaauuagcuuuaaacuuuuuaaaaauaacaacaauaagaugcaggcauuaccauucagaauacaauguuacuacauuguagaguuuuaacuggagggugucauugaacagaauaucauacaaaauacugacaaauaaaagugaauuuuaauugucaaaucacaaagcaauccuuucauuaucuguggugaggagacgacauuucacaaagggcauauuuuuuuuccuauuggaggacuuauuucaagggcaaaugaacuguguauuucauauauauauauauauauauauauacacacacacacacacacacacacacguauauuauauauauuucuucacaacaaaaguuaaauauuuuuucuauauuuaaauccaaauaacuuaauuauuucauaauugaaaacaauacaugaaaaguagaacuacaaagguauauuacaaauguacaaaaguaggacacaaauguuuauguauucuaaccuauuuguuuuuuaaacaaauguauagaaaccuaauaauucaugaauucuacuguaaaaugccuaaaauuuaaauuuaaaauaaauuauauuauuugguuuugaaaaugcagcugaaaaacucuguagcaaagagcuauuuuaugaauuccauuccuguucuaaagauagcacaucuugacaugagaguuuucauagcguuaacaugguuguaggaaaaaaaaaaugguuugauuuccuuaccuuagacuauauaagcaugagucaauuuuuaauaauuuuuuuaauaaauuccaguugauacucuguguugccacaauuaaaauaucuaaugcaaaauugacuaaauuuuaaaauguuuuugaaaauagcaaauaauacuaacaacaaaacacugacaauuuguagaaacuccucagcaucaauucagucauauagucaugucuagaaaugagcaaaauuuggaauuauagcuaaauuuugaauuauaucuaaauuauauuauaauaaaggauagcuugaauaggugcauccuaacuguuuaugaaaauaaaugaaauuauaaauaucaacauuuauagcaggaaacuuaacacaucuauuuuauaacacuagauacucuaaaauacauuugaccuggugcaauuuuuccagcagauauauuuuuauauuuuuaaaagacaaauuauaugugaaucaccugacauuucccaguacauagggaaccaucaguaaaugugacaagcccauuguguauauuggugaugcaaucuauccuuucugauucagcuccauaaacauucuccuuuugacugcuuccaaggccauccuggaacaccuagaaugcgucgugaaucuuuacggacaauaccgucugaaaauucaagcguuuuuccauuguuucagagaaugaaaacuaccuaacacuuauuaucuugaaguaucuucuuauuuaucagaaguuuuacuaauucagcaaguaaaauauuuauauggcucccaaacauccauaugucucauauauauuauauauauauaauauauguauauaauaugucuauauauuauauauaauauauauuauauauaauauauaacauauauuauauauuauguuauauauaauauaauauauuuuauauauuauauuauauauaauauauauuauauauuauauuauauauuauauuauauaauauuauauauaauauauauuuuuauuauauauaaauaauauauauauauauauauauauauauauauauauauauauauauauuccuacacacacacagguacacuucuuuccucuguuaguauauaugacauuauccacaauggcugauucacagaauguagacacauacuuuuaaaacuguacuccacauaaagccccacauaaagggcucuuguggcugagggaaaacuucgacuacuuuguuugaagugcccuuccaugcauuggaaauacagcaguaaacaaaagaaacaaaaaucaccaaaaguccuaguagaguuacauucugguugcaacuugacagccacuucacacgcagacacacacacacccacacauacacacacauauacacacacugccaaauuagaauauuucuuuauucuucauagcuacuucacucacacauugucagccaaacuagaauauauccuuauucuccuguuuuuuaaugcuuaagauauuuccauuaagaaagguuuugacaauuaaauaucuuaaaggcuacuuuaccaucuuaaauaccauuaagagacaagaauuuacuaucuuugggagcaaagaguggauaagaaaugucauaaacuuuaacagcaacaaggaacaauguauagacuuaaaguauaauuaaauaucaugaagcuaauuuugauuuuaagcagaaauauuauuugggagccaacugacuguugacuauugaauauuauauacacacuuuauagugaagcuugaaauaauucagguaguaaauccagcaucauuggaggagggagagguagaggaaaagaaagaagaggaagaggaagaaaaagagaaagaaaacauacacagagcaaauacauagaugaauacaacacaaaggauccgaaaacauacuauguuauuuagaauacugggaaaacuagucccauuaucuuuuaagggggcuuucuauaccuuaccccugggauaaauuccaaagccuuuuacauggaagacaaaaggcuguacuggcauguuucuuacguuaggaguaagguagaauugggcugaaagguauguauuaacaacuucugucuuaggccuuuggagcuuauaugugauucuuaaugauuugguuuagauuuacaaaggaauuacaauacuuagaaacuaagaauuuuaauuuucagaaaugucuauuuaguuuauuagacaaguuuugcuguaguccucccuaacaaugugguauguuuuggagcuguguccccaccaaaucucaugucaaauuguaauacucaguguuggagguggggccugguaggaggugauuggaucaugggagcggaauccucaugaaugauuuagcacagucuccuuggugcuguucuugggauagugagugagauagugauuguuuuaaaacaaucagaucuugugauaacuccucucucucuuccucauguucuggccaugugaagugcuggcuacuccuccaucuuccuccaugaguaaaaguuuccugagaccuucccaggagccaagcagaugucagcaucaugcuuccuguacagccugcagaaccaugacccaacuaaaccucuuuucuuuauaaauuacccagucucagguauuucuuuauagcaaugugagaauggacuaauacaaaaugcuuagaucuaucucguacaguguccaaaacauaugacuaacugaauggaauggcuuucuggaaguauguagcauggcuauuuucuacacauaaaauauauauuugaacacuagcauacucauauugaaaacaaaaauaauuauaaaauaagggucaucccuuucuaaauuugaaagugaauuuauuauagaauacauauuccaauuccucacaaauauaaucaauaacucauucuauuaacuuuauuucuuaacaaugugcuuuaauuuccaauagcacauacucauauuaaugcaaaacuuaagugcaaauuuacugauuuuacaccauacaccuacauuuuucaacuauucuuugaaauuaaaaucacaaauauaauauguaaaauaucgaacaagaacaaaaagacauuaaucaggcuuacugacagcacaaugcaauacauucagaaagcacacuauagucuugguucuaaacuuucuuuccuccucccauacugaacucugcuguugcuaugcagcuauccaacaagcacacccuggcuuucuuuuguaugggugcuaugcuguugccauggauauagcuauaucuauauuuuuuuucagcuccucuuuaaaaauauaguauuuucuaccaccuuaagagaacacauaauuuuaugggcucaauacagucauuuaauguaauaaaaauuuuacuaaauuucaaaucuuuaauaucaaucucgguguaacuauaaauauauucaaaacucuaacauguggacauaucuacuauguuuuuaauacuaauggaaugcucacugacauacagcaauuacacagagccagaaauccauuuucaaaaauccuauuuccacuuagggggaaaaaucaugaaaaacuugaaaaaauaguaauaaaucaauaucuagucuguagacaucugagauucauugucuuuaucauuuccuguggaugacuaaguaugaaaugaagugggaugcuaacuaaucauugccaaaauuaaaaccacaggguagauguaagaccacaagcacaagagaacaugaaucuuuacaccagcugacaaaugaaccagaguucaguucagauuucaaagucaauucacugauguuccaccaucaaaauuuaacacauugaaauuaaacuccacaguacuuccauauggugaugguuaauucuuugcaaagaaugcauuagaaaagagaaacuuuuacauuguggugaaaaagugugcugcccaaaugaauuaacugauguggagauggaauugagcaagugacauuaguagggucccagcgucuuuuagauuauuggcauugcuggaaaaaaaaaaacacuucuuuuauauuaccauagaguuuacauacaaauaaucacucaguugcuagucucucuucaagggaucaggaagaaauuugucaucauucagugaaauuacaaguacuaggaaagucacccaaagcacacgagcagccuacuuuuccccacauguaaaguacauauuagaagugaucgagugaucgaggugauauagaauuucaauuaagaauguugauuuuggggccagacugccaacuucagauuuugguucagucacuccgucaccuggcaaccuuagcugaguuuauuaaugauucguaccucuguuuucucaucuacacauggggauaauaauaguuaccaauuuuauuagguuauuaugaugauuaaaguacauuacacauauaaaacacuuaaaauaauguaugguaucuacuauauuucaaagaggcuuaagauugcaugacacauuagagacacuaacagguuaauauuggaaaaaauaauauuggagggaaaaggggcuuuuugcuuaaaaacuuuauauuucugauauugcaaaguauauuauuuaguaauuauugagggcucacagaggagauauaguauuauagguaccauuuugguuguguaauuuaauuagucaaauuuacacuuacagaggagauauaguauuauauguaccauuuugguuauauaauuuaauuagucaaauuuacaacuaagaccaacuaauuuucagagaagcaaaauuguacccugaagagugaacuaacgcuguuagccagaagcaacuacaucauaugacuccacacuuuaauccauuuaacaaauuugguaaucugaaaaacaaaacaaaaacaaaaggauuucaacgaagaacuaauuuguauuaaucuauaaguauacauauuuuuguccagaaauacuugaggcagcuaacgaauauauaugcaacauaagucaacaaaauauacuuaaaauacauagaaaaaugagacaaaaauggagccaaaucaaauauguagagguggaguugggggaggaaagaaauuuuguauuauaaauaccugauaucauuuaaucuucacaaaagaucuguguuacaaauuucacagauaacaaccugaggaucaacaaagcuaaauaacuuuuuuuugaagagcuaguaagcaaugucuucaaaaauacauaugcuaaggaagcaaaggauuuuuuuuucauuuggaauagaaaugguauguuucaaauagauguacucuuucuccuaaaagauauaaucuuucaauuauaucauuacacaaaaaaaucaacacacacaaggaccuaccauaucuaaaacaaagggcuaagugauacaaaaaaaaaguaaaaaugcuucccaaacuucauuguuagccuugcuuugcugaugcuaacaaaucaagggcccauuauaccacauuaaagaucagcacuuucgaauguauacuuuaaacuaaaauaguuuuuucacauaauuagaccauuuuuaaccuguuggacaauuuugcuuacaacaaacgauauuuucuucuccaaagcaacaaguauaggauuauuauuugugcagccuggcaccucuacagcuauaccacaggaauggcuuaaaaaacaauuuaauaccuauauauaauuuaaaagacacugaauaaaugaaacuuuauuagcuaucuguaaggcuauuaaaauaagcucuagccaucuuuccaaccuucuccagaagcaaugaucaguuuucaaugguaaagaacagaaaccagcaucaugggaggccucaugcauuaauaaagauuuguuaacuccaguguaucuuuuuuggggccuaacauccuuagucuuucauuuuucagagccuguauuuaauauauuuugcaacugaucuaguuuuucuucuuguaaaauaauagauuauaaaauauacuguucaaccccgccauauaucuccauuaacaugagguuuaauuauuggaauguaauuuguauacagaagauauuuguuuuaaaaauuaucauuguaauaaauaguaauauuuagcaucuauguacaacagcugaaaguacauaaacuuuuuugcuucuuuuccaucauuauaagugucuaucagggaguaaugcacucuccauaucuccauauauuuugccaagaaauuacacaaagcccaaacucauggcaacaaaaacaucuaaacagcuauugacaucaucuuggaucccccauacccuucaucaagacgcaagauaaauggagaacacucuaaauuaauugaagacaacagguaaaaaaaauuaaacuuuauguacauaaucauuuuauauauaauuaugccaauaaucauacaaguacauguuuaaauauuugauuugaauaauaaauuuaguugucauuuugcauaccuuguuauucugguaccaaauauuuguuuaaaaaaauggaaaauacaauuuuagccuaaauagucauauaaauggguccuggaguaauuuccuuuacaaaaauagaaauauugauaaacuuaauuauuaaauuauguguaaauaaauauauaaagguuuauuuuaaaaauuuuaacauuuaagguagaugaaggcaaaauaaauaaaauauacugguuugugcacauaaaaauauauuuuauaauugagauuaguaaacaugagcaaaaucauaagacagcauuaacagguagcaaaugaaauauuuugauucuuacuuauguuguuaauuaggcauaagguauccuauuccacaauauguugaugguaaauuuaaaugguugaauaauagcucaacuugauuaaaaauuaacaagcauuucucaacuuugaaaagaauaaaauaucuaagauucuuuguguacaccauguuaauggguaaaguguguggggugugugcauguugugugcucaagauagggaauaguccaaauuucaacuaguauauuuuugauugaauuaauauaguaaauauaaacacaggauauuuggaaauaauuugaauuuucaacauaaugugaaaauuaaaaccuaaauuaugaaaauuuuuauuaugucaaggacauaccaauugagaggcuuucauuaaauacaauccuuaaacuguaaauccagcacuaaaccaauacaauuuucauuuacauacacaaaaaaguguugucaauccuuuauaugacaaccacauauacagugcacaaauuuuaaaauaaaucucugagagugguuugaagcaauacuuaauaguuuaauaugucuaaucuuuugauaaaauuuaaguuaaucuacagggcugggggugaugacuuaaaauccccuuaaauuuuuaguuuuuuuaauuaaguacuuuaccuuggaaaagucauacaacaucucuccaggcaucauuuuucuaauaucuaaguuuuuuuuuuaaugaucucuacagccucuuucagcucuaaaauuauaugaucuaagauacaaaaagacaguaauuuuugcuguacuuuagauaucuaaguaaaaaaacuaaugagcucaaaacaguauuacaaaauucuacuaaccacauacguugaaauauuggguagugauauaguuuggcuguguccccacucaaaucucaucuugaagucacacauguuguggaagggaccuggugggaagcaacugaaucacagggaaaggucuuucccaugcuauucuuguaauaguaaaguagucucaugagauccgaugguuuuauaaggugggguuuccuugcacaagcucucucugugccugccaccauccacuugacaugacacgacuugcuccuccuugccuuccaccauaauugugaggccuccccaaccauguggaacuaugaguccauuaaacuucuuuuucuucacauucucagguaugucuuuaucagcagcgugaaaacagacuaauaacaguaaauugcuaugaguagagugggaugcugcugaaaagauacaugacaauguggaagcaaguuuggaacuggguaacaggcagagguuggaacaguuuggagggcucagaagaagacaggaaaaugugggcaaguuuggagcuuccuagagacuuguugaauggcuuugcccaaaaugcugauagcaauggggacaauaaagucugggcugagguggucucagauggaagugaggaacuuguugggaacuggaggaaaggugacucuuguuauguuuuggcaaagagacuggcagcauuuugucccuaucccagagauguguggaacuuugaacuugagagagaugauuuuggguaucuggcagaagaaauuucuaagcagcaaagcauucaagaggugacuugggugcuguuaaggacauuuaguuuuauaagagaagcagagcauaaaaguucagaaaaccugcaggcugacaaugugauagaaaauaaaauuccauuuucugaggagaaauucaagcaggcugcagaaauuugcauaaguaacaaacagccaaauguuaauccccaagacaauggcaaaaauauuuccagggcuuuucagagguugucacagcagccccucccaucacaggcccagaggccuaggaggaaaaagugguuucguggaccagacccaggguccccaugcuguguguagccuagggacuuggugcccugugucccagcuacuccauccuuggcugaaaggggcuaauucagaccucaggucauggcuucagagggugcaagccccaagcguuggcagcuuccaugugguguugagucugcaagcgcacaaaagucaagauuugggguuugggaaccucugccuagauuucagaggauguauggaaaugccuggauauccaggcagaaguuuguugcaggggcaggccucucaugaagaaccucugcuagggcaguguggaagggaaauguggggucagagcccccacacagagucccuaauggggcaccgccuaguggagcugugagaagagggccacuuuccuccagaccccagaaugguagauccacugacagcuugcaccauaugccuggaaaagccacagacacucaaugccagcccaugaaaucagccaggauggaggcuauacccugcaaagccaugggacagagcugccuaagaccauaggaacccaucucuuggaucagcaugaccuggaugugagauaugaaggaggucauuuucgaguuuuaauauauuauuuuuuugagauggagucuugcuguguugcccaggcuggagugcaguggugcaauuuuggcucacugcaaccucugccucccggguucaugccauucuccugccucagacuucugaguagcugggacuucaggugcccgacaacacaccgggcuaauuuuuuguauuuuuuaguagauacaggguaucacuguguugaaauuuauauauauauaauuuuuuccccauuuugcccuaguauuuucaugaagggcuaauccaauaauacuuccuuacaauuaauuaaaugaaaaaaauucuuuuauggagaaacaugauauaugugcccugaaucgcuuauucagaauuacucaauuuacauuacuuucuuguuucaaaaaaauaucaguaagcaauuuaauaaaauacaaccucaauacaauaaugugcuuauauuaguuuuguauguucuuacauaauacaauuaccuauuaaauugcauauucaucaggcauuuuuucuaaccuaauaugcaacuuugagcacauuuccucaugcuuuuggauuuccaacaaaguccagccuauuucacaguugaugcagugugugaauaaugggauuacaggaagaagagaagauugaauauuuauuaauuugugauauuuccaacaucuccaauguagcuaaaugaggagcacaaaaaaaauguguucaacaugauaccuuuacuggcauuaaacaguuucuccuuuucucucacuuucuuauuuaugcagauaguuaagaugagaauaaaugaaaagagaucccacgcauggaauggcauuaaucaguaaccucucuuuuucucuuaacaaaaugaauacugauaauaguagaaccuuguuuuuguagaggauacuauaauuuucaaagcuuuacacacuaaauucaccaagacauaccuagucacaagaugcaaugaauaauagcaacaaacaaauuacaagggcuaaaaagauguuaagcacacuucuuuuagcaccugcaaauuuguacaaacguuugugcaaaaauucuaugguuucaugaacaugauucuaugucuuucuuauagauucugagcagaacauagaaaacuaaaugguauaaauuuaaguuuauaaauuauaucaauuuuaaguuauacuuaaacaacauccuuucugguccacagucccaugauuugauuaaaauauuaaaggaaaacuugcuuuagguucauuuuccugauacacauuuaaaacucuaaggaugcacucuacacugucauggcugccuauuuuagggucaaagauugcaguacucacauauaccccucuugcugucugguuuauucucuuguaagguggcuauucauuuuacauaagucugucucagguaugguauguuuacacuuuucauuauauccacauauucagauugauaaccacagaucugaaccuaccacguuucauccuuauuucuacuuuauauuuaaccuuuuauuuauggagauccagauucaggucuauucccuacacuugacucuauccccuucaagaauuccuauuaaaaaugugcuuguagaauaacuccaaguuaagauuugcgcuacucuuaucccagguuaauacccaaucucaaaaguuaccuguuuuacccaaaauuuucaaaaucaucaaauuauuccucaucuauucauaauguguugaugaaaagagucaaacucuguaaacaauuggaagaaacuuauuugaagagauuuauucugagccacauauagugaccacggcccaugacacagcccucaggagguccugagaacauaugcccaagguggucagggugcaccuugguuuuauacauuuuagggagacaugagacuucaauaaaacccauuuaagaaaugcacuggcuugguccagaaaggcaggacaacucaaagugggggcuuccagcuuacaaguagauuuaaaauuuuuucugguugacaguugguuaaguuuaucuaaagaccugggauuaauagaaaugaaugccuggguuaagauaaaggauuauggagacccaaguucuucuuugcagggaaagccuuuagguacuaggcuuuaaagagaauaaguuguaaaauguuucuuaucagacuuaaagucuguguugauauuaaugcuugggaagcauaaugaggcauuuucaacccccacuucccaucauggccugaaagaaacagucucucagauuaaauuguaaaagagcccuugcugaggaggagguccauuuagacgguugggguggcagggcgggggggcuuugaauuuuauuuuugguuuacacaugcauucaacacauauguaucaaacccauuacagugaugaaaaauagggaaucuacagccagacuuccugaguuagaauccuguacuugcuccuuacuagcuguaugaccuuuguaugucaccuaauuucccuauuccuucauuuucucauuuauaaaauggagauauuaauaguauguacucauccuagagaguuucugugcauauuagggugacaagcaaaguaaaacccacaaaaguauaacugacauauaaguaaaaguuugauaaauauuaguuauaauucaauuuguaugaguaguacuaauaauuaggauguauuuagcucuugaaaaaaggucauggucucugccuuuguggaguuuacaauccagugaugaggauugauauuaaagaacuuugaaagcaagauguugagcuagaaaauauucauauccggcaugaaauuauuuugucgugacauuuguaguuagaaguauuugccauuacacaugagaaagagaaaaagccccucacagcuggaagcuggccuggcacuaucagccaggcuacaacauuguuagaaguugggcugacacagcugggccaugguauucucuuacugcacacagauaauuucauagaacaccaucaucagacaaagccacuccuugcuaugauggaucuggacaacaucagaccacuacauaaaaauguuugagcacagacaaaacaagaauauugugcaaacuacgaaaaugaccacacuuccccuaucuuggcuaucaccaaugagugcugauucuuuaccaaucagaauuucugcuuuaaaaggaauuguuuagauucacaaacaaagaauuaccccugcuuccugacauuauccaaugcagacaaagcaccacugcuuugaauaugcccccaaauuaccuagcaugaaccuguauccuauaauacguccuuucuaacacucucuggcugaagcaccuauucuucauuuguguuaguuuccuuuguugcaaugugccaauaaaaccaacuuguuugaauaaagaugaguuucugguagucaucggcaggagagcagugucaugcauuuuggcauuuuuucauuaagaauaauaauuuucggaaucagauguucuuauuaauaauuuaaaauuuucuggaguauaacuuauacagcaucagagucaauuaauuucuaaaucauaaauuccucugaauuucucuuguacaaaugggcauaguaacuaucauauaaaaauagggggaaaaaaaguauguguauuuguuaagugacuuaaaacaacagaacaggcauaccuuggagaaacuggaggaauugcagguuugguuccagaccaccacaacagaacaaauaucacaauaaagucagucacacaaaguuuuagguuuuccaguacaugcaagagucacguuuacacuaaacuauauucuauugcaugaacaauagcauuaugucuaaaacaauaauuuaaauaccuuaauuuuaaaauuucagacaaccaucugaaccuucugugagucagaaucuuuuguuggggcagggucaggccuuaauguuaaugguugcugauugaucagggugcccguugcugaagguuggagugguuguggcaauuucuuaaaacaagauaacaaugaaguuugccacaucaauugauacuuccuuucacaaaaguuuucucuguagcaugcaauacuauuugauagcauuucacucacgguagaacuucuuuuaaaauuggaguccaugcucuaaaccaugcuagcuuuaucaauuagguuaauuaaauacucuaaaucuauuaucauuucaacaaugcucacagcaucuucaccaggaguagaucucauccaaagaaacgacauuuuuuugcuuaucuaugcguaacuccucaucuauucaaguuuugucaugagauugcagcgauucauucacaucuuuaggcuccacuuucaauuauaguucuuuugcugauucuaccacauuuguagugagugccuccacugaagucuugaccucuucaaaugcuuccauaaggguuagaaucaaccucuuccaaagcccuguuaauguggauauuuugaucuucucccaugaauaaugaauguucucaguggcaucuugaaugguaaauccuuuccagaagguuuucaacuuucuuugcccaggucuauuaugagaaucauuaucuaugacagcuauagucuuaugaaauguuuuuauuaaauaauaaggcuugaaacuaaaauuacuccuucaucuaugggcugcaaaauaaauguuguaauagcaggcauaaaaacaauauuaaccuccuuguacaucuccaucagagccgucaagucaugagguccauuaccagugagcagugauauguugaaaggaaucuuuucuucugagcaguagguuucaacagugagcuuaaaaauucaguaaaccuggcuagaaacacauacauugucuuccagguuuuguuguuccauuuauagagcacagacagaguagauuuuaccauaauucuuaagaccccuaggauuuucagaauggugaaugagcauugacuuccacucaaaguuaccagcuaccuuugccccuaacaugagagucagccugucccuuaaagcuuggaagcuaggaagugacuucucucuagcaauggaaguaccacauggcaucuucuuccaauaggaagauguuugcuuuacauggaaagucucuuguuuaguguagccuccuucauaaauuauuuuagcuaugucuucuggauaaccugcugcagcuucuacaucaguucuugaggcuuuaccuuguacuuuuuguuaugguuacagcuuucauuuuaaucuucaugaagcaaccucugcuagcuucuaaguuuucuucuacagcuuccuuaucucucucagacuucagagaauuaaagagauuuaggucuuuuauuuggauuaaauugugguguaagggaauguuguggcugguuuuauuuucuauccagaccacuaaaacuuuccucauaucagcaguaaggcuguuuuguguucuuaucauucagguguucuuaaaagaagcacuuucuagaacguuccguuuucuagaacuuucuagaacuuuucauuugcauuuacaacuuugcuaacucacuaccaggcccacccuuugguaaccaucacucuacuuucuaccuucaugaagucuacuuuuauaacuccuuaucuuucaccacauacaaaaaucaacucaaaauguauuucagacuaucucagcuuugauaugccuuccucacuaagcuuacucucuuuuagcuuuugauugaaaaugaaagaugugcgacucauccuuucacuugaacacuuagaggccauugcaguauuaauuggucuaaugucuuuuucuuuucuuucuuuuuguugagauggagucucacaagcaauucuucugccucagccucccugaguagcugggucuacaggcacccaccaccacgccuggcuaguuuuuguauuuuuaguagagaugggguuuugcucuguugaccaggcuggucuugaacuccugaccucgugauccgcccgccucagccucccaaaguguugggauuacaggcuugagccacugugcccggccaauuggucuaauuucaaaauuguuuucucucaaggacuaaggagaacugagaagagggagagagaugggaaugucuggaauguggagcagucagaauacucacaacauuuauuaaguuuaucaucuuacaugggugaaauucauggcucccuaaauaaauuacaaugauaacaucacagaucacugaucacagaucaccauaacagauauaaugauaauuaaaaaaguuugaaauauugagaaaauuaccaaaaugugugugacacagagacaugaagugagcacauguuguugguaaaauuaugccaauagacuugcucgauauaugguugccacaaacuuucaauuugaaaaaaacacaauaacuguaaagugcaauaaagugaaguguaauaaaacaagauaugccuguauuuauuuuuaaagccccaguguuugcuacauaaauauauauucauauuagauaucuaaaaagaaccuaugaacaaauguuucaauuuacuauuucugauugagguuuuuuaacugguaaauauuuuguuuaguuauuuccuaccucuuauaguaaaaauauuucccauauuugugaaauaagauuuuuggccuuuuuccccaaagugccucaauucuaugugguucuauguaagaaucuacaacuuuccaagauccuaaauguacaacaucaucugaaaaugcagucaacauuugcuagaccauaugcuuugaauaaauuaguuuuugcaauauauuagcuagcuggauacugaaguguguugguagugauaugcaaggauuuuucugaacauggccuguagcugaagcauguuacagguacauaguucagucagcagcauuuaaaguaacuaaaucagccuuguaaacaagcaucuguccuuuggcccagagcaucugauuaaaaguguuugaaaaauuacaaauauuuaaggaguaggugguuuguauuugcuugauuacaauauuuaacaauugaauugguuaugaucucagauaagucaccuuucuaugucuuuuuccacagacucagacuaacacuuuauuaaaguuaggaccauuagucuaacauuaggggaaucucugugaaggggacauguaugaggggaaauucuuucuuuaaaaugauagaaagucuauuauuaggucauugagucaaaagauguaacuuggcaccuaggaaaaaauaauauauuucauauauuuauuaucauuagcuauauuuuugugaaguauauuacuggcucauuauuucaaugagcaaaagcugguuuuuaccagcuaguaaucugaucaaauuuuuagggcgauuauaucagauuuauuuaaucagcaagaguaaaauaauuggauggacuaagaucucacacggucuuuugaaauccuguuaccuaauacuuuuuuuuuuuuuuuucacaauuugcucauucaauugaaacaugccuuuaaaaccagcauaaaucuguagcuacauaagugucaguuccacugaaugaucaaaagccuaggaauuguucacauuauacgugucuugacuuuauuagaauucuugauuuuuccuucaggucauauuaaacacccuucaauuuucuggcucauucuuugauacaaagucaugcuagaaacauuaaaucauagacuccgaguaggaugagaccuuagaagucaucuaauacaaccuccaacaaaacacaauaaucucucacauaaugcccuucauaggauuauacuuagauuauaaacucuucaugagcuuagguuuccuauaaaccacagaauuuaaaaaaauccaaagugaguauaaaacuaagcuguaagcaaguaauaaauaaaauaaaagugaaugauucacaucacagugcauuuauuaaaacuuuaaauauauuguuauugugucguugagccauuaauugucaauauuacagcaugagacagcgcaaggagucuccaauaaaaauccuuuuuauuuauuaaaaauaaaggcccaucauauuuggaaagucucaggcauaaaacuuuccaaugccucaccuguuucacucccuaccucuuaaugcuucucaaggacaacucuagguccugagccuuagagaauagcauuuaggaauacagcucuagacugcugguuagccucuuaaaagagacuauuacagcuuaucucuucauucucuacuucaugacaaccaaaaggcaugugucccucagcaucugguauuacccauacucugagacccgcacccauacuugggccuaaaguuacccaagaccccacuuucucauguucuagcccauuucacuucugagucuuacuuauuucucauugcugauuccaggcuacuaucgcuucuuucucuuugagcucacaacaugugauuauauuacacucuuccucuccucuugcugucaacuagcacuccuggucagugggguccagggugcuacaauuuucauuuucaagagaucauuuggaauuuacagaacugucuaagaagacaaguuauauaugugcaguccaaugagagaucagaguagcugaaguaaugaugcuaguaguuaacacagaucaaacagagauuuuucaccugcccccuucuggccuauucucuacaaagagacacauuuuaaaaaucuuaucaugccauuucucugcuuaaaucuuuaaaugacuuccaacuucacuuagaugaaaauaccauagcuuauguauccuaagugaucacagcuacacaucucccuuuaacggaaacuugcccuuucugcccaaugcccacuauaugcugccagacugguguuuuagucaccccuguauguagaucuuucuuaccuaaagcaauucucuuucccuuuguuugcccuuccucucauuccuccucucauucuuuccauggcaagcuccuucugauucuuaaaacucucagcugaaauaucaaaccacuuuuccuacuacucucagaaucagaccacccccaaaccaugcucaacauccauccauugauuuuuccugacacugaaaauuuugcaauuuuauugauguacaugcacauuauuuuaucauuguucucuuucccauuauaaauuaagucucaacuaacauguguagcaaggcuuauaggauuagaagaucaccauuugccaacuaucaaccaauucagguagaaaucauccauggagguuaaaacuaauggauaaaagucugaagaguaauagguaaucacacagugccaacagugcauaauuugaaucuaaucaugaggaaggaaauaacagacaaacucaaauuaagggacauucuacaaaauuaauggcagaaugucaaugguaggagccacaaaaagaauucaagaaauauucgaaauugaaggacuauagagguaugacaacaaaaugaauccccaugaucuuuuauuuacuuuucuauaaaagacauuuuuagguaugugguuugcaaauauuuuuuuuccagcacacaggcugcugucuuauuuuauuguuucuuuugcugugcagagauguuuaguuugauaugcccccauuuauuuaucauugcuguuaucguagccugagauuuuguuacaauaucaaaaaucauugccaaggccaauguccaggagcuuuucucucauauguucuucucacaguuuuauaguuucaggucuuaccuuuaggucuuuuauccauuucugaguugauuuuucuauguggugauuugauuucuuauguagcuuauaaaguaaauuuugauguaauucuagauaauaauaaugccaaaacauuuugggacaacagcaacauuuucgggaacuacuaauucccaaggugguagauacuaauaguagucaguuuuccuugagugccugccauacguaauauauggcaggcacuuugcuaagcugguuguauggauuaccucauuuauuccucacaacccuguuaaauguauacuauuaugccuauuuuugaagagcacaaaauagguuuagauaauuuuguuuuuaguuugucaaauguuuucuagcucucaagggaacuaaggaaauuagagaucuuacaccauucuaucugauuccaaggaguugagauaaggaauguaauaugggaaacuaagaaacauggaggauuuaaaugugcaagauuggcacuuagcuggcuucuugauaguggggauauaaauuuaacauuucugagccuguuucuucaucuacaaaaaagaaaguauuaugcuauuuuauugauaugauaagcaaguuuuaaaauaagguaauauaaaaaagacauagugucuauaagagcaaaguacaagggaaguacauaguaauaauacauaacaguagccaacauuuguuaugaacuuaauauagaugaaguguuucauauuuaaucuuuacagcaauucuuugaaauacaucuuuuuauuauucucauuucucagaugaggaaacagcucuuguaaaugagguugaauaaagguagcaauaccagugaguggcagagaagugauuacaacucugauccagcugacaccagaaucacccaucuuaagcacuauuauaugcugauuauuuauuuuugguuaauauuauuuuauaaacaagucauaauuguauuacauuauggaauacagugugaucuuuugauguauguauacaauguggaaugauuaaaucaagcaaauuaacaugcaucacucaguuucugugguaagacguuugaaauuuacuuucuucuuaguuucuuugaaauauauaauacaauauuauugauucuauuguuguggaauagauuucaaauuuuauucuucuugucuagcugagacauauuaccuuagaccaggaacuuuccauucccucaccaccaccaccaccaccaccaccagcaccacccagucucuguuaacucucauucuacucucuacuucuuaugaaaucaauguuuuuuaaauuccacacauaaaugagaucauaugguauuugucucucagugccugacuuauuucacuuagcauaauguucucuagauucauccaugccaucccaaauaaaauaauuucacccauuucuaaagcuacaugauauuucacuauguauauguaccauauuuucuuuauccuuucaccugcugacagacacuuagguugauuucauaucuuggccauuaugaauaaugcuauaaugaacaugggagugaagauauuccuucaacauacugauuugguauggaauuccaagagauggauuugcuggauuauaugguaguucaguuuucaguuuuuugaggaaccuccauuuuccauaauugccauacuaauuuacuuucccaccaacaauguaguagauuuccauucucuccacauuauuuaugcugcuuauuuuuugcugggaaaccacuacucuuaaaaauugaugaaggaauguaguaggaaacagggcagugggucaacagccaguuuagauacagacuugaauguaucaguuuuaaaauauauucuguguaucaguacuuugaaccgggauuacagggggagucucacucagagaguugaugcauauuuaggacaggauagaaaaucuugacagguaaguaaucauagccuauggcagaaauccagacgaaauaaguaaauauuuucccuuuguuuuuggagcucugcacuucccucuguuacuaccacaaaaaacuacucucuacuucugcugaacacaggugguaucaucaguaagucucuuuaaccacagagacauagccaacagugauucacccuuuaaagucuauacuagaccucuccucaaugaaaaaaaaaucuuuugauuuuagcuaauaauaaucucuacccuuaaugacuuauugcaacauucauuuuuuguuauugaauaauacuauucuguauuggauauaauuauuccacauaaauaaauuugaagggaaauaaucuauaucaaaacaacuaugcuuuaagaaaguuaacagagguaagaauugacuuuaugaaugaauuacagcuauuuuuacacguguucuggugaugaacauaaacaucuugaacucacucaacuuugcauaacagaaaccuguuuauuucuuccucccuuccuuucuuaguucuuuuaaacauacauuuagcaugcuaacuuuugcagaggcuacaagcaguguuuaaaaugcuuaagcauguucauaagaaaaauuaugaaaaaucuuaccaugaguguagaaauguaguuugaugauaaucuuuuuacuuuuuuauaauuugauauuuagacacauuauacugcacuuugggaggcagagguggguggauaacuugaggcuaggaguucgagaccagccugggcaacauggugaaauccccaucucuacuaaaaauacaaaacuuagcugggcauaguggcgggugccuguaauccuagcuaccuggggaguugagacacaagaauugcuucaacccaggagguggaggcugcagugagaugagaucaugccacugcacuccagccugggugauaaagggagauucugucagaaaaaaaaaaaaaaaaaaguaaacuuaauucuagacacaguaauuaauaaaauucacuuuaaaaauguguuauuuugaaaauuuuguuaaaaaauaucacaaccaaugaacacuaagcuaaacccuuuuccauaugauauuuuaggaacauaguauguuauuucaauucaguauaaaauagaagucuaaaugacaaaauaauuuuuaaaaauagcauauucaaagauagguauccagaaaaaaaaugaaucaccguaaauuguguguuauaaaucaucaguaauugaccauaguuuaauaauccuuucagucauuguguaucaauuuugaagaguguaugacuacuuaggcaguagugguuuuuuucucuuaucaaacauguccuccuuaauaguaaguuucauguuauuuaacuaaaacgcuaaaggugaccuucaagaguucuuauuguucugaagucaaaaugaguucauacuuuuagacacaccucauagcugaaaaauuuuguccuguuugagagccuguaaaaaaugcagaagacacuagaauauuguuuaaaagacuuccaaagauaugcuuaagaucacugcucuaaagcaauucacauggggggacuuguuaaaauauagcuucugauuugguacaucugguguggcaucuaauacucuacuucacuagucagcuaccaggagacacugaugcugccacacagaguguugucugcuggccauacucugaguaguaagauuuugaaagcaaugcccucucagguauauucacuuaacaguguaaaaauuaaaaauaauugucacucaaaguuuuuuuucuccucucucuucugaagaagggaauauaugaagucuuguauuagagcuggauaaaagcuguggagucagacaaaacuuugaauauugacuguaaacuuggauaaucgaccaaauguuaaaauaauaucuacuacacagggcugugauacgacguaaaaaauaauauauacaaugacacaauuaaauucagaaaauacgaaucugacuccucacuucauaauuaccucaaauuauuuuauccuaaaugaguacaauguguuugguuucugaaucuuuucuuguuuugauuuaaaacuucuuaggucucaaaaaauauccuuuuuaacuucugaaaauauuucaacuuaguuugaaauagguuuguuuugguuaguuuaagauuguuuaaaugagaagauuuaaaauauuuguaaugcuguucaacaacaaaaauguaaaauaauagguguaacuauacauuuacaaagaaaacugaaauuuauauauauuuaugagaaucuguggauuuaauuuaauuaaauaauuggaaaauacaugcuacagacauucugcaguauuucaaaauaauuuuagaaaaauuuuuggaauaaacagagcuuguuuuaagccacauuaagacaaaaauguuucauuauuuugcaaucuacuuuguuuuuggcaaaaaaaaucauacuucccacuuugaucacccacuuuauucaccaaauuuggcacauucuaacuucugcuaauagcaaaaacagaacagacucuuucuguuugaagauuugcuacuguugagaauuauucauaguacagcccacagaauccaaagauaacaccaacacaagagcccaaacagcaugagcaauggugacauuauuguauuguuuggcuccuaugauaacuacugugaaggggacaucauucaugccaauaaaccagucugaguauguuguucaauuacucugauuuucuaagugucucaccucauauuuuuccaucuggguuugaaugagaaacagaaauacuuggauuuuucucuucucauuauauuuccagggcacucucuacaaauaacauaauacugcagaauuugcuagcauuguaaccccugccacuccucuaauuaacugaguugaugauccuagaauggaaagaggaagcugcauuaaaaggcagaugcucaguauaccacauuacuguugcaaauucucuggcauuuauggaagccagaagcccagauuacaagaaucaugcguacuugaggcccuuccacuauaaccaggacacuggcaacaaaggaauuuggagacuuaaaaaaauuuacaacagaugggcaaacuuuuuuauauccacugacccucgcaacuaccuuuccaaccuucccccaucacaaccuacuuccucugagauuguccagguagaguuagcuacagcagcccuguuuucuagaaaugaccaugccagauggcaccuucagaguaugaacaccuggauccuaaaaauauguacuagauacagcaauacaagguugugaaaaucauccuugagauuuuuacuguuucaauuauauaaaggcuuuccagaacuuuuguucugauauacaauuuacauacacaauuuuuuuucuaauauacaauuuacauugaauauuuccauauacugauacacugucuucacguagaguuauuuaauugaacuauuauuuuuaauuucagaauugcuuuguccauuuagaguuuaguaggaacauguagaaugacuuaccugcgaagguuaaauaaaguauuuguuaaguuauggcucugauaucagaucuuuuaauucaauuugccuccuagaaaggucauuugaucucacuaagcauugccuuauuuaacugugauugaggguaauaauaguaccuaaccuaauggaguuuuaguuggaguuaaagaaauauaaaaccacauuucuuaagaguccuugguacagaguaaacaauaaauaaaaauaauuacaaaacucaguuauggguguguuaaagaauaaaaaaguagaagagaccuaguccuuacccucaagcaacuuaucagucaccaagcaauuuaaaauagaacacaaauauuuaaccuagaaaaauaucuauaucuuaucuauaaaaaugaagacuuacaguugauauaaaagggggaaaaccccacaaaaguuuccuguggagaucacuuugaaucaggauugccaaugugauuuuuuaagagauaugggcucugaaagaccugaugauucccuagacucaauauggucuuccauaccucugcuucuucugccccaaucccuuccacucucuaccuaguauauuccuucuuaucuuucaagacuccauucaaacaucacuaaucuuaugaagccuccaugauaccguugaacaaugcuggguggcuguggaaugugacucuacuuucacuugucucucauugcuuuaaauuuguugauaugcaugcagguguucccaucagacuaugaauuuuuuuaggaaaagaaccgcauuuuuuuuuauuauucuaugucuagaaucuggcauauggcacucaguaaugguuugguuuuguuuaucugccuguguuuuuauucgaacucaugaaugcauaaacaggcagaggcagcagcacacaggcuaauccuagaagaaucaaaacaauuuuaugaagaggacaaggagugguggggguguaucccagcugaaggauaaagaugcagaaaagagagagguagggcacaguuaccuccaacaaguugucuuggaauaguaugagauuaaaaagagaagcuugagccagaauaaagauuguggaacugcauagguauaaaucuagagccaauguauugcuuauaaauaacaguaagggaaaacuagguaaagcucucugcuuaauuaaauauuucuccuuuucucccuuccugucuucaaauacuugcuguauucauagaauuucuuucuuaucuccagagggagauuaggcugcccaaaccaaaccauuaaagguaguuuacaaagaaauacaauucagauagaugagaauucucugcucaguaagggauuuagaaucacaggacugcugccucugguacccaacuauaaagauuuuuuuucagaaauagucaauaucauaggucacauauuuuaaaauucacuugcaauuagaagccuaagggaaauugccuaggaaaaaauguuuuggcaagcuuuuaaagccuuucauugaguuggcaacuagacagaccaugcuggccucccaagcaagcagagcaggugugccacuucagagaugguagaaaggcuuccaauuccuaaacacccgucuaaccugccucucaguagcgccugauguuucuggagcagagaugcauucccuaguguugaggggcuaugcucuauugaaaugcacaaaccucuguaagaaggggagaaagaguaagcauaacacauguuuaguaaaugcaaacugccaggcauugugcugggcuuuuccugugcauugugcugggcuuuuccugugaauuacauccuuaaacucagcccuauaaauuauaucuaauuaucugauuaacagaugaaaaaguuauaggucagauaaguaacuugccaacauucaugcaaucauuucaguauggagcuagaauuuaacuuuaggacuguaugacucaaaacuaguuucaugcuauuacuuuauaaaguuauuuuuucaaucuuuuugaucacagugguccuaagcuuuccaacugaucauuagauggaaggaagcaugcuuugguaagagaaagaauagaagucacaugagaacacuacauguuggugaguacugaaggaagagggaccauaaaaucgugaaagaagaacaaagaacaaaaacuucacuacuuaaaaauuugguaguuaguuaaggccaaccaaacaggauaucagcuuuccucuacuaaaaaauuuaacuacaauauuugucuacacauuuuaagggacuuauucauuguuuuccauacagaaaaauguugccuauguaaggcuuucuguguauuuagacguauguuacuauuguucaaaacaugaaauugcaauuaguugauacaugcaaguacauaaugcaaaaaaguaugcauauuagaauacagcauacauauaugacuucuauacuaaugagaauggcacauauaugccuuacauucuaauauguauauuagaauauauauucuaacauucaugauuuuucuuaucaucaaaugaaauagaaaagccuuuucccaucauuacauuuaccacauuucuguuugaaggaacacaaauucauugguaauaaguuaguaguagacuaaugaaaucugcauaaaaaucuagcaauuggcacaaaguuaucccuuuugauauaauucacaauaaccauauuauaauuuuauuuagguuauaguauuaaugaaguaccacugauauuucccuuaaguucccaauguuaucucuaaacuuucuucccauuucuacuucccuaauuccucuuccuugaagaauuucuaaaauauuguuccccaaguguuucuguguucuuuuuauucuuuucccaagugaguucauccacugccaggacugcaagagauacucauauagcuaagcuuuuauuaacucuucccaaauuucuauauauucaaucucuucuucuaccaacuaacucuccacaauauguuauauauaguauguccgaucagauauguacaauacagaugcaaccauguaauuccucuccagugaacaacaugaaagcucauuaccgcucucagugcuuugcacauucuugccuuuaucugauaugccuucuaugcucuaggcaucccagacagacugcuuagccuuccuggaacccaucaugccucucuguuuugacuugugcugguccuucuguuauuuucuucuuuucuccucauuaaaucccuucucacacuuuaaguccugucugaaaugccaguuauaccaugaaguaagcuggaauguuacuuacaccaugaaauacacugaaauauuucuaaucacaucagauuuuccuucaucuaauacuuugucuauaacuguguaaugaaacuugucaaauaugucuuauaacuauuugugaucauguuauuugugaucagcccugucuuaauagagguccagaaggagcucuguuuuaaugacuuguucaauauagauuugucaaauaaauauguauuuuaaaacuguauuuaaaauaucauauuuuaaaauacugugacucaaagaacuaacaagagaaagaacagucaacuacucaauguauuuauauuauaaauaagccuuuaauuaaucuuuuuauuauagaaaauaauucuaacuguucaugucaucauacagaaaaagcuuguauuauguauuuauuuaacuaauaaugugaaaauuauauaacaggcaaguguaacauacuaaaugaucauugauacuaaaugaucaaauuauauguaugaauggcuauuacaaaagcaacuguauauccuuuuccuuaccaacagagugaaaguacuuugaaauacagguaaccuaccugggaaagcuaagagagcagauuuugaauuauuuucaaauuuuaaauauuauuuuguguuucuguuuguuuaacucagaucuguuuuauuaucauaaacauuuuggcuauuaguauacuuaaacucuagcuugaauaugguuuuaacaaaauaugaaauauuaauguucuaguuuuuccuaaugauuuaaaugucuagaauuaaaauugcagcaaauaacugcaaauugaccuucuucccaggcacuuaccauuuacguuagguauaauucauuuaaaauuuagcagaaaggcauuuuuuuuuccaaauagaaguauuuuuaaacagacacuugauccaaaguuuggaaauagugucucagccuggcaccauuacccuaauccucuuuacacugugucuaauauagacagauucacacugccuauagguuuuguggauccgugcauguugcucuuagaaaccauaauaauuugguaauuugcugguuaaagaaaagaauaugguauuccaaccuugcuagaucauaguuuguuacagaguaaugauuucauuuugcuuuauucacuuccaaaauguaugacccaagacaaauaccucccccugcacaucaauuuuuaagcauguuucuggguuggcuuuuuguaaaauuucaauccuuuuugcauugauuuuuucagugcauuaguuacuauagaaacaaugucacugaaauaugaaaagcauaguagacacagcaaaacacaguagacaauauauuuaaauaugcauauagguguaugugugucuggcuauaugauauauauacaugcauaaacaucuauacauauauagauacaugcgguaugugcuugaguguguuuacugcacauacacacaaguacagaguauuuaucuacauauaaauaugguuaauacauauauguagcauauauguaauaugcauauaaauuuuuuauggcugagaaucucauaaaucagugggcauguauguuuuuaauauauaaggaaugcauaaguuaguaaaagagaucauuaaaauagaacguuuuccuaaaccucuaauuuuuaaaaaauauauaaauauauagcuaaaggcaaagaacaguuuguuuugcacuuaaaauagugaacucuaacauaagaaaaccagaaaauauauauacaaagcagaauuuuaaauuuugcaucaaauacaauaaaacuauuguuucagaagaaccaaaaaaccccaauaaauuuggaggaaauuucuuuacucugucauuuuauauaaaauuuuauuugaagacacauuuuuuuaaaauaugaaaguuagcaaauaaauuuccccaacuuaauacaaagaaauauccucaauaaaagaaauaaaauguuaugaccaaguauaaauauaagaucuagauuucaaaauauuaugaaugaaugaauggaugaaugaaaugccauuuuauuuagcauuuuaguuuuugaaaauuauaaccaguguuuuuuucuccuucaacaaucugcacauggagaucaacuuuugcauauaguuaacaaaaauuuuacugucuggcauggcuauagggcugaaugagaaguuugugaaaacaaguugaaauacauauaagagaauugaucugugucacauaccugauauccuauaaguacaaaugaccucaauaaauuccagagaacaggcaaacccuucauaguuuuuaucucuauuuuacguaucuuaaaacuucucuauauuuggggaauaauuauaaauauugaaacugagaauuaauuuguuccaaauauuuuuguuguuuguuuugaaaaacacucuguuaggaaagcagcuugaaaaaggguagaguuuuggcuuauaugucauaacguaaaguuaaauaguguaugagaguaagucagcucuguuagcacacauuacccuuaugaccuuuuuuucuucauaguaugaaagucacccuaaaagaaauuuaaaauucaauuauuuaauuauaguuguaguaacauuuuaaauauuuacuucauaaaaaucuauagucuaaaugcuaauaauugcucaagcacacaauauaacucuagcuuacuacuuaaguaguaaaauuuugcaugccuauguagacagugccuauguaaaauuaucaauuaguccaaggaaauaaugagguaaaaaaaaauccauuucaaagaagagaaaaaucuacagccauucugagcuauguaucuuuuuagaaacuacauacguaauguggccauggcugaaaacaucuccaacuuaaaggagcuuacauucuagagagaaaauacagaugauaagcaugaaaacaaauacauuucaaaaaacagcaucauauauugaugauuagaaaaggcagcuugagcuaggauaaugaggaggagucgccaugagugagugacaucugaauugauuauugagugacaagaauaaggcagcauguaaagaucuuaaaacaaggauuucaagcagggcacaauuuucagaaauaaacuuugcgcagaagaacuucauaagcaauuuucuaaaugauagcguaauaaaggugggaggugguaaguucagaagaaaaguuucauugaccuauaaguccccuuaagauuucucaucuccauuuugucuguauuauguuaggcaaucaucacagcaguaucugcuaauucuaacugucuagacaggucuagggcaacauuaaucauaaauaauugaaccaaguuuguuuuacuuucuaugcuauauaauugacauacaguuggcauauaauaaauucugauugacuugcugacacaaucuguauaauguauaaaaucuaugucuccaacaaaacuaauucauauuuacuacugaaaaacaaaauaauacccagagaagaguaauauauucuuuuaaaauuagcuaaaacauuaagaaaaaguaaaaggcaugaaagaauaccagaaauucugacugcaaaaacagaaacaauguaauaauacucaggaaaaaaauaagauaccauuucagaaaugaagacuucagugauaucagcaaaauuacagaguaggcagcuacaagcucauguaccccacagaaacauaaaaaaaccagcagaaacuaucaaaaccaaauuugucagaacucuauaagacagucaaagguucacagcaaccaaguaaaugcugaaaccagaaaaagucaacuuaaaaacaguagggaagcucuauggcauauuuaucuguccucgccccacucauugaugguuggguagcagucuugaagauauuagcccauguucccagugaggaacgcuggucccugguucuggaggcagcagagcagagcuuuuucacaaauuauuguguagauauguucuaaccugucugggagcuaccugaagagccagcacauggcauuugucucucuuuuugccuaaaucggaacucacauuggaaaaguuucggcauuucuugaaaacauugcaaggcugcaaaacauucugcggaugccugaggcaaaaguuuaugguugagaaauauaauagacagcuuaaggcuuuggcagaaaaucugagagggaauuuucuugggaaauuagggcaaucgauauggagguuauggaaagggcaauuaggaagucaugugcgugaccagggcaugacacauguugagaaaugacaaaacaagauguuaagcuuuuaacuugggcugauccauauguucagugcaagucugguuaagcguugaaggaggggccccacacacagccaaucuggaaaggcugguaaagauggcuauuuguguguuuauuuguuuuagauuuuaauuacugguguucaagaaaacuucuguuuaaacacaagcuaaggaacagagacuucaaggaggcacacaagacgagaaauauggucucugcaaaaauaguuuggaaaagucacuagacaaaugauuagagacuccaaaaacaaaaauaacaacaaacccugaggaaggaggagaauuuaaucuccacaguuaccacauuuuaauauuuaaaagucaauuuuucaacaaaaauaaccucauaguguauaaaaacaggaaagugcagccauucaaaggaagaaaguaaauagacagaaaccauacuaaugaagcccaaacacuggaaaaacuagacaaagacuuuaaaacaacugucuuuaauuaaguugaaaaaugaaaaaaaaaauugauaaagcaauaaagagaaucaggaaaacuauguaugaacaaaacaaaacuaaaaguaaagagauaaaaauuauaaaaaauaaccaaaaagaaauucuggagaugaaagaguucaaaagcagaauugaguaggcaaaagaguuagugaacuugaagguaaguuaauaugaacuaucaugccugaggagcagaaagaaaaaguaaacuaaaagcuuaaggaaacuguaggacaaacauacagauuacugggaguaucagaagaagagaaagagaaagauauaauauuuaaagaaauaauaacaaaaaccuuuagccaaaacucaaacuugauggaagacacaaaagcaucuagaaaucugaaaaaaacuccuacuagaacaaauuugaagagauccaaaccaagacacuuaauaaucaaucuguuaaaagcaaaaguguuuaccauccagaacagacaaagaacaccugcuacucaacaacaacaaauuuaaacaacccaauuaaaguauaggcaaaagacuuagauaggcauuuauccuaauaaaccuacaaaugaccaauaagcacaugaauggauguucagcaucauuaguuauuagggaaaugcaaauuaaauccacuugaaaugccacuucacaccuaaguggauuaguauaaugaaacaacaaacacaaaaagcagaaaauaacuuguguuggcaaugaaagcaaaaauugacugaugggauuagauaaaacuaaaaauccucugccuagaaaacguaacaaucaacgaagugaaaggaccaccugcagaaugggaaaaauauuugcaaacuauucaccugacaagggauuaauauccagaagauacaaggagcucaaacaacuaaauagcaaaaaauauaauaauaauaauaauaauaauaauaaaauaauccaauuuaacauuuggcaagggaucugaauagacauuucuaaaagaagacauagaaauagccaacagguaaaugaaaaaaauagucaccacuaaucauaagaguaauguaaaucaaaaccacaaugccauaucaucucaccccaguuagaauggcuauuaucaaaagacaaaaaauaaaugcugccgaggauguggagaaaagggaaaucuaauacacuguugaugggaauuaguacacccaguguggaaaacaguguggagguuccucauagaucuaaaaauaaacuaccauaugauccggcaaucccacuacuuguuauuuaccugaaggaaaggaaauaaguacaucgaaaugauaucugccccccauauuuauuguagcacuguuuacaacagucaagagauggaaucaaccuaaguguccuugaacaaaugaauggauaagaaaaugugguauauauacacauuagaauacuacugagucauuacaagaggaaauccugucaucugcagcaacaaagaugagccuggaggacauuauguuaaugaaauauaucaggcacugaaagauaaauaaugcaugaucuuacucauauguggaggccaaaauacuugaggacacagaaguagggaacagaacugugauuauuagaggguggaaauaguaaaugggagggaagagaagggagagguugguuuauggcuacaaacuuacagcuaaauaggaggaaaaaguucuaguguuucauagcacuguagggugucuauaguuaagaauaauuuauuauauauuuucaaguagcuagaagagaggauguugaaagaucccaacacaaacaaaugauaaauauuugaggugaugguuaugcuaauuaccuggaucugaucauuauacauugcauacauguaucaaaauaucaaccucuaccccauuaauaugugcaauuauuacaugucaauucaaauuaaauaaagcuuuuaaaggacuguaauaucaaguuuuuuugagaaucuggagaaauugaagcauucauacauugcuuguagaaauauaaaauaaugcagcuguuuuggaaaagaguuuggcacuuccucaaaauguuaaaaauagaguuaccauaugaaccagaaauucuacuccuugguauauaccuaagagaaauuaaaacauauguccacacaaaaucuuguauacaaauauuaauagcaacauuaaucaugauagccaaaaaguggaaacaacccaaauuuucaucaacugaugaauggauaacaauaugugguauauccauaugauaaauuauuauuuggccauaaaaaaguaugaaguacugauacaugcuacauaacggaugaacuuugaaaauaauaugcuaaguaaaagaagccagucaaaaaagaccacguauuauaugauuccauuuauaugaaacauccagaacaggcaauuuauugagacagaaagucgauuagugguuuccuagggcuuggggcauuuggggaaaauuggagugaccacuauuaaguauagacuuccuuuuggagugaauacauagucuaaaauuguaaguaaugguuacacaacucuauguauauacuaaaaaccauugcaguauacauuuuaaaugggugaauuacaugguauguaaauuauaucucaauaaagcuguuaagaaaauguaauuuuuaucacaacauauuaugcuuuaagaaagauagaagggaagaaggaaggaaauuuuaaacgucaacaaacaaauaaaaaguaacagauucaaaauagauaaauauugaagauaggcaagcaagauucaauauacauauauuauguuacccuggagacuaaaaugaaaguaaggagacagaacaaauguuuaaaauuauaauucaagaaaacuuuucugaagugauuuuaaaaaugugaaauuguacauugaagagcacacuaucuaucugaaauaaguauccagaaagacugauaucaaguuaaauucuuuuauaaagaaagagagagaguaguggauauuaaagaauaacaauacauccuuugggcauuuguuggaggaaacagcaauauaguuauaagggaaagaauagcagauuaugaguagacuuuucagcaccaaugcuuuaugccaugaaaaaaugagguaauacaugcaugauacuaaaaaaaaugacuucaacaacugacauucagacaaucaaaaugaguagcaagacacagaaaaaugaaaagguugugagcacugaccuacggucacuuauagaacuaaaggaaaaugaaaauuagaauggauuguaauauguaaugguuauaugccuucccaaaaugcauauaguagaaccauaaaaaagagggagaaugcuacuuuuucagagagaaauuugugauugggauagaagcagguggaagaacuuaaggguuacugguaaaauuccauuuauuuaccuugaugugguuaugaaaguguuuggcuuacaauaaauuuuuaaacuauuucauuuuucauguuuccuuuucauuaucuguguuuuacuuuauaauaaaagauuaaaaauguuuuccccugcagauuauuccaaacauccucaauuguauuuuuauaggaauacaaaauauuaaaauaccaucuauuuuuaaaaauauuucccuaauuaaaaucuuuaauaacagaugauaaauuucucaaaauaaugcgcuaaaauguauucuucauauauuuauuugaguugcuuauuauaaaauauuuuaaauuucauuuuauuuuaaaaauaaaauauguuuuaaauaaaaguaaaaucuugauauacaaaaauaucaaucaucuccccuuuacucacauuuauauauuaguuuaauuaauuuccccuugcacacuuuauuauuuaccaauauguauaguuaauaucugucacagguuaauaauagacugacaucucugagauaauaauuggcauuauuaacuugacaauugaucacgugcauacucauuaaaaacggacaagucaauuauuuugugauaguauagaguuagacaaacuuuuagucauuuuuaguccauucugcuuaggaagucauuaaaacuacccuaucucuuauaaacauauaauuguguuauuuuccauguuucacauuuucaaauuguuuaacauuaacuuuuugaaauauacuucagauuaaagcuugguguguaguuuaaaaagccaagaauaauaacauuucuuuaucaagaaucuuacuagccagcuagccagugguggucauuaauaaaaccucuccaucuucccauuacaauuaaucauaggcacucaaaaaaaaaagcacucuaguauugguaguuucccacauguucaauuaauacauguugcauuuucagaguacucucuuagguccaccaauuuaaggccaacaaagguacuaauuaauauuguaauuaguuaucuucaaucucuuuguuaucuacccucugcuauuaaauuucuuucuacuauaauuccacagaguuuguuuacuuaauuuaaacuggacaacuuuugguuguuaucuuuaccuugcuuagggccuggagacguuauguguuugggugcaagaucucauaaacuaugucuuaauaccugaaacuuucuuaaaauaugcuucugcaauuaggaaagauccuuugcaaugcauuaugaaugaacuguaauuaacauaccuuguauuucuacaccccuauuucuuucauuuacaccuagccuaacagguauaaagcacugauuuaauuauaagaaagcugaaacuagcucuuuuagcucuucagucuuucugaaauaaacauaauuuaacugaauaaauucaaacaugccucaggaacucugaguuccaacuuuuuucccuaacagugaauacuucuguuaucauaucauuguucuuucugugaaaugaauacuaauucuacaucccugucaaggaaauaauuugaaaaucucuuucacugaaaaugguuuauguaaaaugcuuggaaauauaaaaucuauaagguugaaacguuaagaacuagaaggauucgccuaaaauauuaaagucuggucaggcaugguggcucaugacuaaucccuacacuuugggagaccagggagggaggaucacuugagcccagcaguuugagaccaacaugagcaacauagugagaccucaucuccacuaaaaauuuuaaaaaguaaaacaaguagccaggcaugguggcacaugacuguggucccagcuauuugggaggcugaggaaggaguaucaguugagcccaagaauuagagguugcagugaacuaugacuaugccacuguacuccugccuuggcaauagggcaaauaaucggucucaacaaaacaguuaaagucugcuacuauuacuuauuuuauaaagcugcugcuguuuucagagaugauuagcuuauuucauaaaacguaauauuacaauuacguaauauuacaauauaauauuauauucauauauuaaugcacuaauguaugaaaggugucucuuuucauaaaucaucucaaagaacagaaaaacucuguucuuuguucuuaacaagcuaagccucuuauuuauaacaacuaucccucaaucucgccuuccuauagguuauaccaauguuucaucuuauguaauuucugagcacacaguacaguguaaauguuuuuagaucucaauacuauuauuaagaaacaacauucugcauuguuggcaaauauauaauagaauccucuacccaaaauaaagguccauauucauuugaaauuaaugguucugucaaccuauucuaaguauagcuagaucuucaagccaaguauuauucauuacacuuuucuguacuuaaaucaaccagagaaguaaauaggcucauccucaaaauauugauuaggcauauauguaacaucccaaaguggacacauauuguuuaucucacuagcaaauaagccaccacugccauaccacaauauggaggcauaucuacacacacacauauugcaugugcauagccucacacacacuuuauaauuucagggaauaauuaucucuauuccacacugaacuauccuaauauugaaugcuauuucuagucauauauuuauuuaaaaugaacucaucauucuuuggccacaauuuuuugguucagggcuaaaaagcugacaccagcuuggcaaaucaguugcuccucagaaacuaaaauuggaugagagauucuaaucucaaucugccagccuucuggaauaagagagaaauaaacuugaagcuauuggcaguggucauuuuccccauauaagcaggaaagcagaacauauuuucuggacuaagagaaaaaaugugaaacauucagccuaggagaaguaucaaaagaugaugagauagauagagagacagaugcauaaugagagauagauauaugcauaaauacauaucacuugcaacuaaaauaauuagaaguaaaaucuuuaaaucauuaaacuaaaagauggaaacuccuuuaacuuaucaugaauuuuuuaauugcauaugaaauuuuuauauucugauuuuauuaacuauuccaauggaaugggaaaagaguacaaauguuuacaugaauauucgaacuuuuacugcaaaauauuguugauuuucucccugauauuguauuuaaaguucaggaaauaggcugggcacgguggcucaugccuguaaucccagaggccaaggcagguggauuacuugaguucaaguaccagaccagccugggcaacacagugaggcuccauuuccacagaaaaacacaaaaauuggccaggcaugguggugcuugcuugcaguuccagcuacuugugggggcugaggugggaagagcaguugagccuggcaggucaaggcugcagugagccgagacugcaccacugcacucuagccugggcaacagagcaagacccugucgcaaacaaaacaaaacaaaaaaaguucagaaaauaaaauaugagucaaauuauaccaugaaugaaauauaauguuguaaggcuuguuagaaacaagagaauaaaauuuugauuucucagacuugugucccuacacaagauaaacaggacaaaccaauggaaaugagaccucuccuccuuugaauugaucucagaaggauuuaaaucaauaacacaauagcuguugcugcugcugaugucacuuagggaugaaaaccagugaggagcugacauggcuuauagguaagagcugauaagguagcacuaaaguaaguaguuucccaaucaguaguggugcuucuuguuuguucagauuaugcuuuuugacacgaaaugucuuucccaagaaguaaagugagguacauaaacauauaaauuuacucuauuaccuguaaauuauuaacaacacuuuugauaagucacuuuguaucauuuguauacuaaaaagauugaugauugaauaugcugauuaugggguuaauuaagaaaccaaaaggagaaggcuaacgaugcuuacuuucaagaacuuuuguguuuuaauuuacaagagaccucaagauaguuugugugauggucaaaaaaguauugggggcuuuuuucaucuuuaaauaagcagaagauauccagaaacuggcaauagcaggaaaucguuauagauaauuuuuaaaaaauucucugugaaauuucaaaauugucuuuaccauaauaucauuuaugacuuagaaagcugagaugauuuucugcaauauuuaaccauuaaagguggugucuacacuuuuacacuccugguagaaauguaaaucagaacaaccacuauggaaaacaguacgaaguuuccaaguagaacuaucaguccauccagcuaucccacuacuggguaucuacccaaaggaaaagaagucacuauaugaaaaagacagaugcacacacguuuauagcagcacaauuugcaauugcaaagauauggaacuaaucuaagugcccaucgaccaaaaaguggauaaagaaaacaugguauagacacacuauggaauacuacucagccauaaauggaaugaaauaauuucuuuuguagcaacuuggauggagcuggaagcuauuauucuaagugaaguagcucggguauggaaaaccaaacaucacauguucucucuuauaagagcuggaagcuauuauucuaagugaaguagcucggguauggaaaaccaaacaucacauguucucucuuauaagagggagcuaagcuauaaaguuguaaauguauaagaauaauauaauggacuuugggacucaggggagaaagcugaaaggagggugagggauaaacaacuacauauuggguacaguguacacuacuugggugacagguggacuaaagucucucagaaaucacugcuaaagaacuuauccauguaaacaaaaacuaccuggacccacaaaacuauugagauaauuuuuuuuaaaggugguaucuaacucccuacauuucaaaaaaggccagccuuagugacuugcuucuaauaaacagaagauggcagaaggaaggcuaugugacuucaggggcaauaaagcuucccucuaucucuuugggacauucaccugagaccucagacaauacacuauguggaauuacagaaaagccacagguagguauucuagccccaucccugaugagguuccaacugaucugagcauucaccaccaaugagcaagcuggcagaaaauucuagccuguagccuuugagcuacaccacucgaauccgagugaagaaaggaauaguugucccugucgagcacugcccaaaucacagauuccucagcaaaauaaaucuucuuguuuugagccacuaaguuuguaaggaaaaagauauuuugcagcaaaagauaacuugaauagaaaccaagaaucuuaaaaauguuagguaauaaagggaaauauaaugaugcaauacauguaaaacucauagggaagaaagugguuaguuaagaauuucuaagcccuuucacagugguccucaauuaauuuuauacucuaaauacuuuuauuuacaaauaaugggcaaauaacacauuucuauugaaaauugaggaaggggaauaggugugcuuaaagaaacccagauggcaugccuacagaaaauguagucucagaucagcucagucgccuggcuucaucuuagcauuaaaaaaauuguauauuguauuauaauuauuaaauuauaaguugacccuugaguaacacagguuugaacugcacagauccacuuauaugcagauuuucuuauaccucugccaccucugagacagcaagaccagcuccuccucuuccuguuuuuccucuaccuauuuaaugugaagacaaggaggaagaccuuuaugaugauccacuucugcuuaacauaaaauauacuuuuucuuccuuaugauuucuuuggcuuacuuuuuguaaggaaacaguauauaauacauauauagcugggagcacuggcucacgccuauaauuccagcacuuugggaggccaagacugguggaucacccaaggucaggaguucaagaccagacuggccaacauggugaaacccugucucuacuaaaaauacaaaauuuagccaggcaugguggcgggugccuauaaucccaacuacucgggaggaugaggcaggagaauugcuugaaccucggaggcagagguuccagugagccgagaucacaccauugcacuccagccugggcuacaagagcaaaacuccaucuccaaauauauauauaauauaaacacauauauuuaaaaacacauauuuuuauauauaacacauuauauauacuguuuaugcuauuaguuaggcuuccagucuacaguaggcuaugaguaguuaaguuucuaggaaguaaaaaguuauaugaguauuuuugacuguacagggggucaguaccacaaucuccacauuguucaaggguuaauuguaaauacagagaguguacauuuauaauguguauaguguauguuuauguauaguauguaaauauuacauauauaauaauaguacuaagcauguguauaauuacaaacauauauauguugauuugauuugagcuuuuuuuuuugcaguugguaacaucacccaccaugcaaaaaaacacacagagaagaaaaucgaaguuuuacaaaaaaguuaaauuuacagaggaacuccaauagauaagcaggagagaaauauugagaauauaauaagcuuaaauaagaaaugauaaauuaaauuuauuuuugcauuauagcgaaauaugucaaauuuccccauaggacuauagggaauacucaguuuauaucuuucaguucauauuauauauuucauucacuuaacaaauauauucacugaaugccuauuacacuaugccacaauugcccauucauucgugguguacacagugaacacacgggaccgagauccuuaucuuucuauagguugucaacucauucccaggauauaguuugugacgaagagaauauagcacaauuaguaauauuaggauauugggaagcagcugccaguuuugaaguuuauuaagacaucuaucaaugaacagauugccugaaaaucuguaugcuuuucuucacagugacaaucaauauacucacuuuaugguguuacugaaaauucccuccaccaaaauuguuuaggcagaaaucuaugaaggaacacucagaauugagucuuaguugauguaucagauuuuguuuaaugaauuuccuuccaagaacaccuuucuauugauauguauagguuaugaguaaaucuuccuaaacauucuagaguucuaauguaagacuguugcuucuaaaugcuuuaacuaaaaugagccauugaugagaucacugacuucucuaauuauauggcuucuucaggcucaagucuccuuuccuucaauaacccuuucaagcuagagugaucacauccucuuaauucauaguuucacuauuuaaacaaauacaccaaaauccauucucucuugggacuuuuaauuauuauuuuauauuucuaugcauuauuuaacuguugaauuuuauuuaacauauaacuuauuuucuccaacuggauguuaagucuccugaugauauugacauauacauacauauguguauaaauauuuauggguguauauauauacacacacauacauauuuacauuuuagugcauuuuuugucuccccaaauagauuguaaguucccugagcauagcaacuuggaauauuuuguucauuccugaauucucagugcccagcgcaguaguacaauaauaaauauuuuuuaauuaaugaauaaaauguuaaauaaguuuguuauuccucaauuuaaaaauuauccagcaagguacaauggaugaccaucuugguauccucaaguugcuacauaaacauuuuuuuuuuuuuuuuugagauggagucucgcugucgcccaggcuggagugcaauggcgcgaucucagcucacugcaagcucugccucccgaguucaugccauucucccgccucagccuccgaagaagcugggacuacaggcgcccgccaccacgccuggcuaauuuuuuuguauuuuuaguagagaugggguuucaccgugcguuagccaggauggucucaaucucgugauccgcccgccucggccucccaaagugcugggauuacagacgugagccaccacgcugggccacauaaauuuuuuaaauaccccaaauacucauuuauccauagguguccaauagaugaaccuugauucucaaguguuuaucugcuuguaacagauuuaucaucacauuuauuauugaguggccuuggggaagcuggauugcaauguaggcuguggauggggguagaagcagcucuagacuuuaguggcaucauuuuucagugaaauagcugagcauaugaauauaaacugaaaaaaaucucugaagccuuagaaagucaguggagaacugccaucucuugcuguaggaaucuaaacuagcaagugauccacauuagguaggacacauuggaccauacagggcuuauuuucaauaguaacauaacauggcagugacagaaguaauaaaggugcaaaacugaagugugcuagcagacugauaagauuuucuaaccugauuugaaaaauuaacaccaucaaauguauaagccacauauauuaaauaaaaaagggcagcagcuuacugcgcuuuuauauauacuaucuacuguauaccauauacuguauaguauacacauuuuauauuuuauauacuagauacugcccuuuuguauauaauacugaggugauauuguauuagaacuuaacuuauuuauaauauuugcuuaucacaaaacugcaggaaugguuuaagaacccccuuuacaagcucauauagacagucuaaaauguaaaaauacuugacccauacuguugucugcuuuguggucucagaaaaaaacucagagacagagaaguucccauuuuaacugucuagacauuacucugcacuguaccagucaugguaaacaagaccaauaagccacaggcacagguuuuaauaggcugauaauaaauaugguagugaauaaguaauugcaaugcaauaugcugaauaaaaauuauaauucaauauaguaaaugcagagugcuaugcaagcgucuagacaggggugaucauccuucuguuuggagaaggucagaaacacuucucagagaacuauuuauuuacauugaauuuugagcaaugaguagguguucaucauguagaauuccaguuagagagaacaacauggugaaaggcaccaagccaugaacaagcagguagcauuucuacagggaaagucaaagaucaggaagcacaucugagaguggcaggagugaacuggaaauuaagcaagugccaaaucaagaagggcuuugugcaccaagaucagaauugaauguugauggagucucugagaugcuguaaauaacaucauacaaauuuacuuugggacacucaugcgggaaaauguggcaaauagauuggacugagcaggaauaagaccucguuuuugguuucagaaauuugauuuacaugaacggugauugugauuguacaaguauaugggagaugaugggggugaggugggagagcgaaauagaaagaaaggagaaaggagauaccacuuuuaaacuagaaucauaauuucuccaaauuuucacaaguaauagcuuuauuuuauaauuaucuuaaauaauacauuauuuuuuauuguucauuuaaauacuucaaagggauauuuuugguuuacuuuguggaguauaaauauacaauauuuuuucccaguuuucaagaaaaugccacaaccauucuuaaacucaguuuacacgugcuaagcucaguuauguguuuucaacaugagccuaauaaaaacgagcuuugugauuugcauucuucuuucugcaauuucaguguuuaugcauauugguuuggcaagaaaccagauaagcagcucauguagaauaacuuggcaagggaaaccucugcuucuggugagaacuucuucgaguuuuauuucguuauuaaaauuaucuugugcagucuagauucaguaggauccauaacagugaaauaaacagaauaauaaagugguagcauuuggggaaauuaguauacuucagggguuaaagaaaaaacucaggauucuacauugccuggguuuaaaucuucugugaccuugagcuaauuaauuaccuguuguuugucuccuuugcucauguuuaaauuccacaguuccaucuccauuuauaggguuacuaugaggaucauaauaauguaugaaauaugauaagcaccaugccugguaaauauauauagucgauaaaugguaccacuuucauuacuuaaauauaagaauacuacuacaaugacgaauuuucuuccuuugcuaucauaggauaguuaaugaauauugaauuggucuaguguuaaaaccaauauauggaguacaguagcugcucucucaaccucuuuuuaaaaauauuuuccccuuauuucuguauauaaaaaagauucuagcagcaacauagauagaacagcauaauggaucagcuuuccgagucaucuuaauguuuguauaucaauaaaugaauaaugggaaauaagaaggugcugaauauauaacacauauacuuuauuuuuugauacaugguaaugacuacagaauuauaaugguucaccuaaaauuaugcuuucucauauaacaauuguuccagguauuuuagaggaagguauaaaucuccaauaaugucccuauggcaaugggaaguaauuagaguauuucacaccuaaagauuaauauuuuggauuuauauuguaccuuucaucuaaaggccucaaaaagcaucuauaaacauuaacucauuaacuucaauugccacaccuccuguaaaauaaagaguguccaacagcauuuuacaaaugagaaaaauuaaauugagaauaacuaaauauuagauuuauguuuuaggagucaagauuauaauuuaagauuuuaaauaauguuuaugaacacaagauuuucuacguguacacaaaauaugcuuuucuuuacacuauuuugcaugucauuuccuuuaaaaaugaauuuucaauuguuuuuaugacauuuaggaacauagacguaaguuuuaugaauuuuuaccauacaauguuuuagauagauagcuauguuucagaacaauucuuuuuuguaucaugaauuuaauacacauaaaacugagagauacuauauauaugcaaauauguguguauguuuuuguguauguuccuauauuguaagagucucaacaccaggaacaauguuauauaauuuugugcuuacuuaaacuaucauaauuucucaauuaauacuguaagaaacuaugugucaguagacaauauuuagaccuuuaaaaguaacccaaaauuauacgaaugcaauguaucugugaauacucuucauugaaaaacuuuucuguucacaauguauauucuauaaaguuuaaaauuuaaguuauuuuaugguauagguacaauccgucuuuauaauuuuugucuccaaauacucacaccucacuuuaccucuauuuuauuuauaacaaacuauucaauuucucuaaaacaugcucagcacuuuccuuauugugcuuuuguuuuuucucuucagaacauauuuucccucugaaguauauaucaaaauccuaccaugucccaaggcuuaauacuuaagaaaaaucucuuccaugcagcaucccuaguucuuuuuuguaccagauacuguuggugcuucuucuagaucccauguacaggcaagccacuguaaguuuacaccugugcacuuauacacagacacacacauaugcacacacgcaggcaguucauggccaaagaauaauggauguaacagccuagaugcuuaguuucuaagagugauaacuacuguggugcuauuuucacuccagauaccucguuggaaucuggcucaggaaagacuucuucuggaaccauuuauuugccuagugauaagguuaggcuuuguguccccacccaaaucuccuugggcaauuuaaucccuagguaucaagggagagaccuggugggaggugacuggaucacgggagugguugcucccaagcaguucuucugauagugagugaguucuuacaagaucugaugguuucauaaguguuugguagcuccucucuugcucacuucucucuccagcagccuugugaagaagugccuucggccaugauuguugaguuuucugaggugacccagucucagccauuucuucauagcagugucagaacagacuaauacacuuagcuucuaccucugcccuauucugcuuuccucacucaguucacuuuucuucugggcacauuccucaauaaauugcuuacccaagaaucuccaacucaggcucugcuuguagagaacuuaagcuacaaugccuuuaauucaaugaauuccugaacucaucgcaauauuauuuauaauaaguagacaaaaauaauuuaaaaguccaauaacagggggcuugguuaaauaaaccguuuucuaucuuaacagugaaacaacaauccaaaauuaaaaacauuauuuuagaaaagauaagacagaguuuaugaaacaauaaaaggacaaaagauuaugugcagucuuacgagcaaagucuaugcuaaauaauggagauauggcucugacaaguuaagauacagucccugaccuugugaaguauauaguagcaugagagacauauuauauaaaguuucaaagaacccccacauuuuaauuucuacugagguaaaugcugugaaguauaagcaaaauucaugaaaaaaaaaaaaaaaaaaaaacaacaacgaaagaccugacuugguccguaaagccaaaaagacuccagugaggaaauaacauuugauuagaaucguggggcaugaugggugugauguuucaagagucaucuagauauaggaagcaaaaaaaucaaugguccugaagaagaagcagcaugacaccuuugagaaacuaaaaaagcaaaagauaagaguagcaaugguuggugaggagguagagaucuaaaaaucuagagacuuauaagucauguaaaacguuuacuguuuuaucuuaagacccauggaggccaaauaguaagauacagauuuuaagcacaguagggacaugauguuauuuuuaauuuuuaaaauauuacucaaauuacucugaggagaauaggugaguagggguaguggacaccaauaugcaaguuuugagguuacugcagcagccaaagucagagaugaugggaacucuggcuauggaauaguacagaaauguggaggaacgauugcuucuuaaccuuuuggcuaagaucaaguguagaaauguggaggaauggacagauuugagauauuuaggaagcagaaacaaugggacucauguuuaauugguuaggagguuggagaauaaaggaggcuucaagcauuuuuauagggaucuggcuuucccaacugcuagauguuguugccugucacugaaacagacaucauaaugaagcuuugagugaaaaagggguuagaaaaggauaucaguucuaaauauaugaagauuaugguguccuuaugacaucuaagaauuacuaagcauacaugaagccagaacacuaaauuacuuacaaauaaauguguacacacaugcacauauguacuuguauaacauagacauuaccgcaaauauuuguguguauguaaugaaaaucaaggccauacauuauaauguuagccauucuuaucccuaaauaauaaaauuaugcagcaauuuaauuuuuuugcauuuguaaguuugucaguguauacacauaaauuuuguccucauaaaauaaaguaaaaaacagugacuuuccuuccauggaccaccacauagcucuuuaaaaacuauucaauuauugacuucucaagcaucagauaaaccaaugcuuggaaucaaucacucaggguacacuucuaagaugauuuuuaugugcaaauuuggcauuuggcuuuuuauuaccauucaagucuagucauucaaccaucucucugaguaacucauuauuuuuuauuuggcagaaaauauuccccaguaaugguauacccuuuaaaauacaaauaacuuuuuauuguauacuuuagacuuccuuuaauugcauaaguaagaaaaagugcuucagaucaauugggaaaugcauugacuuacucauaacacaagauaccugugauuucuuugcuuaauacugaaaaucauaauugagauucagcagcuuccuaacauaacuuuuccccaaagucagacugaaagaaaaauaaaucauaauaaugauuaaugauuacugagaguucauuacaugcugggcaaaucucucagugcuuugcagcaauucucuuauuugacaauaaaucugugagaaaagaauaccaagaucuuuuaugugaugagaaaacaaguucugauauguugaguaaaucacuguaggucacacagcaagugucuaaaaggauugggauuccaacccacucaggcugagaguaacuucaugccaaacuuuguaauauaccacucuuauucugcaaaggguguagcuugaugcuaacucugaaguuaaaacuuuaaacauaauuuuucuuagaccacaguucuuucaaacaacaagauaaaaagccacaaggaaugugacccuuuccaauauaguagucaacugcugaagaggucaugaagcugagauuuauugacuaccuauuguaucaguucaaauucuuaauguagaauaaaaaagaaaacuaaaucaacuuugaacagaaaauuauuggcucguauaaugaaaacucuagagggagggcaggcuccaggcacaauuugauccagagguucacaguacuaucaaaacuuggcucuguuccucugugauuuucuuggcucagcucuguucugcaugcuggcuuuguugucaggcugaaagccaagauagagagagcaaguguagguuuuucauccacauacaguacuguuaugauuugaaugugucccccaaaauuuauguguuggaaucuuaguccccauuguaguaguguugaguggugggaccuuuaagagcugauuacaucacgagagcucuaccuugugggcauuaaugucauuauaaagagaguggguucauuauugccagagugggcuuguuaaaaaaaaaaacgaguugagacuccucuugcucucuuccucucaugugcucuugcccuucugccuucugccgugggaugaugcaguacagaaguccucaccaaauaccaccaccaugcucuugagcaucccaacuugaagaacuauaagaaauaaaucucuguucuugcaauaacaaauaccugaaaauguggaagugacuuuggaacuagauaauggauagaggcaggaagaauuugaaggaguaggcuaacaaaagcacagauugcuauaaauggaacauuaagggcaauuccagcaagggcuaagaagaaaacaagagcuguaacaagagccuaaaucuucuuagggauuacuuaaguggucauaaucagaauguugguggaaauauggauggcaaaggcaguuccaaugaggucuaagacagaaaugaggaacaaguuauugcaaaacggaguaaaggccauccuuguuauaaaguagcaaagaauguggaggaauuguguccaggcccuaggauuuuaugcaaggcagaauuuaagagcagugaaccaggauaccuggugggagccagucuagguagcuugugccuauaaucccagcuacucaggagacugagaugggagaauugcaagggcccagaagauugagaccaaccuggguaacauagugagaccucaucucuaaaaaaugaaaagaaaauuaguugcaugugguggcacaugcauguaguccaagauacuuaggaggcugaggcaggaggaucacuugaaaccaggaauuugaugcuaaucaaugaucaugccacugcacuucagccugaguaacaaaccaagaccccauaucuaacuaaauaaaugaaauguuuuuaaaaaggguaucuggugggauaaacuucuaaacaaaauacggaagaaguuguuugucuaguuuuaaccauguauaguaagaugcaaauggagaaaaauuauuuaaagauauaauuuauaaauaaaagggaagcagaagggaaaaauuuagaaaauucauagccuggccauguaaagaugaaaaaggcuuauuuaggagagcaaaccaagaguguccaagcaaccaucugcuaaaaagauuaguacaaauagaaggcagucaggugcuauucaacauaaugggagaaugacccuaaaggcauuucugagaucuuagaggcaaacuaagaucuugaggacaaaguuuccagaaaggcaccuguggggccucagcauucacugcccauggccagcuugguacucugcccacuacauuccagugcaguguuccuuggccaccagaacauuggcucaacugaccccuaaucguggcuccagugggcucagcugcagcuugugucaccacguacacacaagcaacacauggugcugacucugcagaugagcagaaugcaauaucuguggggccauucuggccuucauccagauuucaaaggaugucucagacagccugggagaccaggcagagacuuguuacaggaauagagccacaacagagagucuccacuaggguaaugcuuaguggagccaugggaggcagggcugccuucaagaccccagaacuauacagcccccagaguacaauuccagccaaguagacuugcaggaacaaaacucccaucugugagagcugcugaguggacugagcccaggacagcaauagaaacaggacugccugaggccuuaagggccaaccccaccccaguuuucccaggaugagcaacauggaaucaaaggagauuauuccacagcuuuaagaauuuuguuuucguuguuggguuuuggacucacaugggaauuguuauucuuuucuucuugccugcuucuccccuuugaaauggaaaugucuacccuaugccuaucccaccauuguauuuuggaagcacauaacuuguuaauuucacagauggaaaauaauuugccucagaauaaaucaugcuuuaagucucacucauauuugauuuagaugaaacuuuaaacuuuguauuuuuaaggugauauuagaauggguuaagauuugggggacuauaggaugaaaugaauauauuuuucaauuugagaaggaugugaauuugggggaccagggguggaacgccgugguuugaauguguuccccagaaagcauguguuggaaacuuauuccccagugcaauaguggugggagcuggggucuaacaggaaguguuuaagucaugagggcuccaccuucaugaaugaucuaaugcugauuaugagggggcuugaggcugugaguucaaucuguuguucucucacgaaugcccuguuucccuucugccuugugccauuagaugaugcugcaagaagacccucacaagaugcagccccucaaucguggaccucucagccaccaaaaccaugauccaaguaaauuuuuuuuuccuuauaaacuacccagucugugauauuauccuauagcagcagaaagggacugagaaaaguacuaucacugaaaauggguaaacguguguucaaguuucuaagcuucaagcauaauuucugagacucucugaaacucugccaguuuaggacaugugugacccccuuaccaacuaccacugacaagagaaucacaugcaaugguuuaaugaaggcugggucacaugcuguacuccuagugcagcaauaucuguagauauccacagugaaaucaggacauacuggaaagagguaggggaaaauaaugcuaggaaaucaugcagcagguguuccugccucuauuguguguuagauuuguaaauaccucaucuuauucaaaguaagccuaaaaguccaaugaaauaggaauuaacucuacuguauaaauuaaaauguagaagauuacaguguuauguaaaccaggauuuuaaaaaaauugucuggcucaauagggucugcucucuaaacaguagcaauuugacuguuuuuuauauaaauugugucagcuauugagucauuccaguuuucugaauuuagaagaaauaacaaaugaaaaacuaguagauacugugugucugcauguauucccuuucuuccuuccuccuuuccuaucuuucuauuauuucacaaguauuugcuuacccucaauaaaagaaaagcaaagcgccauuccucaugggagcagcaaaauauguaaggcaaauucuuuuccuucugggguaacacaaauacuagaagacagaucaaugcucagcuaacuaaaguaagacagaucgggcuaagugccguaaccugaauuucaccucuaaugucuaaauuucagacugcuuauccacuggcacuuuuugugguuagcacauaguuucucuugccuuucuacuuaaaaauaauauauagaguuugugcuaacuuuaauagaaauuaaaauauauuuuaaccauuuaaaacuuuauucaaaaaguaaaucaaggucagucugacacauuauuuggcaauaaugauucaaacugcaugaucuguguuuugcaacaauucuuuauacaucucaaucuccuaugaacuacaaguaggacaaacucuacaauuuuauuuaauauaguaccuccacagugaauaacacauggccuugaacagaguaguaauugcucaauaaagaguuuuuaaaugaauuuugauaagugaaauuccagugcauacuuuuaaaggacaccacauuuuccuagaaauguaaauauccuaauuugagaucauuuucauauacauuugagaagaugaguuugaaaaaaauucagaacuuuuucacauucuaauuucucuuuaguuacuagcuagaaauuuguuucaagaacuuagaauuuccacuguaauucacaggcuauaugauuauauauauauuuuauaaugacauguauauauauaaaaugguuuuucacaaaagaaauaauauaaagucaaguuuaaacuuaaguuuauauuauauuagcuacuuuguuuauagaaaccacaagaagauucuuuuuggaauaaugaauaagacguuuccaauuauugucucuaugaauaaaaauuuaucuaagcauucuucuuucuugaggggaggaauucuugaaaucuuaccaacucuauuuauaaauauugcccaaguaguaugauagauccaauuaacauguagagguaaucuguaaucugugccuuguggacauuccauugaaagugagacacgcuuguacagaggucacuacuacuaaaaccagccauccaaaccacugcaagauucugguuacugcugucaaggagccuuccaagcaaggaaacuaacucugaagaggaacagcagauccucugucauguugucaggauauucagggagagguuuuugacuaaaaaacggagggugugagaauauauucguauuaaaaaauuuaaacaucuuaaacaauggugagacucuaugacaugauaguguuaucauagugcaauguggcccacaauggauuaaauaauguuauguuuucuucccugaacuaaucuaccuuacucaccuuugccugccucacuguuggcuacacuaacauucuugcugguucuucaaaaugucuagcauguuucucucucucucucucucucucucucucucucuuuccucccauacuccucuuccuuuuucuccuuucucuucccucucucucuucucuccuuucccuuacucuuucuucccacuagaauaaucuauuccugaauaaucacuuaguuuuagucucuguuguaugucauuuccucagacacaaugucauuggcccccuaaucuaaauucauauccucuaucacucucuaccccauuuugcuccuguuuuuucuucauagaccuccauaugucaucauuccuuuauugccugucuuccauuuuagagguaagcugcaggaagacaagauuuuugaguguuuuuucuauuuuguuuaucauuguuuacccagggcauauguagauauucuacaaaaugugcuaaauaucaaaauaaucaauauauaucauugugcuuugcaauuuuucauuugggccuccuaacaacucuauaaaguagacaggaugagauuuaaaugcaaugaaauaauaauuacauaaaauuuucugccaauuuuaucuuacaaaugaccaacaggacagacacuaaguaaaugaguauuaaaagugagcaagcagggagaaacaucaauaugauugaauugaguucaugcaauucagcaugacucuggggaagcuaaaauagggaaauaaaguauguagaugucaucuuugguuuucuuuccuuuuauaauaaacuccaaaguuuaaauagagagggcuuaaaaagaagccagcaagcacaguucuguacuaucagcuuccuagaggaucagaaccucagaaaaaaaaaguuuaagaauuuugguacuauuccacuugugaugcuuaaccauuuggaauuauuauucuuggaauauuaacaauuuaggguuaauaaucuugaauagugaaagcuagacauggaaaaaaugacuauuaugaaguaaaauuagcaugcacgugugcacacacauauauauacacgugcacacagagcaaacucuacccaggagacuagggacauccagagaguaaauuauuuaaaaauaaugugaaauaauaauuuauuccagcuucaaguccaaucuucucuuuucugcuaaaaauaaaaaugaacaaauaauuuacaaggacauaaagaggaaacaugaaaacagaaauuaauauugagaaaacacuucccaguagguauuaacuaauccuuagcuguagcaguuagaaaagcacacuccuaaaagauucauuucuuacagguacuucugcuuuuuaaauuuauuccgaacacccaacagaaacaaaaacaaaauaauguuguuuuuaguuccuuaagcuaacaaagguuuuucucagguuacauuuuauuaugcuguuugugaucacgggcauaaaauuaccuuucaaaacaagaaaauucaagaacaauccagggaaaaauacaaguuuaaugcuauaguaaauuuagaauccaaucuaucgucucuagugaaagagauaccaguguccuuggcaugauuacuugagaagcuagcagagguuaaugcaaauaugguaggaguauaaccacauauaacagaaacaaguugucaucauuuuccuaaugaacgcaaguccguuaugcugugauuacuucugaauguuuauuuucaaccacucuggcugaacuucaaaguguuccauuccauaaaucucugguaucuuuagugauaaaguccacauaucuggcugacauuagcugaaaugaccugucacucucuugcaccuuuccccugcucugguacuccugcagagaagaacauuuaacauggcauaagaugcaguccuuauccuguuccagcagagaccuagaccacaugcagcuguuagacauucuaaaggucauucucccucuugaauguguguauuauuuguuuuugcuauuauuugacauuugacauuucucccugucucuaucuuauauagccccuuuucaaaugaaugagcauuuaucacuuuauacauuaacauauauuagaagcaaacugaaaauauaaugguaaaaauaaucuuuuauguuuuccuuuuuuuccuuuccugaugaccuuaacacagcgcaucaucuuaccaaauaaaaaugacuuacuguaaauaaugcacuauagucuuaacuuccuauuucauguauuauuuuaaucauuguuaauuucuuuuuuaguuucuuucuauucucuacgugaggggaacagccaaagaauacguguucagaaacaauguugaaaugucuugcggauuagaggacaacaaaauuucaggaagaaacacauugaaacauauguucuaaaaauuuuauuuuuuaaaaaugugaaacuauaacaguugaaauauuucugugaaauaauuaaauuuaaucuuuuuuucauaauaagggaagaauauugguuaaauguuuuauguaggacugggcuaguuuacuauaaagaucuggcaaauuuccauaacacuaggccaaggaaucauggcuaacuaagcacucuuaucucucaguuagaaagaaagauaaaacauagaauacaugugacauauguguaguuacucccuaccaugugguacacucuaaaauggggaucugagugaaauuguuuaacuugggacuagagauugagaaggcacacacacacacacacacaaaaucuaggauuacaggcaggaauguuguuaaaaacugauauuuaauuaucuaggaauaaugugaaauaaagugcaugcuagcuucaacuacuugauacugacaaacuggagagaagugaacagauacuuaaagggguagacacugagccuauuagugauuucagaguaaucacugacauugugugaugcagcaaaagcuaccuuaaaauuauagcuauuuguaaagcaccaaaaaagaaacaaaaacuaggauauuuuaaugaccacucaguagaagaaauauuuugccuuuuuuaaauuuuuuacggcuggcagcaaagaggugccaaacacuacaauguggcaauguaguagaaauguguggaguaaccuggaucacagugaucagaaaaucagagagggcucuaggaaagaauguggcuucuuguuggcaaggggacuaccugaggaaaaaagaagugcagaggaugcauggaaaggauacaaacccagugaaaacuguucuugacacaguuaauaaggggacaaauaagcacagauaucggacaguauuauuuaucuucugugccucagagaaguuaugcaaauuauauagcauuguuuaacuuccuuuaucuccucugcaaaauggguauaacaccagcauuauuaagauuauugcuacacguuaaugagauaaugccuagaaagugcuugcaacaaugauuggcauauugugaguacuuaauaaauguuacucugauuauuugguuuuuauaggugaccaugaauaacaaguaauaaaucauuuucauuacagauuauggauguagucauuuucacuuuauccuuucuauauauucuauacuucuauagaaucccacuggguauuuuuacuaacagauaaaguaggguuaaggagacuguauuuauuuauuacauucaugauaguggcaccaaaggugggcaaacuaguucaguaauccuuuauacaccauagaaauacuuuagcuguauuuuaguaauaauaauucuaaaucuacaauacaauaaaagucauuuuucauuaaaaugccuuuaaauuaguauuguggacuuauguucaguguacuuaugcucauuguucugauuugccuccaaaugucucaauaaguuacugaccuuuaaucaguuauaaaucuaggaacuaguuuuguugauuaaaauugcagugauagcucaauucugaaagacaagucuaguuuaauuuuauaaaagaacaguugguaaaucaguuccaguauguaaaacugccaggagaauuaaaugcuuaccuaaaucccuguaacuucuaucucccucuauuuuuuuucauguaagcauacuuuucauguguagaauuaucuuacauaaacaugggagaaaacaaacuuuucaguacaguauauauuagaaguuuuagaaaaagaguagacccgggaauguggauaauuguuuaaauaaaguuaaaagaaauuaagaaauuaagaauugauugcugaaacaugaacauuaaaaaucagaaaacaauauagauugaagagauuaugacuuuaaagauauaaaaguauaaaguuaaauggucaugaaagaagaguuauaucuuaaaaugaguccaagcaguaaaaagauuauggguuuaucaguaacuggaaagauuccuauuuuaugaaaguucugaagccaaaaggagaaagaauaaaaaaaauaacaaaaauuuguacuagguguuuucugucauguuaaacuaauagcaaaucucuuuguuugaguuugaaaaugggaauauaaauaacucauauauucauaggcaguuuucuucacuugacauaauuacaaaaaucaauuaacucuagccucaagauauuuggcaaaugugcacaaaacagacugaaguaaaauguacaauuauuuaaauaaagucuauuacauuuauuauauuuaugaaguuuugagggaaggcacagaagaaaggggaaggaaagcuaauacugacugaaaauucauugugggccagucacuuucauucuuucaaaaucuguuucauuuacuuaauguauuuuucauuugacccuucaagcuagguggucauaucuacauuuuacauauaaaaacacuacgguaaagaagguuaaaauuaauuguccauaagugcuaaaauuuggguaaaauggcauuugagcugagacacaugugacaagcuccaugacuuuuaguucaaugaauuaacaauuaaagcuccaagauuaguaacaucuacugaaauaaugauagagaugggugccuaaauauaacauauaaucauauacuguauauauauuacagcaugcucaguugugcaugcacaaagacugaaaucagaaggaaauauguaaaagcaaagcugauuuauuuuuuguauaguuggauuuuuggaagagauuuuucuuacauagugugauaauuuugaacucugauuuccacuaauauuauuacaaugguauuuguucaauaaaugauaugugaaaacuaugaaaaauuaucucaugucuuuuuaacauaauuacaaacuauguuugacuauuaaaaccuucaacaaaccaguccuggugacaaaugcauauccauaucagcauauauagauuuucacuauaauuugaauaaaucauagagauguuauuugcauuugcaauauacacaucuuuuuguuaauuuaguauuacuuuaaggcuuccuacagugauacagaagaugcugugcaaagucagugugugugugugugugugugugugucuguauguauguauguguauauaaaaguuuauuauugaggauaaacauagcauaggaaaccuaagaacauguuauaggcuaugcaagaauauaaucaagaauauuuuauguagccuuugcaaauaagaggauuacaacacaaaauuaucauuuagcaccaauuuaaaauauucccaagcaaauacauguauacauagugacauguuucugauagacacugaauuaauuuuaguuaaucugggaagaaaagaguuccaaucugagccuggggacagagagaaaggaugggcaggagagacaguaggaaagaagaguggagagugcaagcuguggaaaaggguuuggaucugcaugaaaagaaauaggauuuggaacuggaguaaacucugcuggguucuaaauucugugagaaaccuagaggaugauauauucacugcaccuagcagguuguaggaauaguucuccaaacacuggguuaguuaccucuuacauuauauucaauaggcuucaaaggaauuaauuauuguacucuaauacaauauaguagagcacagguaaaaauggaucccauguaaugaaaacaauuaacaaauucuacauaaucgggcuauuucuaucuccuagauagcccacauuaauaggccacauuaauauuacuuugaugauaugaauauaauuccuauuuuuaguaaaaauucauagaguauucaaaaaauuccuaccugugaagcauuugagccacuuaaccucucaaugugcucaugagcaaaagaggguccuaggcucuggacaaucucuaacagucuuuccaugaaugagccuaugaucauguaauuucuaaaggaaagugacuuaaggaucaggccaaaaucaccagagaagaagaaaggaggaagguggcaagcuucagagcacagugugagaaugaugcucucaaagccaguuucauguggaaaacauagaaagugauaagaccacaaaaaaccugggaugccagaaguaaaacaaggaguaagguuuacauaaaguaggccagcaaugaaagagcaagagaaugaggggaagagaccaaugcaggcuaccacacaaucauuucuucagguaaaacuggacuuuggaacagagauaggaaaaaaaacuuuuaggagaaucuaaugacuucuacaugaaacagaaagggcacaccugagacaaaaguuuguagagguugaauaaauuagauaacaugguaucuagagaagaauuaauucaaaaaugcaagacaauaucuuauaguuauuaucuauaacaaauagccuuuuaaaaauguauauacacuuaugaaaccuuaaccguuaaggcuaacaucuuauuugaagucauuguuacuuuauaauagaguucuguaaaaaauaaaaaugaucaaaacuguugguuacuugaugauuucuccucuugggacucaagguaaagcaaauuuuaaucuuuuugguaaacuaucuuuacauuuuuaaaaaacaguacacuccaugugagaauacuuguaaaagcauuugagguuggguaugaauucaugcaauugccaauguccaaucaguucugcuagaaguugcacucaauuagcagauagggagaaaggacaaaaaaauaauaauaaagggagcaauuacaggcacuagauucugauuuuuaaaaaucaguuaaauauguuuauaugaaggaagacaacuuauacuuagcuauuuguccuuuuuucugcugccugugaaggaaaaaguaaaaguccucuaaguaauuaaaaauaaaacauagccaaaacaaaauauaauuuguuucuuuaaucagcauaaaaggaaagaauaaccugcugcuaagacagaauuauuggcgauugaaagagaauauaccuaggggaacauugaggcugagccaaacuucaagcugaucacaggcccauaggcaguauucuaauacuagggugcuuauuugccccaguuugccuccaaucaguccaaaugugucuuuuucaccccaacagcaacacuuuuuaauuuuuguggguauauaguagguauacauauguauagguuacaugagauacuuugauacacacaugcaauguguaguaaucacaucaggguaaaugggauaucuaucaccucaagcauuuuuccuuugccaagagcuaucuuaauaguauauuauccuuuuuauuccgaaaggaguccugguuuggacaauaaacuggacaauacauuuaggagaucauccuauauuagaccaaagcuaagaaaagagugucgccaccaagacagagcuaaacaucagaaucagcccuagcaaacauuuuagccaucuacuucauguaaauuuauaaugagauaucaucuuugaaagaacaguuaaccuuaaauccacauacuuaccagaaaggcuuucaacuuugauuuauauguuguagaaaagccauaguuauaaaucuaaaucuuucaggaacagggauaaacagggaacccuauuugaucucauguuucucaugucacuuucuaaugccuaaucuaggacccugauuagcaguacauguaaguugcaaguucaauuuccugaaauaugaaccuuauuugcaauaguccauaaguccauauuuuaaauuuuauugcaauguauccauauaacagaugagguggagcagguaaauuugagacuuugaaaauuccaucacucauccaaggacuucacagccaggaaguagaaaaagaccaaggcaagauuugaacauauaagccugacaucaaauacaacgcuuauauuuuccuacucuauccuacucugacuguuuauaaaaaugaccaaucaucacaauuuuugacugggucaacucauucaaguuaugcuccauugauucuaaauuucuuauauuuaaucuaccuugauauucauuagacugccugggagcaagaaaaagaugcugagacccuuccuucccauuggagcacucaauuuuccacucuuggcucuuuuacaauggaccgacuuauuaagagcaaaaaagaaugagauggucaaauuaaguuccaauaauuucauaccuaaauuguuuuuauugaaguuaucacugacuuuacauauuagaaaaaacaugcugaaaagcuagacucuaaacaaagaugcaaagagacagaaagaacacuuggcuuacguggauccacucuaucccacuucucaguuugaacaguguuuuugcgcacacacaagcacacugccucugcuuucacguucuuccaucugcagaucaguauuugcaaaugucuuuucuuaucagaaaacacagguccuuaacaaugaagguggagucuucuaggggagguggaaaaaagaggcccgaagucccaacaagauuccuuuaguuugguucuaaaugggaucucugucccacuucaggcuuuacuucugccauccuuggagcacaaguuuccuuuccucuagcuaauuauguuuucagagaaaauguaacuaaagaacacaaaauucuauaaaacauauuucgauccuucuauguaauucuauuaauuuauguaagagaauuauacauucaauaugaaacuauaaaagaaauuaugaacaagaaauaaaaauuaucuuuuuauuuuauauuugacaaccuaagauuccaucaaagaucauucuguuuuaaaacucuuuugacuggaaaucaacagcaaauaaauuaauggugccauucucuuaaauuaggaccagacuuugauuuuaaaauguacacuuauaguaaaaaacagaaauacuaagaaaaaagaaauauuuucaaaaguagguaauaucagcugggggugguggcucaugccuguaaucccagcacuuugggaggccgaggcagguggaucgcuugaggucaggaguucaaaaccagccuggccaacauggugaaacucucuuucuacuaauaauacaaaaauuagcuaggcauguugguggcgugugccuguaaucccuguuacuugggaggcugaggcaagagaaucacuggaaccugggaggcagagguugcaguuagcagagaucacgacacuacacuccagucugggcaacagagugagacucugucucaaaaaaaagagaaaaaaaaguagguaauauuauucgaaauuaauucuaaacugagacauaaguagacacaggaacuaaagaucauaagccuccugguguagaauuaguauuuucugaacauaaguacccugaauauacuuuaaaugguucacauuuuaaauaggaaaugacacuauuaacguugaauuugaggaaaagcuagaaaaagaugacuagaaaaacacuguuuccuuuuuuaggucaaaauagaauugaccacuaugaaaaauaaucuuuauuuucuccaucugaggcaggaaaggggaucauugugaaaccacugucugagauauacacuucacaguuaugccaaaaucauuuugaguucaaaacugaacuccauuucucucccgaaaugguuucucuuucuugguuuccuguauugaauuuucuguacuuacucccacuucaaaagaaugaucaguacacuggcugcaaccucucucaccucucuccuaagcaacaccuuccaccacaaaugcaguauuccaauauuucuucucuuauauuuacagcauauuugagaguucaauaagcauauuuacagacauaaugacuuuuuauccuaaaaaugacccagccaaggugggagcuauuguuauuauuccugauuaaaacugaaaaacuaagauuugaaagcaaauauggacaugugacaaacaauguaaaauuucauaacuguauguauucugccagacacugaauuaguccuugaaauucagggauguaaaauauugucucugacuucccaaacauagguccccuucuuauaugacaguauuauuucuucucugcuuuguccagacaggaagcacaaaagauacaacauuuuguuaaauggcaccaaaaauuaaagauaacuauuuuccaagaggcagauucuggcagcguugagaaccuauuagcuucccuaggcaucuccccugcuaauccucaggccaaaggccugaaugaccugacauucuaaaagaaccucuuugcugccucuaaggauguuucauggaaacuuuucuuccucucauugcuuccaauuuguacagauuaaaaugaacuauuccauuggaaauucaaucaagggccacaucaugaagcucaauuggcugcaagaagguauuuuuucuuucaucauuacaguacaucuuacuuugaauugggagugaaugacacauaauauuaaaauaucaagaaaucauuuagguagauuagacucauuaucaauuauucuugauuaaucaaaccaagaauaacaugcauauaagauaaaggaaaaauucacuucuuaggaguaaguaucucuaaggauacauuauaaaauaauuguucauauuuucuuauccaagagugagauagaagguaauaauuguaguguaauaucacuaacaaaaauauuauacauucucauuuaaaauacgcauuaugaaauauucaaaacacgaaauaugccaaaccaccucucauagcaucaaaccaguuguucccucuguacauuccuuccucucuucucuuugauuugaacauuuaagggagcucccugccuacaccaaauaagaaacaaagauucaaagaugcuguucuaaaugguagcgaaaggcaacuggauuguugaauccaccacagggaucacugugcuugaagacagacuccugaauucuucucugacuugcuauuuaauaguccugcuggcugggcauggugcucacgcuuguaaucccagcacuuugggaggcugaggugggcagaucauuugagcucaggaguuugagaccagcuugggcaacaugagaaaauucccucugcaaaaaauacaaacauuagggaggcugaggugggagcaucgccugagcucaggagaucaagacugcaguaagccaugagcgugccacugcacuccagccugggugacagagugagacucugucucaaaaaaaaaaaaaaaaaaaaaaaaaguccuggcauauaggcauauaguaugcacucucuuucccuccaaagaggguuguaaacuuagccaaccuaccugauggaggggccuaaaagaaaacaacuuauucccuaacuaaaguggaagugaacugaaccagucgauuucucugugagcagaguaacaacagauauaauauugcuuaccaaaaaaaaaaaaaaaaauauauauauauauauauacacacauauauauccaacacuugugaaacaaccacccaacuuaauaaauaaaacaccaucaauaauguugaaacuauguaccucuccaucacaucaccuucccuuuucccucuauuaauugcuagucagauuuuugcauuuaucauugucaugugcuucacaguuccuuuuuaagagugcaauauucaaauuccucuucauggucuauaauauaccaucaacaggaggucaacaggguauauacaauguagaugcucaagacucaauguguauugacaggaauaucaauacaacccaguuuauacauaauuaucuaaaguuuuuaaguaguauagcugcaauuuauauugcauuuuauuuuuaaaaaucaccauaaauaugaugcaagcaacugagccaaucacuggggcccugguugucagcagcauuaccccuggagggcaguuuuuuucagugauaauauucuucacuuugcucccagucagugucauucagcuuauucuucuuugguggcccaaaagcuucacuugucucacuaacucagcagccaagagcaaguucuaucuucagaaucugggugauauuuugagaaaauaaaacuauuucuucucagcaagccugugcauacgagcagucagggacugauuuucugguuuauagauuaucuaaaacccuuugcuccuuuuuucuugcuuuuggccauuucacugcucauuaguauugccacugaaggguagacaggaaaaauaaaaagaaaaaaucaaagcagccaguuuugcuauuuauuaacuguuuauuaaccacagcaugaacucuuguggagaaaaauagaagcacuggacaguuaguuugcgaacaaucuguuauguucaguuuucaauguuuucccuguuuucaauuacaccuauauaauuaaaagucuauauaaauauguuuuccuaauaauaguuaugccacuuguaaagaaacuuuauuuuacuucugccaugagguagauuauucugucauggucaaaagucauaaaugucaaaugucauaaaugucaaaugucauaaaacugucauuuucacugauguuuuauacauacagcagugaggauagauuaguaauaugaaagaacaguguacuauuaacuucagaagugagaguaaaaaaggcaauuuuauuuuucuauacccaagaaaucaugcuuaaugcaauaucugauauacaguauuaaauuuagaaaagaucucauuagcuuaauuaauuaccaaauaaccacaucuuaacgccuccuccuucauuacuuaagcuugcaugagaauuacugacaucuauuuuuaaaaaauaaaagaauuaaaauaauaaaaaauucuuccuuagaucugaaauuggcaugauuguauuuacuuuguagccuauagcuacaauauggugaaccaucagaaagcugagaaaugagauuucuacuauaaagaccauuuguaugugauaaccuccugaucccauuucuaugucuuuuucugaaauauauguuuuuauggcaccuuuaggcuacuauaaaaauggcauuuauugaauuaucacaaucuccagugccauaguagaccacagucguucagcugggaguucugaauuguucuaccuucagcuuccuaauguuauaauauuuucuuagaaggcagauacuccugaaaguucuaaggauaugaaacgugucuuguuucaaugaucuguauucuuauaaccacacaauagguguaaaaaaaaucuggugacacacccaaaaaugucacguuaugguuucauguaacccuaaauugauauguucugcaaauggaauaugagauuugagucauaauuucucagcuugaaauuaauggauuauagaaaauguccaaaacucaccaugacuacaccacaagagaacagaagagcagucccucuuacaucuguggaugaagcaucacccacauuaauaagguguuaaaaauugaaaaaccauuuaagaagaaauguauaaugguucuuauauaggccaugcuucuacugggcuaugcugagaguuguugguauaucuaaaaagaaaauucaaugguuucuguuauuuccauucacagaagcagcaaagaauaucuggauucugaguagcaagacagcaacugccacuaaaccacuaacccaauuuuguugguugucagauugcagagauuauuagaagcaggaaucagucuucuggauuuuaauucgcuuuaaaugucauacaacagaacaacagaacggguucucuuuucuuuuuuuuuuuuuuuuuuuuugcuuuuuguuuuuguuuuuuuuugaguuggaguuucacucuuguugcccaggcuggagugcaauggugcgaucucagcucacugcaaccuccacuuccuggguucaagcaauucuccugccucagccccugaguagcugggauuacaggcgcacaccaccaugcccaguuaauuuuuguauuuuuaguagagacgggguuucaccauguuggucaggcugaucuugaacuccugaccucaggugauccacccgccucagccucccgaaguguugggauuacaggcgugagccaccgugcauggccaggacuaaguucucuugucucaccaaagcuacuaagguauuaccuggucuuuggauuuuaagauacuaagucaaucaaugacaugacauuuuaaugauguugaaguuauauauaguaaacacuucaccaguuuuagggguucauuccaacuuaaguuuggauuuaaguccacgcagcauuuccuucaaaugauauuucaccaccccaagaagcuaugaacuaguaaauagaaaauaucuuucaauguucuguauuucaucaauuaaguuccuaggcuccagccagaacacaauuugcuuuuuuugugagucauugcuauucucaaacuauaagacuccuacccucucauuguucaaauauuccauauuuacauaucaauuaacagauguaucagagcagaaacaaccaucugacauccauaucacauuguuuccauaugaugaaauguuuuuauagaggacauaacacuuacaacaacaaagaacacaaaaaauauaauucaccugcuauuagcaugcuuauuuuaguacagauauuauuauuuuaggugcaaaaucaaaauacacaacuuaugguuauauuaauacuaaugaaagaacuaagauucauauucaaaaggcugaauucugagguuacuaaauuuagaacauuuccuuuccucauguccaccuaugacugaaaaucuaucauccauuguuuagcacaaauaaguaaaagauccauaaaaggaaauauuuaaaugugucacagaaaucauaugaauaugauaugccaaaugaauuuauuguaucuauuuaauuucuaugcugcaaugauaaacuuugcccuguaauuacuacacguugaguauccuuuaccugaaaugcuugggacuugaaguguuuugguuuucagaauuuuuucagauuuuggaauaguugcguauaaacaaugagauaucuuggggauaguacuaaauguaaacauuaaguucauuuaugcuucauauauaccuuacacacauagccagaagguaagauaauuucauacaacuuuuuucuauaauuuugugcauccaccacaugaggucagguguggaauuuucuauuuguguuaugaugucaguguugaaaagugucaaauguuggggcauuuggauuuuagauuucuggauuagguauccucaacacauauauccuuuuugucccucuacacauuaaaaacuuuuuaaaaaaauguuuccaaagugauguuugaagcaaaucaaauucauaacagaaugcacucagaggaaauuuacaauggauuuaaauuugucuauuauaacaagaauuuuaugcauuuuaauaccacuaacagaauagaaauauuguguguuccuggaauuaguacauuaccaaaugacuaaauauuuaugacauuuguaauguuauagcaauacuauguaaaauguaaucugcucuuaaguucagauaaaaaauuucuaugaaauuugaauggcaaucugggaaacuaaaugaaaucuaaacucuaaacuugucucucagguuaauuucaguguguuuggccuggugucacuugauccaauuuauaaaagaaaaagaaaaagaaaaaaaaacagauuuccuuucuauuugaacguuuucuauccaaacucaggaauuauauaaguugaaagaaaaagguguaucaauuuuaaaucauuuuacugauaauucucuuaggacugaauauucagaaaauuacauauauauaccaaugcccagcuguaaaaggaaauccuucccuuaaccuaauauccccuuccuuaccacuuucuuaugacaaaacucauagaauuccucauauucuauuaaaucuucggguucucuacaaucaguauuuugucacuuguaguccacuaagagcacuuucuuuaaagucaucuuuguccucaacauuuucaagcccagcaaucaaaucuccauuugcauacauacaauucaacaggguuucucacuucuccuucuagaauuacuuuucucacauggcuuccagaauaccauguacuccugguuuuccuccugucucccaggcuacuaauauuucucuuuuccugcauccgcugcucuccuuggacucaaacuuuuggaaugcuaaaugaccuagucuuggaacucuucucucucugcacgucuuccccuccauuccuuuauuuuuauuuauuuuauuauuauuuucuuucuuuuaauuuuacuuuucccuaaguuauugggguacaggugguauuugguuacauaaguaaguuucuuuaggggagauucgugagaaccuggugcacucaucaccaaagcaguacacacugcaccauauuuguugucuuuuauccccaccaacccuucuucgcaaguccccaaaguccacuguauuauuauuaugccuuuguguccucauagcuuagcucccacauaucagugagaacauacaauguuuaguuuuccauuccugaauuacuucacuuagaauaauagucucuaaucucauccaagucauugcaaaugcuguuaauucguucuuuuuuauggcugaguaguauuccaucucauauacacacacacacacacacacacacacacacacacacacacauaucagaguuucuuuauccacucauucuuugacaggcauuugaguugguuccaugauuuugcuauugugaauugugcugcuauaaacaugcauguucaaguaucuuuuuugaauaaugacuucuuuuccucuggguagauauccaguagugggguugcugcugcaucaaaugauaguucuacuuuuaguucuuuaagaaaucuccacacuguuuuccauaguugcuauacuagcuuacauucccaccagcaguguagaaguguucccugacugccacauccaugccaacaucuacuguuuuuugauucuuugauuaugacuauucuuacaggagucuauauuuacaaugauauauuccccaaauguacagcucaaaucccaaacucaccucuuaauuucaggaucauauaauaaacuuccaauuuaaacucucaaguuugaugucuaauacaaaauuuaauaaaugcacauuuugauuuguacccuaaacuugcucaugcccccauauuccgaauauuagucaacaguaacacauuuacuccauguauuuggguaaaauaccuuggaagccucuuuacuuucucuggaucucucccaccuggcucaucuaucagaaaauccuguuuuuccgaucuucacauuauguccacaaucugauaacuguacauuuagcuaagcuaccaccuugauccaauuugcuauugucaauuuauacuucuacucuauccagugcacuuaagcaaagaauguuaucuuucuaaaauacaaacuauuucauaucacacauuuuaucuuaacccaaauauaccuagaagauuuaaauaccuuaccauggccuguaagucccuacagaaucuuccucagugcccucucagaccccauuuacuuccacuuccugcuuuucucacugaacuauacuccaauugccuuugaauauauuucuuaaguaaacuaagcagauuuucuuagugucuuaucucauggccgucauucuugcuauauccucugacugaauuauucuucaucagauauccacaugguucacauccuuucuuuggaucaagucucuguuccaaugaaaacauacuuugucacccuucauucccucauuuugcuucauagcauuuaucaauauuugacauuacaucauauauuuucuuaucugguugccucuuccaugagaauguaaguuccuuaaauacaaaaacauagcuuguugguucaacauuuuaauuuuagagacuaaaagcaaugcuucauacagaguaaauucagaauaaaauguuugcugaauaaaagaauauucucccaauuagcacacauacuacauguugguaguaaugcuuauauuaccauauacuuucaggaauauuaacuucuagaauuauaaugacuuuauuaaugaagcaaauaucuuauuuaagcuuacuuaugaaaaaaaucagguacucugcucaauaaaaugagauuauuuuuuaaaauaguacuuuuaauuauuuuaguuuaaagaaaaacauaugcaaauugcuauuguaauauaauuuacuaccuaauguuuuucauuuuaaaaaucuguuaauaaggaacuugacuacagagugauuuaagaauauuuaagaccauaaguaggccuuuggugcuuagcuucugguguucacuuggcuucccuguaucuacucaagaagcuuucggggucaacucagccucagcuucacauugaugacuacuuggugaacaacaguaggauaaaagcauaaaaaccugaagcaggaguccaggauagugaagaacuuugaauugguugcuuucuuuauacucuacuuuuguuuguagugauauaaagcauauguuaauauuccugaugcacucccaguuugcaaauucuaaaggcaaguguacauacacaaugauaguugauacauaagacuauucaucccuccaauuaguguuaaacacuaauuuugcaguguucuauaggagugaugcuguagguaacaccuugguacuaauaauagacaaaacgaaaacaaaaucgaaaacaaaaaacaaauccagcucucucaaucagauacuaguuauccagaauaccugaugaagaaauguacauaauucuuguuugcaacaaagacaucuucaauuuaaagaguucuuaacuuguguaauuaagauuucauguuccuuauuuccccuuguauuuccuuuuuugaaggucacucuaaggcagcuauuaaauauagccacacuugacuguaucucuucucccaauuccuuucuguuccuccuuaaauauagcaauuguucuccauuuaguucauauaaucuuagagauuaaaugaacauuagucuaaaucuuauuuuaggguugauaaaaaugaagacuaaaaauuaaauaacuuuccaauguauucaauuagcuauuuauaaauugagauuuaguccaauaccuucuaaauucuaauccagaauacuuuuuuuuauuauaccuuaacauugcccauauguuugucaaauucucugaaauguguguccacaucaauaugcuaaaauuugccaauuuaaugacaugaauccauagauguucuaauaaucaauuccagaacuguuuaguauuuuuucuuaucuuuuagacaucugucuaaucauuuaauuuuccaauaauuaaugaacuuuggcauagggcaaaaucuaacauaagacaaaccauucauucaguuaaacuaguguugcauucucuaauaaugugaguuugccaauguuaaaacuaaauuaucagauuaaaaguugcccuaaauuucauccuccauuauucuuauaaugaaauaugcuagaaggaagauagugccuuuuuacaaaacaaauaaauuacuaugugagaauaguuaugaguuuuacaugaacaaauaaacccuauaauugugguacuuguagugauaguagugguggaggugcaacuaugcaaggaaucgauacaaugcauacaauuaaccaggcaaaaauuaucugaaaacauauauggucauucauaaaacucaaugguugacauuauuuuuagauguauuuguguccauguguuuuuuuuuccccacaacucuauuuucauauguuuugucucaaaaacaacaaucaguuugggaccucaaguaucccauagguaagcagagcuaccaccguuagaagcugcuuaacaaacuacuuuauucacuaauguguguuuacuccagcaguauuaaacacacuugcauccuuccaggugucuuagauuuuauucauagagaauaaguauuaguuuaagaagauauuucucuccuauuuuaaauauaagaaaaaaaauuguaucacuaggucuagcaaucuaauuuguuuagaggguaucagguguguugauauguccuagcauuaaauucuuacaagaauaagagacagggaucauauuuauuuuucuaguuugaaaauaaaaacuaccuauuuucuuacagcaucacaaaccucauuaaaaugacauuuuuuucugagauuuuuaaaaauauuucaugugguuuucaaguaguacuaaaaaaaaaaauacagcucagaaugcagugacaccuaauggcaaagauaucuuuauaggccauaaauguauuuucuaauaaacauuauacuauaguaauacauucuaaguauugcuacucaccaauaugcugucuguaaucuaaaauaucaugaugauccaauagaaaugugaauaucuuacuuuuuaaaauaaagucauauacguagguguaggugaagaaaaaaaacuucuggauuaaaaagugugcuuuugaaauugcaauggcccuuuaagauaaaauuaccauaugauaaaauuagccugagauaucagaauggaauaaaauguaucuuccaucacuccuaacaauuucaauuggcuuuuauuuuuuaauaaaucaaaaguuaaucaccuggauuuuuauuccuauuuggcuuaaaauuuauaacagauauuuaguggauguacauuucaccuggcguagaaagcaaaggcccuuaguguaauggcuuauuagucaugucauaguugguaucuuugauuaauaacaacauugucuaacuuaauacacacuugaauugugcuucaaauaacuguauuaaugauacagagaagaauaguaaagccaagucccuuaguacauucuagacguuuacacaguuaucaagaacuucaggaacaaacaacuacuauaaguagaaaaaggauaaaauaucauugagacaucuuacacaauccaaaaaauccuugaggaguccuggggguuaucauuaaccaaugcaaaucauguagucaacugaaaaaaaaaaaugguaaaagaacagcacaucuucugggaaugcuuuuauaugcuguaauugucaaaauaauccuuagugcagaaguaagaauaacugguauuuuacauuuacaaucuauuauuguuuuuaauguguugacaccuuuuauuuacccgauuuuguacuuuaauuugaacauucucauagugaaaauauucuguggauuaucuuagguuucucaaauauaauaucacagcugauuaugauuucagaggauaaaguaucaucuguuugugagaaaaacaugaauaaaugcaucuuuucuacuccauguugacauaagguauuuuacuaugacugaaaacaacaaaaauaugcuagugauuuguauaauauaugaauaaguacacuguuugaguguucccuuguagagauguauaacugaggacagcuaauuuacaaucaguucugugagcacaggaaccagauaaagaaaggagcauauauuaaacuguuaaaacaugagaucuuccauaguugauaugaagcaaaacacaaacugugcaguugacuggaaaugccaccuaaucccugcugaauuaaagcagugcucuaaacuccuguuguguuuagggaguaaagagugugggacgacugauguaugaagaaaauagcagucagcguggcuaaucucaaagacuuuggagcuuucuagcuacauaaaucagagcgacuucugaauagccucauaaaacacaguaucauugccauuccacucacgacuuuuugguucuuccuacagcaugcagaucauuaggaaacuucuaagcaaucaaguaaugugggucugaugaaauuacucaaucaaugcauaggcucaaaguagaagcauaauucaaaauugcauaguuuuuauaugucaaaagaccuuucuuuaauuggggcaaagaagaucacaauggaagugauucauuuuuaaauacuauaugguuguguaucuguguguggauguguauuaaaaauauacguaaugauuaaauauuuuuaaauauuugaaacucaaaguaaucauaaaauugugcauuuuugacuaaaauaaauacauuuucauuucaaucauuaugguuuaaccauuauguuucaucacuguagugaaucaauauguuuaacaaaacauauuagaguuuaaaauguguaauugaccuuauuaaacuaccggcaugagguaaaaacugaagagaaagagagaaagaaggagaugauuuucauguauauauaaguugguucaauaccaaaauaauucaauauauaaaaagccucuuagagcagugucuuuucaucuuuccaguuugccugaacuacauauugcagcuacuuucugcuugaacacaucacaugaggcugggaaaaccuuucauuucugcauaucuccuuccaucgcuagaggugaaauauucccuuucccuccaguuucaucacauucauuccuucaguccugaacuaauauauuuccccagaaacauauuucucacauuaaauauuuaaaugaaggcaacaccuccuaaagaaaauuaauucuuuuccuauucaaacaaguaaggaaacuaauccaauucauguuaacuggugcuuuacaauuuuaauauggacauucgguuuugaauuuacuauacuuuugcugagaguagggguggaggcacugaauuacacacauacuacccgucaucauuuuuuauuuuuuuaauuuaggaguuaauguuuuucgauauauuauaaaagauaaaguuuuugaaacaauuugcuagccucaugacaauauuagguagucuauaaaacagcuaauuaucucaucuaauguacuaauuauauucaagucaaauuaauugucucagaaguaacuauaucuguuaguaggauauacacaguuaauguauacaaccaacuuucuaaagaaaucuguaauuuguacacaguuaauuuuuaaaugugauuauagccacucugacagacaacaguauacaaacuaaaaaauacaacaguuuuguucuauuuugaaacagauguccagacugcauugcaaaauaauauuuaacuaguaagggauagcaaaagcuguagguauuuguaaauaauguauuuaucaugcagaccacagaauaagcgauuuaaaaaaagcauucuuccacaggcuuucccuccugagagaugaggagccuacaucagaaaucccuaaucauacaaugaauauaaagguauuaugauuauauaucugcauuccugcuccaaucauuuacaacuagauauaaauguaugccauuucucuaaaaggagcauaguucauuucugaacucuaucagaacauugcugaaccacucaaugagaccauaauuucuugcugaaaaguucugaaucuguaggcacuguuagcccccaggcaaaacgggauccagcaggcaagcuauuagugcuugacuuacuuaaugcacaaacgcuagguuuucugaauccugaccucauuaccccuugcacagagacagacaguucuacugauauaaaugauagagaauggcagacauguuuacaaagacagccucugagaccaagagagggagcccccuggagcggaggggcuggccacugugggcgcgcacgcuagacagaaaucccucgcuugggcgggcacaaucgccaccugcagcagauuccccuaccaggaguauguguacgugcguguguguauguguaugcguguugugcgguggagaagcagggguacagaaaggggagaagcugugacccaucugucgccucaauuugcagaacaccaagccaugcguacagauaaaaguccugugcccagaaaaauucccccaaagggaccucucugcagcccagcaaagaaaccuugcuggcucgguaagcgaauuuccgaaaaagaaaucgucgcauuaacgcagaaaaggcugcaagagccugucucccgcucagcucucacggauuagcaagugaguagaguuggagccugaagcugcgagcgcugugcaugauaaugacgcgcagccccccgcccgccccugcucgccgcggccagucccggcccgucugguugccaauagguggggccaccagcaucucggagcccgcucggcaguccuucucagagucgcggcccgcaguagucccggcgccuucgcugucugccuugcgcggcuacucggaguugacugcgaggcgaggcgaggcgaggcaaggcggauaucugcuaagcagaccucgggagcagccugcgcgcauucgcuuccccgcguuucccaagcgccccggggucaguuucgccgccgcgccaggccccgggagcguguccgaggaggcgaggcacgcgacaaucaguccuuggcgacacugccgccagccccuccugccaccgucucaaagacuacacgcaaggaucauaaagccaagaagaugugagaagagaggguggcugggggcgcauccggcacccccgucaccaucgcacuaagcugcggcgaacucagccggcucacguugcaaaaccaccuguucgauccgaagggagcucccccuaccccccagcccaguucuuuucaucucacaggugacagcuucucugcucccccaaagauaaauuuuuaaauggagcaaauguacauccgggaaaaaaaauauggaagauaagagucaauuaaacucccuuuccccacacacuuagaaucccccugcaguucccagcacacacucacacucaggucaacucgagacccccacgcauccagccacauuccacgaaucacugcaaaacaacagcacaagucagucgagguucgagcauccacauccuuucagaaaacugagcaagugugagggaaggguagcgggaaggggcaaugaacugaagccaccuccaacaagacacacagagaccggagagggggaaagcgaaggggaaacauuugagaacugaaacgguaaaaguaaccacgagcugcaccaacacuuucuuaccgaugugaaugaucgaauccgcauucgccgagucccagguucgagaccaccagacggacaaaaccaagagaaaggggaaaacuuccaucuccuccuaugccgauucucuuggaggauggauuuucuuccaauuuuuuuuuuuucaaacaguccaaagaguuugaggucacgguggaguuuagcgcagcuuuuucuuuuuuucuaaauuccuauugccagagcaaagccuuuuaucgucgccgagaaaggcagaagggaaugacagaaagagcccagccugaggaaaccuccuucgcaaagccgugucacuuggaggggaauuuuggcaucgccagaguuguuugca

SEQ ID NO: 191619 - RNA, 83428 nt, Homo sapiens
gcgucaacuuccgggcggaugcccgccagcacggccuccgccgcuccccuucuuuggccccuuuguguccccgcagugucgaggcgcgggcccuggcagguccuuucucgaggcagggggcacgguagcacagggagcuucucuuugugggcgggcgcgaggcccgcuaggggguuauacuggggaacgugccugcgcgugcuuggguaagaggagguugcaugagggucagcucgugguuucaguaaggaggggcgggcgggggaggcggacgaaggggagugaaaagcaauggaaaauuuuaaaagauacccccguccaccuucuaauuguugcggccuaacaaugaagcgcagccauaacaguccugagccacuggcauguuugcgggcccuuuauugccuugggaauaaacugcuguggcauuguaucguauauuguuuucauggccuuuuuuccucucuuuauuuuuccccugcagauaguucauuuaaagcccccaucccugcaagguggugcuuucuaccaauaugaaucuuuucaaccuggaccguuuucgcuuugagaaaaggaauaagauugaggaagcgcccgaagcaaccccucaaccuucccagccuggcccuucuucaccaauuucucuuagugcugaagaggagaaugcugaaggggaaguuagcagggcaaacacuccugauucagauauaacugaaaaaacaggugaguuacaauguuaaaauugauguaacaucaaggacaguuuuuaaaagaugaaaggcagaagggauucucauuuuuauucuugaugucauauauauugaugcauuguccugcggugugcccuuuuaaauacagcuuugggacugccauaagcaccauguacccucaacugagcauccauccauugucgccucacuuuuauaugaguucuucgaauauggccccaugguggaaguugaaauuagaauuuagggcauccauaggucagaacgguugcuauuggaagagcgaugucagugauucaguccuaugauaaacuuugaggcuauuugggcagacauuuucauucauuccaguauucccucaaaauauugaucaucuacugugagcuagacauugagcaaggugccuaaagacaaccucuguacacaagggaagaucagaucacaucaaguucuugcauccaccugacuuccuggauguccucagaaugcaaaugaguaauugguauucuucauggugaaugaacauuuuuaaccucaucagcagauugucagagacaaaaguauuugaggauaagccaaaaauuaagauuuccacucgaaucuauguucauugaacaguuaacuauuagaggaauauauuugagcucuuguuguauuauaggaauagugauaagugcuucaccuucugucauuuaauuugcacaauaauccuacaagguagauauuacugacauagagguuaaugugaaaugagauucagagagguuauuaggaacuugguagagccugaacucaaguccuggcaguaugauuccugagcauaaacuaauuaguuaguuucuuaggaaaggugaaaggaauguuggaaguuauauuuuaauauuuauuucaguaauaucuuuuuuuaugcaaaacucuguuucguaaacagcuuuuaacuuaauguagccugaaagauugguaacacacauguuuauccuugguaucuuuuuguuugccacccuucuacuuaaauguaauaaugauggcagauccucugcaaguuaucauuagaauaacauuuuuaaauacuuugguguaauuggaaauuggcagaaugauuugguagauuggauuaggagucagauuuacaaaggcuuugucuaaguaguuuugaauuuaaaugcuauagggaacaacugaaggauuuuaagcaccaggauuuuaaucccuguguucacucuuugaauagauauuugacauccagguauuuuaaugcuuuuccaaugaauauauuugucuguuuccucuguaguuagauaguucaggaaagccaagguguagacaugggauuucgaguccauagaagcuucugcuucuucauuuuuguuaaaugugggacauuagacaagucauuugaaaucugugauccacacuuuuuucaucucugaaagugaaagcaguuuguaaacuggauuucaguggaauguuuuaguuauuuaucaguauuggucaugugaaaucuuuaauuuccuuuagugaucagaagauauuuuucuguuuuuauuucuuucuaaugauaacacucauuuucucuuuauugggacuuuuuuccauacauaaauucugcuuaaaaacugagauugcuuuaggaauuacaugaucagccuugauggcuucgggaaauaagaaaacuaaguuuguucuaggaauguugagaauuaauccuuguaggaauggagcacuuugcuuuaauaaaagauuguuuuaaaugauacugugaauuuuggagaaucuugaaaacugagaaguuuagauuuuacauuguaaguauuagauauccauugaagaacuuacagagugaauggaaaauggugaaagaaaguuuuaaaagucaguuuagcaguagugacuaguacacacugauugaggguagggauugaagggaaagaaaacauuuaggcaacuccuguaauugagcuuaaugauagcgguagaaauggagaagaaagagauaugagagguuucaaaguaaugaagggcaggguuuagaucccugaugggaaugagauaagaugaaugguaagauuuuuaugcgcgguggcugaagccuguaaucccagcacuuugggaugcaaaggugggcaaaucaccugagaucacaagaccagccuggccaacauagugaaaccccgucucuacuaaaaauacaaaaauuagccaggcaugguggagcgugccuguaaucccugcugcucaggaggcugaggcacaagaauugcuugaaccugggaggcagagguugcagugagccuagaucacaccacugcacuccagccugggggacagagacuguaucucaaaaaaaaaaaaaaaaaaaaagguaaaugucuuuaagaauucaaauaagaaucgaaggucuggcugggcacaguggaucaccccuguaaucccagcacuuugggaggcugaggcgggcugaucagcugagguuggaaguucaagaccagccugaccaacauggagaaaccccguuucuacuaaaaauauaaaauuagcugggcauggugguacaugccuguaaucccagcuacucgggaggcugaagcaggagaaucacuugaacccuggagguggagguugcagugagccgagauugugccauugcacuccagccugggcaacaagagcaaaacuccaugucaaaauaaauaaauaaauaagaauaaaaaucaaagguccugcccccaagugcuaauuuagccuggggucuagggauugcugaggaaguggggauucagaauugaguguuggaucucuggagaggacaagauacugaaguuagauuuuaaggucaggacuggagaugaaaauuggugaauuauaaauaggaugugacuauugaccuuacuucuuuaucaugugguaacuuuucauacucccauugugggauaaugcugcguuaguuuauuuacaguaaagugucaggucaaacuaagucagcuuacaggacagaaauuguauguagucaaaauuaccuguaaucacucuuuuugacuaauccuguuauuuuaucuagugaguugacuucauuuccuaugacccuccuucaguuacugugccaccaccacauuguuucuugaaucuuucaagcaaggucccaucuuugcuucuuccaauuugcuuuuuugccuggaagacucuuccugcugauauuugcauaugacucagaugcuuuguuucauuaaaucucaguaaaaugucaccuuuuuaagaagaccuuccuugaucacccugugaaauagccacccaccccagcccacccuaccccagcuuuacuguuauuuuucuucauaguauuuaucacuagcuaaccuuucauuauguaguuguguaucacuagcuaacauuacauuauauaguugugacucccuuguuagaacauaugauucaugagagcaggaccuuaucuguuguguucaccuauuuaucuccauuguucagggcaacgacuggcuugucguaggcccucaauaagugcauugaaguaaauauuauugcaugaugagugggcauuauuaguacuuuauacauuuuuuaaaauuuauuuauuauuuauuuguuuuuagacaaucucacuguguggcccaggcuagagugcaguggcagaaucuuggcucacugcaaccucuaccuccuggguucaagugauucucauaccucagccucccgaggagcugcgacuacaggcucaugccaccaugcccggcuaauuuuuguauuuucuguagagacggcauuucgcuauguugaccaggcuagugucaaacuccugacgucaagugauccacgugccuuggccucugaaagugcuaggauuauaggcaugagccaccacgcccagcccuauacauauuuauuuauuauuauuuuuuugagauggagucuugcucuguuaccuaggcuggagugcaguggcacaaucucggcucacugcaaccucugccuccuggguucaagcaauucuccugccucagccucccaaguagcugagacuacaggugcacaccaccacagccggcuaauuuuuguauuuuuaguagagacaggguuucaccauguuagccaggcuagucucaaacuccugacuucaggcuaucugccugccuuggccucccaaagugcugggauuacagacaugagccaccacaccuuuauuuuaaaauaggaccuuaaaauagucccuuuagccaucagguguucuuuggccaugguugcuugaagcuucuuuugguacaggacauccucccuaaugccccucuaaaucccagccagccuuuggauuugagggcauacacuuaaccucugcccccugauuuauuuuacucuucucggugcccaaaguugucaaugauuguuauuuacacauuauuucuccuuuuuuucuuugacuuuugggaguacagugaguuuggagggauugaaauaauggcaggugaaagggaagagagauccuacuauauuuuaugaauaaagaauaaaaaugagugaagccugauccuccaagagcaccaggagaaaaugguauguaaauauauaguuaaaauaguauggugugauaaaaccauauaauagggcaaaauacuaagcaaaguagaaucacuaucuguaauucacaaaugauugaauuauccauucuucaggggaggaucacaaaaagucacagagauaugaccuuuggaguggacucuaaacaaugaaaucauuguuuacugggugaacaaaugaugagagaguugaaaauauauguugccuccaagagucuaauauguguguggaggguugggggcagauuauagaacaggagguuuuagacaauauagaugaaacugaaaagauagaaguguaaaccauuggguugugaggggccuuuauauccugugucagggacgguagaucuuauuugguacacaucauagagcauuucauuauggaaaugcuauuagugaagcuguuguauucauugaagccucaauguagggaaaugacuguagagaugacagaggaggcaacugaggggaguuguaaaugauacgcauuugaugauauuaggugaucaguugaauguggaggauuuacagauaacucaaauguuccuugcuuggacagcuggaggauugacaccauggacugaauuaagaggugaguuuaggagaaagauacuaaaaauuauguuguguuugcauuacccauccuauuuuaguaccaagguaguagaugguugaauauuagagcucagagaguggucuaaacccuagaacuugggacucaucaauguccuaagcaggguguacaauaaaaaacaucauuugacaaugggcaggaaaaccaaugaaaaauuugaaggaugacuagaauagucauagaaaaugauaguguccuggauaccuaaauaccuaguuugguauuuaguugucuaguaacaaauccuguagagaagucaaguugaguggggacugaucagugaccaguuuccuuggaauuaaaaguaacuacuaaccuuuaacaguuucaguagaauggugaugagauagagauuauucauucaggaaaggaaagagagaaauagguaaccugauugggaaguaaugucaagaaaauauguuucaggauuauugaaaauugagcguucuuuuguuuuuuuuuuuuuuuuugagacaguuucacucugucacccaggcuggagugcaguggcgcaaucucaacucacugcaaucucugcucucggguucaugccauucuucugcuucagccuccugaguagcugggacuacaggugcccgccaccacgccgggcuaauuuuuuuuuuuuguauuuuuaguagagacccgguuucaccguauuagccaggauggucucaaucuccugacuugagaucugcccgccucggccuccuaaagugcugggauuacaggcaugagccaccgcaccuggccaagcguuuguuaaccaaggacaagaagcuaguggagagggaaggacugagggagggagguaucugaagagaggcaucaagugaugagaacugaagaacaguuggacuguuuaacugugcaaaagaauaaagacauauuuucccugggggggauaauugaaggagauaaaaauagauggguucauagauuauuuuggcauuggcggaauggaggaaaguuuuaguauauguuugaugaauuuuuuuuuuuuugcugaaauagauuuaguccucuagagugguugccuuuucaaggugguugucauauugaaaguagcacuuguugauaagugagagacauuuuuaaaacuauaccagucgucagaaagauuuccugagaguauugcucugccacauacagauuguaugaucuugaguaaaaagucaacuguuugggucuuacagucuucuccuggcuuugcuuaguuuucuguauuccuugcccacauuaaaaugguuauuauccuuugaaugaugauacugaauguaucauuuuagcuucauaauuccgugaccauugcgcaauacucagucuuuuuguaggugucuguggccaaaaugugagccaucguuaaaccuguagauagucauugugguuucuuaaugucuguuaauguuaauugaaaagcaauacuuaguuaaaggguuagugcugaauuguuguaacagaaaguacaauaaguacucaaaaguaaguaggaaucuuaagugcauuuuaaaugugcauguauuuggcugggcacaguggcucaugccuguagagucgcagcacuuugggaggccgaggcaggaggauugcuugagaccaggaguucaagaccagcuugggcaauguagugagacccugucucuacaaaaaaugaaaaaauuagucaggugugguggugugcaccuguaguccuagccacuugggagguugagacagaagaauugauugagcccaggaguuugagguuaugguaagcugugaucacuacacuacauuccagccugggcaacagagugagauucugucccaaaaaggggggugggggggaggagggggauagaaauauuauuuuagucauugucacuucacccuacacacaaauuucacuaguuuguaucagacuacaucuugguuuugaugucugcuuuuucauaccugucuaaaauauugcagaccuuuauuaucuuuaauaagcuaauaggcaaaaguauguuauuguugcuuuuucuuuauuuuuuaguuuaaguauguuuucauaaauuuacuagccauuuggauuuuuuguguuucuuuaugcuuuucuguuuuucuaauacaugucucuccgauaaauuauuuguaaguauaucuuaaauuccacgugucuuagucuguuagaacugcuguaacuaccaugaaccggguagcuuauaagcaauagaaaucuacucuuggcaauucuggaggcugggaaguccaaaaucaaggugcugcaagauuagguaucucagggcccuauuccuagaccacaaucuuuuaaccccauguggcugaaugagugaggggucucuugggccucuuuuauaagggcacuaaucccauucaugagugcucugcccccaucaccuaauaccccuuccucccuccagcaaaugucaccuccuaauaccauuaccauaaugguuaagauuucaacauaccguuuuggggaguggggcacaaacagaccauagcacccccuuuguuguuugccauagaaaaauuuuagauuuuuauguggucaccuuguucauccuuuccucuaagucuucugcauuccgcauuaccacacuauaaauauacucauucauauuuuccucuaguaugucuguuaauuuuaaaaauuaugauaaaauacacauaagaaaauuuaccaucucaaccauuuuuaaguguacaguucaguacauucaguucaauacauauacauugucaugcaacuauucuccagcacucuuuucaucuugugaaacugaaacucuuuaugcauugaacaacuacuccucauuucugauucccccagcccccggcaacuaccguuuacguugucuuuuuaugaauuugacuauucuaaguaucucauuaaaguggaaucaucacuuagcauaacauccccaggauccauccauguuguagcauauaucagaauuuccuuccuuuuuaagacugaauaauauuucacuguguguauauacacauuuuguuuauccauucauccaucaaugggcacuuggauugccuccacaucuuggcuguuugaauuguauugcaguaaacaugaauguguaaauauucucuuugaaacccugcuuucaguucuuuugguuguauacccagaagugguauugcuggaucauauaguaauucuauuuuuaauuuuuugcggaaccuccauaccguuuuccauaggugcuccaccauuuuacauuucugccaacagugugguggguuccaguuucuccacauccucuccaaccuuguuauuuccuguguuuuugauaauagccaacauaauggacaugaguuuguaucucacuuuggguuucguguugauuuuuaacuuuaaaucuccucugaauuuuauuucauuauagggacuaaagaaagggugauaucguuuucuccuuuguucauuauucaccaguuacuagucaguuuuucauuuauugaaaaauccuuuuucuuacauuaaaaugucaucauuauagucuaaaauucccauguuuguuugcaucuuugggucuguuaaucuguuccucuaaucuuaauuuaccagauuauuuuaauuuuuauagugucauauauaugauguauccuagauuuugauguguuuuuguuguuguuguuuucucuuugaccugaaaguuguuuagaagccauuuuuaugagguuuugucucuuuuuaaaaaauuuccaacuggcagaaauuuugcuugcauauuuuuguuaacauuuacuucuaauuucacuguuuugugaccagagaauguggucuguaguauuucuucuuugggggaaauuaacucagauuuucuuuguggccuaauauuuaauuucuguaaaaauucaagggugcuuggaaagaaaacauaaucuaaguacagauuuaauuauaugucgaauaauagaugaguuuuauuauaucuuuguuuuucaaacuggaucauaaacauuuauugugucauaaaaucaauuucuuggguccugacuaaauauguauaacuacaauuuuuaauggaguagaacaaauagaaaauuaucaaaguguauugcuuauaguaagagcugcucacauuuucuuucaguuacacuugcaaaucuaacaaucugugugcuuaguaucauaaucugaaauaugucucucacaguggguuucagucaaaaauguuugaaaaacacuguucuacaucuuguuuauuuuugugcucuugcuuuauuaagagcauagagaaaaguuaaugcuucauauuugucucuugacucuuugccuuauauauccuacaauuuuuaugcauuucauuauuaguauggaguugggauaugucaguuauauuuuuauuguagguauaaagucuauuauuuagaagucccuccuuuagguuuaacgcuuuugccuuguucaguguuaauugcaugacuuucuuuuccuuuauguuuuaauuaauuaauuguuuuauuuuauuuuuuuuuugagauagagugucacucugucccccagacuggagugcaguggcaugaucucucucacugcaacccccaccuccugggcuccugaguagcugggaccuccuccugacucagccuccugaguagcugguaccacaggcaugcaucacgacgcccagcuaauauuuguauuuuugguggagacaggguuucaccauguugcccaggcuggucucaaacuccugaccucaagugauccaccugccuuggccucccaaaguguugggauuaccgcacccagacuccuuuauguuucacccuuucuuuugacuuaaauuugaaaugggguuuuuucccucauuuugucuuagaaugauguauuagaaacuacucuuuaaucuuauauuuaguguauuguuugucuuuucuaggguauuuauuagagaguuugauucaucuuuuauuaagaugcuaaagguauuuuccugucuaccaugauaugcaaauuaagacuacagauuuuauagucuauuguuuugguaauaacucuuuugagacagagucucacucugucacccaggcuggagugugguggugggaucauggcucacugcaaccucugucuccuggguucaagcaauucucaugccucagccucccaaguagcugggauuacagaugugcaccaccacgccuggcuaauuuuuguguuuuuaguagggacaggguuucaccauguuggccaggcuagucucgaacuccugaccucaagugaucugcccacguuggccucccaaagugcugggauuacaggugugagccacugugccuggccauauuuugguaaucuucuaagagggcaaauauaugauguguuuuaguugguauuugaaggaacugccuugaaaaucaguugccaucuaaaggauugaacaguguagagcaauacaugauuugaauaucagaaacggcagggauuuauaauucugcaagacagguauaaagguuuagguguuuuuauucuauuuugggagaucaccuuuguuuauggauuaucaaauuaauuuaaaguauuucuaugugaauucauaaucucccacuagugauuuuuuuuguucgaaugagccuuaaucuccuacuagugauuuuuuguuugaaggagccuugaucuuggaccaccgaaaagguaaaaccaguggcaagcuugaaugcuuguuuuaugguagacuuagauacgagaacggguaaaggguacuggauaaacuugggauauaagauugucuucuuuuaugcauaccacucauaccacuggugggaaauuucauuuggaauuacucccuagggccauggagucuuccugcauaugcuaauaauguaaguucccauuaccuuugguaauaagaaaauaucuuuaaaacaaguuagcuuuuccuauuguuuuuauauggaaggacaggcuguuuucccuccuguucauuuagcauuuuguguauucucucauugcacaaauuaugcuuauaacauaguuacucaugaacauggcuacuucacuccuauuucaaaagggcaaguugaacuguaacuugccauuauuuugcuuuaauaucccccaccugguacaaugccuuaaacacagacaauauucagcauaugucagaauugaauaguagcagaugucuuuucuuuauaacuguuucugcuuuucacuauucuuuccucuguuuuuguaguuuuccuuuuugcuuccugucucuuuuaugguacuacuuaaaagugccuauuugcuuugaauuaaaaagcgucauugcagcaggaauaucuuuuuagccauuggcuguuagcuauuuugcuguugcuuacuucugaaaauaguccagauaaacaaaucuaaguguucagcacuauucuaauucugauuauugacuauaccaguauguugauauauuauaaacggcuuuuacugauuuuauuuauuauuauuauuuuuuugagauggaauuuugcuuuguugcccaggcuggagugcaauggcgugaucuuggcucgcugcaaccucugccucccagauugaagcaauucucccaccucagccucccuaguagcugggacuacaggcgugugccaccacaccuggcuaauuuuuguauuuuuaguagacacaggguuucaccacauuagccagauugcucucgaacuccugaccucaagugaucugcccgucucggccucccaaagugcugggauuacaggcaugagccaccguguccagcccucaucaguuuucaaaguguggucugugaacuuuuugaauguucccugaggacuucugagggugucuacaagaucaaaacuauugucauaauaauauuaagacacuacuugccuuuuucacgauauugauauuugcacucauggugcaaaagcaaucauagguaaaauugcuggugccuuagcaccacggaucaaggccaaggcucuagacgguucuaguagucaauguauucuuaaaauuguguaaaugccaguaucacuuaaagacucuugaagcaguaaaaauuaguaauuuuauuaaaucucaacuuaggagaugucuuuuuaauacuuugugaaacaaaaugugaaguacgcaucacugcauaccguacaacagugaucucaagggaaggcguuugagcaauugcuuugugcuaaccagucacguuucuuucccagaacaccacugauucacaaaguaugguuauacaaacuuaggaauuuggcagauguuuucucaaaaugaacaaaguaauacaaagaaaacaacacaguauguauuuccagugauaaaaccccaguuuucaaaggaaaguuugaauuuuggaaaacuaguguccaugacugugaguuugacagcuuccagauacuuagacauuucugagaagaucaauggugauauuaacaaaaguaauuuuuuaauauaauaucaugaaaugugucgaccuuuggaagauguguauuacucagugaacuaguauuuuccaaaugaccaaagcacaguauuaggaaauaauacaugguuaacgguuuuaacguaauagaaugcaaaauguuuuuucguaugguuccaguuuccacauugcaaauaacucuaagaaauuaccaccugucaaguuuggguuuaguaucaaagaaaaauauucacaauaaucuaaaaaggcuaugaaaguaccccuccuuucuccaacuacauaacuuugugaggcauaauuuuuucacaaaaugaaaugaaaacaauguauugcaacagauuaaagguagaaacagauaugagaauccagccaucuuguauuaaaccagagauuuugacaaauauaaaacagugucaucugacuaaauaaauuacuuguggcuuggauauauaguuuucaugaagauguuguaggggagccagagaucacuuccaacucccguuuagcucuuauaugggcucuuuuggcugaaucuagaaaccagaucaacaccaggaagauuacaaaagaaaagcguaccauuuuauuaggucuauauguacauggagaucuacccgagagaaaucagaagaacugaccaaagcaagaugcuuuuuuacuuuuuagacaaagagcaauaaauuugagaagaaaugauaggacaaaggggaucuggcaaugggcagcaaacuuuuaggggagucacuaggagacauaugggggguguaaaacugguggaagauaaguguuacuuugguaaguauauuuaaucaggucugugcaacccucaauucucagucacuggugauaagggcuauauauuugcccugguacggagaggguaccccucccagaggagccuucaugacuugcugcaugcaagaagagaugagucagcuacccauuucugaaacuacaauuucuccaguguugucaacucauaucaaugguuuggcauauuuugaaaugacauguuuuucauuacuucaauauauuauguuaauaugugaaauguuugguuuuaaguaaauaaauauuuaaacauucacuuuuauuuucaaguaugguaaguaucagagauacaacugacauaaggaaaaacucuuugggacuuaaagaguacgaagggguucugaauuggagaaauguuguaucauagcuuuuccucacccagccccccacccccaacauuauacuauuuccucuguuaaucacuugccaagcaggcugugaggaugccacuugguucaguacagucugcauguuuaauguauauauuuugagaguauauauuacauaucugauaagugcuaaguaauugaguacauaaugggaaguaagccaaauuuuauuuuauuuuuucuguauucuucuguucuguuaacuaagcauauuaaagguuaauuuuaaaaauugaggcugggcuugguggcucacaccuguaaucccaacauuucaggaggccgaggcagguggaucaccugaugucaggaguucaacaccagccuggcaaacauggugaaacccagucucuacaaaaaaauacaaaaauuagccgggugucggggcaggcaccuguaaucccagcuacuugggaggcugaagcaggagaaucacuugaacccgggaggcggagguugcagggagcugagauugugccacugcacuccagccugggcgacagagcaagacucugucucaaaaaaaauaaauaaaauaaaaauuguuaugucuucaccauguauuuuguacuacagucuguuuaagggagaaaaacaaagaaaaggucaauaaagagucauguucaggaaguucuaguucuccuaauccucacuaauuaaauuuuuagaccccccuacaggugaaaagauuauucuucauuuuuuaucugcaguccagugcucugccucugagcuguaaccccuccugucuucauuuuuaauaaagagggccgggcgugguagcucacaucuguaaucccagcacuuugggaggccgaggcagguggaucacgaggucaggaguuugagaccagccuggcagauauggugaaacuccaucucuacuaaaaauacaaaaauuagccaggugugguggugggcgccuguagucucagcuacucaggaggcugaggcagaagaaucacuggagcccaggaggcggagguugcaaugagcugagaucacgccacuguacucuagccugggcgacagagcgagacucugucucaaaaauaaauaaauaaauaacaauaaagagaguuuuuaaggaaaacuggacaauucauuuucucauagccuuuccuuuuucuuuuuuuuuuuggagacagaguuaagcuuuuguugcccaggcuggagugcaguggcacgauccuggcucacugcagucucugccucccagguucaggugagucuccugccucaccuccccaguagcuggaacuacuggcgugcaccaccacucccggcuaauuuuuuuuuuuuuuuuuuuuuuuuuuaaaguagagacgagguuucaccaccuuggcugggcugaugucgaacuccugaccuugugauccgcccaccucggccucccaaaguucugggauuauaggugugagccaccgcaccuggccucucauagucuuccugaagugucagaaaguaggacuuuauuguuaaaguguucaauugacaggcauuagcuuuaguucucauuuuuaauacaguaaagaucuaaauuuuuaguuuuauguauuuuuagauuugugauacaucagcaaaacuguaaaaucagagucuaaaguaccucuauacuuacuauauaggaguuuggacuguuuuauuacuuuguguaugaugauaauauguagguuucuucauguuuauggcaauuaacauggaugugauuuauuccacuacagaguuguuugcucaacuugcaugcaauguuuauaaaauuguucuuuuggaaaaaaguaugauuugcuuuuugcuguuguuccuaggacugcauuguaggaaauagagaaauguuuguguuuuggugcucucuagagcaaauaguaguuguauaguacuugguuguuguuacagguugaguaucccuuaucugaaguucuugggaccagaaauguuucucauuuuagauuuuggaauauuugcauauacauaaugagauugggaauggaacccaagucuaaaacccagcugaucuguauuucacauacaccaaguuugugcguaaaacaaaguuuuuacagcauuuuugaucacaugagaucagauguggaauuuuccacucuuggagucaugucagugcucaaaagauuucagauuuuagaacauuuuuuauuuuggguuuuuggaucaggauguucaaucuguauuuacagauacagcucgugagcccuaauaaugauuguuauaauuuaguguuacgauuuaauggagguggcuaauaguuuuaggguauaacaguuuagacuuuuggacuuggauuucagaucuacuuucuccuauaugacuuugggcaaguugcuuuuucucucaggguuuauuucucucuuucaugggggauaugugucccucaugauuauugugagguuuaaauguuuauuauauuugaagacuugauaaugaccuacgagagaauuaaugacagcuaucauuuuuaaccuuugaacuaaagauucaacuggucauugcuuuuuaaaauuaauuuccuagaccaggcacuguguuuacuuuaauacgacucccuucaaucugauccauuccuccuaaaauauguaaggguaaauggugguuuuauuggcaaaagggaaaauaauguuggaauuuaccccuuggagagaagagaucuugguguaauacuuuauugaccuguuuuugaacagacagaugauaccaaucauacuaguuuucuagaacugccauaacaaaaugcuacagguucggugacuuaagaaauuuauuuuucacaauuguguagcuuugaaguccaagaucaaguuggcauguguuuucuucuugggccucuuuccuuggcuuguaaggugaucuccuuccugccuugucuucaaauggccuuuccuucuuuugcaucccggugugucucccuuuucuuauaaggacaucagucauauuggacucagagcccauccuguaggccucauuuuaacauaauaauuuugaggguacaaucuccaaauauagucacaaagaguagggcccacacacaugaccucaguuaaaccuuaauuaccuuuuuagaggccucaucuccaaauacaauuacauuuugagguauuggugauugggacuuaaugauggggaggaguacacaguucagcccauacaccacauauucauaagagcuaauauuuaugggaugcuggcuaugugccaauuacugaacuaaaugcuuuacauauauaaucugauuuuauaugcauauuaacuuugugauuauuaguaucuguauuuacagaggaggaaauuaaggcuuagagaaauuaauaagaugaagaggugggauuggaaucuuuugggcugugguguucaugcugucucaaguaaaaccuaagugcuacaaaguaaaaguacaagaggaaaguauuagaauauaaaacacaaaccuauguuauuuugcaguuuccacuaaagucuuguuaguaaacaaccugugaaacagaaaauguaacaccagcccugguugaugauuaauuuuuuucuuuaaaaaguggugagaauuuugauuuuuagauuggaaacaaugaaugaaauuugagauuuuagcacaugauuauaacuaacaacagauucguuuuccaguugcucaaaauauuuuucuccuuuuuauucucuugcagaagauucuaguguuccagaaacuccagauaaugaaagaaaagcaaguauaucauauuucaaaaaucaaagaggaauacaguauauugauuugucuucugauagugaagaugucguuuccccaaauugcuccaauacaguucaagagaaaacauucaacaaagauacagugauuauaguguaagcugauuaauagauauauuguauuugcaugugugugagauuuuccaagaaaaaaaccuaccuaauuugagauauuuuggugacuucccuuuuuuuuuuuuucuuuuuuuuuuuugccccaccugccuuucuuggccacaucuugguuauuuucucuaacuuauagucauggagagguacaauguguguguuuucuggauaacagugauuuuuuuuuuuuuuuuuuuuugauaacagugauuuugagagcagauacuuaauuuccuuauuauggaaguuuaaaagaauuguuuaguaccuuugaucguguauaacugcuuuaugauuuauucuaaaguccaugaaucaagucauuuuaacauguuuauuggaaacagucugagcuaggcacuguuuuaugauuagaaauacaacagugaacaaaccauccccagcuuucuuucugcccucacacagcuuauauucuagucagguagaaaaguaauaaaagauguagugugucaaaagauaaguguuaugggcaaagggaagaggaauagggaguuagggucagggaaucguuucuuuuuuuuuuucuuguuuuuucuagagguggggucuugcuauguuguccaggcugcucucagacuccuggccucaagcaguccugccaucucagccucccaaagugcugggauuacaggcguuagacaccacaccuggcucgagggucagggaaugguuucuaaagagcguggucagaaaagccucaauugagaagacagugcuuaauugagaagacagugcuggagcaaagacauaaagggggugagaaagugaaccauguagaugugggggaaagaguauuccaggcauugggaauaucauguucagugacuauauuaugccugguguuuuugaggaaagugggagggacaugaugcggagugaaggaucugaagccauaguguaaaggaugagaugaaggaggggcuucaucacauuaguuccauaggcuguuugguuuuuauucugacugagaugggaauuccuaggagaauauugaacagagagguaaaauuaucugaguuagauguuuaaaaggucuuaaugacugugagggagcaguaguaaaagcauaaauauuguuguaauaacccaucaaaaaaugauggagacuuagaugaggcuagugccugugggagggauaauaagugguuagauucuggaauauacuuugaagauggagcaagagaggauuuguugcuggauuucauguggguugggagauaaaggagucaaggaucacccuaagauuuuuggccugagcaaacuggaaggauggaguuacuagguacugagauaaaggugacuguuucugcugugggugggcaaacaccuuuugaaggaaagucagcaauucauucuugaacaugcuaugauugagaacacuccuagacgucuaaauggagaugucaaguagguauaauuagauuugggacauuugaguucuggggagagauuacaugucugaauuuacuaggugacagaguauugguuugcuauuuaaagccauaugaucagaugaaaucaguguaagggacacuaguauaguauagcugaagaagggaaguccucuugguugaaauacugaggcuaggggaacucuggauuuuuagaaucagggagaugagaagaaaccuguagaagguucugaggaggagcagcuauugagguaaaaggcuacauggucuucuagaaguuaagugaagauaaaguguuguaagaaagagcaagagaucggacugucuacuucugauaagaugaggacuucaucuuaaaaugaacuuuucacaugaagcugugauaaacaugccuaauucugaaauguacuccaagauaaaauguagugaagauccugcaugguuaauccugaggaaaauugucauauuuuggaaaaauuguagaaaaguugcaaaaaaaaaugcauuaucaacucucacagucuuuucagaauuacccuuguuagcauuuucccacaauugcauuaucacucuucguaaacagcaauuacaauaacuacugaacacuuugccugcaguauuuucucauuuaucuccuaaaaacaaggucauucauucauuugcauauuaacaguaauauuucaaacccagaaauaccaauuaacacuaguacaguacuauuaucuaauauacuuuucauauuucaauuuugccaguuauaccaguaauguccuuuagagcauugcuacucaaaauacugauuuauaaauaaggaauaugucuuagaaugcaaaucaggguacugauuccuucaccaagaauaucuugcagugaaaaaaaaaaaacagcugaacuaagcaaugugcucaguaacguaguuguuuacguucuguugcuaguuccuuauguugucauggacagacuacaguuggagaacuagcagucagucccuggaccauauuuucaguaguacuuuaugguaauuuuuuuuuuacaguggauuuaguuugucauaucucuuuaaacucauuuaaucugaaacuauuucucagucuuuuucuguuucucaggauacugaccuuugaagauaauaggccagguuuuuuuagaauuuuucuaaauuuggguuuaacuaauguuucuucaugguuaaauuuagguuaaguggaaagacuacuacauacuacuaccuaaaugaucuugugucguccucagugugucauaucaccuugaggcaugugucaggagacacaugauauccauuugucccauuauuguugaacuuugaugacucaauuaacguggccccugcuagguuuugucugucaaguuaccauuuuucccuuuguaauaaauaaguuaucuguggagagauacuuugagacuggguaauaguccuauucgcuagccagcuuucacucaguaguuguaguaucuauugauuuuugucggauuaauuuaugauaaugauggugggaaaaugugguauacuaaccaguguucuagaacuuaacacuuguauuugguagucuguaauguuccuuuuucuccccauuugugcuuuuauuuaugugguacaauaaauaucaaaaugaaauuauagauguguacuuauucagugguuuauaauuuaguacuauuauuauucauuuuggugcacaaauuucucaguuuuggcagcugagggccucuucaaacaggcuguuguguuuguuugagggauuccuaucauuuuccuuucuggaacaagguaucccagacuucuacuucuccuaccucaagccugaaauaaaaauuagcaauuucuccaaguaguucugguucuuuuuaguaggaaaugauacuuggaaauauagaaacuucuucuguguucuuucuuugcugcuggugagguaggaauuaaugucauugcccuuucagcagaaggaccuaggaaauacucggguguaggggguuggaguuagggagagagagaaggaaaaaugugaaaaugugugguguuuuuuuuuuuuuaaucauuuguuuacagugauacugauaauucuaaucuaucacuacaggucuuuucuuugccucucauucuguuuucuucugacagugagaacccugacuucuaccaguaucaguauauuuuacuaaucuguucagucaucaaguaugcauaaaauaguuuuagaauagcuacacccauacuacuugaccauugaggguauacagucaaugcacuuggauuauuaauuaauuaauuuaaauguuuuguuauucauuugaaauaccauuaauuauuuuguauuccuuuuaggguuuuucccuuguucuuuucuuuuaaauuuuacuuucaaauauuuaaaauaugaacaagauuccaaaaaucaaaacucuacaaaggauauacucagaucccuuacucucuuucugucccuucuccauucaaaccuuagaacuaaccaguuuguuuaguucauugucauacuuucguguauuuuuuuuuuuguuucuuacacaaaagauagcauacuacauguguguauauucauuuguucuuuuauuuacuuagcauauauguauauaucuccuggaaaucauaucaguucuagaaauuuuuauuauuuuuugcaacuccauaguacuacauugugugaacauuccuuauuuuauucauucauuccccauguaugggcauuuugguuaucacaguuucuuaagcuugacauuuauugacauuuggagccagauaauucuuuguugugaggugcugcccuguacauuuaggaugguuaguuaaguaucucugaccucaccccagcagaugccaguagcauuucccuagucaagacaaucagaaauaucuccagacauugccaaauauccccuugcagcaaaacuacccccuaccccaacuuugagaacccacugauguguaugcuagaaacucuggcaguagauaaaaucuccuaggaagcauucauagacaagaaagaacugaaggcagaauccuagguagcuucagcaguugaagaaggugaacaaaggaagaagagccuguuacagagauucagaaggacaggcugaaagguaaaaggaaaaucagaaguaauguugcagaaccccugaggugaggguggggccaaauuuucaaggauauguuugucaacaauguacaggacaacacaggaaaacuuagauaagcagugaaaaguuuuuauuccauucagcaguuuaaaagacauuauuguccuuagugagaacaguuucacugaguuguugugcgaaagauguaaaaacaauaaguuugagaacuccauaagaaaggauguagaaaaucagucuaauaaaaucugugaaauggaggagaaugggguuuuuuguuuguuuuuuuucuugcugcuguguccacagugcccggaaacccuggcacauggaauuaauugaauuaaugcagucuugagcacauugccgauuggggaggaagagcuuaugaagagagaaaagauucaggagaaacauaguagauaguuagagcagagucuuguagauguagaaagggcuagaaugccuuagcagugagaggggacuuugucuuuaacaggaaggaacuucuuuaucugagacuggaaaaaagagcaaguggucaacucuguuguucuuacagguuuuuuucuucuguuuuuaaaguuucaagcacacaagaaaaugaaauaguauauaaagaacaccuguauaccuuccaccuagauuuaacaguuguuuuccuuauuuguuuauugugucaccuauuauuauuuuuagcugaaguauuuuaaauuacggacaucccagcauuucuccccuuaauacugguuauguaucugccaucuaucaaugaacaauucucuaauaucauuuaacuuguaccuuagguucagauuucauguuuuuuauagcugauuuuuuucaaaaccaagaucuaaauuacauuuggcuauuaggcuucaacuguguuaaucuagaaugggccacuccccuuuucugcuucucuaaagagaucaagucuuuucucagaaaaaacagauuuuucuuuuucuuuccuuuuucuuuuuagacagagucuugcucuguuacccaggcuggagugcaguggugugaucucagcucacugcaaccucugcuuccuggggucagaugauucucaugucucagccucccuaguaggugggauuacaggcacccgccaccaugccaagcuaauuguuuuaauuuuuaguggagaugggguuucaccauguuagccaggcuggucuugaacuccugacuucagguaauccacccacgucggccucccagagugcugggauuacaggugugagccacugcacccggcugguuuuucuuuuucuucaugacauuauuuauuuucuaucacuuguauuuccuguagucuggaagauaaauccaagccauagugauauucauugucagcaucaauauuuauuacaucaugaggcacaugaauuuguuagaucauugagucugaucacuggauaaagguugugaccaccagaagaguaaauaucuuugaaagugguuauccagggcaggaauuauaaaaggauuuuaaccugaaugcuuucauuuucucagucaccuaagaggcaaggucaaguagggagcagggaauauagagaggcauaaugaaaauucaaaguugaguacaucaggaaugagaagucuagguauaauaaugcaaaggaaaugcaugugauuguccucaaauauuugaaggacaggcauagugauaaaggaagagguguauuugccucguuacuuuagagcgguuucucagagcugaucucaggaagucaaccuagaagcuuuugaaauacguacacuggcuaggcaugguggcucacaccuguuaucccagcacuuuggaaggccaaggcgggcggaucgcuugagccuaggaguucaagacaagccuggcagaaacucuggcaguagauaaaaucuccugggaaacauggcaaaacccugucuguacaaaaaacacaaaaauaggugugguggcaagcaccuguggucucagcuacucaggaggcugaggugggaggauugcuagagccuguaagacaaagguugccgugagccaagauggcaccacugcacaccagucugggugacagaguggaaccccgucucaaaaaaagaaaaaacacacauauucuguucuuuggaaauuugcuuuuagauguucuuaggcaucacauguugugccauaaaggacacaacagaaauaacaugaguacauauagagaaauugcauauucuagauaugugucuaagagagcuauucagaaauagaauuagcagcauagcaaagucugaguucacuaauguuaagauuauaccuaaguauagucccaucuugcuuucauucucugaucucuauaacuuacauucauuuguuacuguucuaguucugaucucuagagugccuaccauguuugaaaaccaaaauuucaaaaugagauuuuuuuguuuagggaauaaaugaguaaaauuugacucaaaaugucuuuuauaaaggauaaacauaugaaguuaaauagaacaggaauaaaguuaguuguuggagaauaaacccucauaugaaauaaauauucccuguuugcugaggaaauguuuuguuucuggcagagauuccuauauucaaugggaccauucugauuuuagcaguuagauccugaucacaccuagguaggccugaaaauuacuuuaucuuuguauccauuuaaucuucauaauuucuuaggaguagcauaacuucgucugacauagagaguauuggugaaagaagaugaguaaagaggaagugggcaugcaauaaaugcgugugaguccuaacaaaauaaaugcuaggaaguuccuuuuguucguuuccaucccagcucaggguugagauuuuuucaguguauacugauguugguaaugcagauuuuucacauaacuacacugaaauggaaaaaaaaggucucuuucugacaaguauagauugcauuuacuauugaaaagaacugcagauguguuguacuauguauacacauagacacuauaaugaaauaacauuaguaauacauuaaaaauguuuuuugcuccucuaaaaauauuuuuaguucugagccaucugaagaugaagagucccaaggccuuccuaccauggcacguagaaaugaugauauuucagaacuggaagaccuuucggaauuggaagaccuuaaagaugcuaaacuucagacuuugaaggaacuuuuuccacaaagaagugacaaugauuuacuuaagguuauauucauugguuauuguagcuguaaugaugauaaaaucucuccugcauucagugcuauaguuaguaguggauagucauuuuucuaaagauaucuuacguuugaagauauuaacuauuaaaucuaaaggaaguaaaugccagacauuuauuuauugaaagucuuaacuuuuuaauagaugagguuauuuauuuguaaauagugcaguaauuaaagccuuaauagcgaacauagguugugaguuuuuuuguguuugaauguuucuaaaaugcauaaccuccccauuuccauuagaaauacucagaaaugucaggaaccaccucacacaacugugacaaggguuuuuaguggcauuuagugcccugaagccagcgaugcuaaacacccugcaguacuaaggacaguccauaacuaaggauaguccugccaguagcacucuugcugagaaauauugauuuaacuacagaaacaaaggaguauaguugaaauguaaagugauguuuagguaucucuaauuauaagaguaaauaaaaauugaccaauuuaguuuuagguagagaauaaauuucugaagauuaauaaacagucuguuccuagcucugccacuuauuaguugaauuaucuuaggggaaucauuuaauugcagguccuuuguauuuucaccuuuguaucugucuucgcugcuaccacuaccaguucuccuccucaccauaugaggcuuaggaguuaccauaucuguauggacuaggcagguaacuuugaagugguagagacuaguauacuauagaguacauauucuuuuuuaaagggguagcugcugucuagcuucagcaggacauggccaugugagcugucagugauagcccauuuuuacuggauacucagauuuuucaaauaaagccauaaggcuggauuuuuauugaggguuggucaccacuuuaacagcuauauuccuaugccuaaaaucacccauuuaaaauauacaauuuugugguuuuuacuauauuuaugaaauaaugcaacugacucccaaaagaaaccuuauauccauuagcagucacucuccaguuuugucccucucccagucccaggcaaccaccaauccuuuuuuuuuuuuuuuuuuuuuuuuuuuuuagcuuauuguggauauuucauauaaauggauucagauaugugauauuuugugacuggcugcuuucaccuaguggaaaagauucgucgcuguugcaggauguacuuuguuccuuuuaaugcuaacuaauuuaaagaaagauaaaaauaaacaugcuauucaagccaaacaacacaugucugugaaccauaggugguccugugccugccaguuuaaguguagauuacauuauuuuuaaucuauguuauuuuugacaugaauccacuggauuuuuuuccacccagaucauuuugauaccaucuuacuauuagcuaaaugaaacuuuagugauaucuugagucuacauuuucucugacagcaguguuacuugucugcuaaugugaauuuuuuuuuuuuuuuuuuuuguggaaacaaauguagacaugagggcuaaaguauuuuaaagcaguaauaaggaaagagcuucuaauagaauaaacauggaguauuaaaauauucaacauaaagggccaaaucucaguuuaaaaauacuuucacuugauugccaauuuuuaauguaguucagaguuuuuuucuuguaaaaaucuuucuaauuuuguaauuuuauuggaaaaauaagauugauaugcauaauuucccugaauguuucauaaaucaguaucugaaauuguguaauuuaguauaucacacacuccagagcacucucuugaaguaaucucuauuucaagugauccccuucaguucuagaaauuuaaagguaauguuuauaaauuacucaacaaaagguuuuaaauccauguaaaagaauucaagagguugugaaauaguucuaagcuugcuaagaauaugcuuuggcuauuuugaaaaugaagaaggccaauaggauauaucuuagcauccaagauuaggaaaaauuaguguggaagagagcacuuugauuugaggcuacuugauuuaauacaaaaaguagcuuauuuaaaaguaagaucuuuuuaaaacaaguaacucauuugaaauaugggaagcuauaauaggagaaaaauaggggauuuuaguuucuucugaaaucuaaaauuacugagcaguauaaaaacaguauauuagaaugaugucaugcaagcaauauaugcauauguucuugaaaagauucagacaauucagaaauagaguaaaaauuaagagccccuaucccauuuaucucgagcaguauuagauuuuuuuaaaagagcagaauuguccuuuuuccccuagaaauuaaaaaaaaaguaaauagaugucugucagucuccucuuuccccuuucucucuccaucugacacacacacauacacaaacgugagcaugcacacacaggcacggaguggccuggacauguuaaguaggaaguuuuguguaaaacuuuguaauuaaaauagcaaaaaccuagaaaauacuguauauaugugauuguguuuuaauuuuuccuuuauaguaagaaugagucaaccugauacauuuuaaaauaugcuuaaaauucagaccuuuuacauaaaacagauuuucugaaaauuuaucauaggacuuaaugaacuuaaacuaugacacacauacuuuccugucauguuuauauuuaauauguuuguucuuaaauauuucaguaacugaaauaauucuuaaagugcugauuuaaaacauuaaucuuuucucguucuguuaguugauugaaucaacaagcacuauggauggagcaauugcugcugccuugcugauguuuggugaugcagguaugcuugacuuaauuuuaagccaugucgauuuauuguuacgucauaauaauaguaccuucucauuaauauugcuccacaguuuaucaaacaccuuuaugaauucuuacaggaauuugugagguauuaauaguuucacuguuuuucccuaaaaagggaagaaguuucucacugauaauuuuacugcuuuucuaccaaucaaaucuuguaacagugaaguuuuguaggauauauuuucucucuuuuuaaaguauaauuucuaguugcauugugguuuuauuauagguuuacgaaucuuaguaggaacauaaugucuuagggaaaggcguagcugguaaucaacauuccuuuaguaaauauuuuuucauguuucaggggcuugggauacaaaaauaaaugcauuugaaugagcuugcaauauagaagcguguccaguuuuuaaauaaaugcugacucgauuuuuuuuaacuuacacauacuaaaaaaaaaaaaaguaaaaaucaccugacccuacuacuaaaaaaguauuuaaauagugaaagcaaacccacacuucauuaaccacccuuaaauuauaaccaccuuuuaugucauucucaacuuuuuuccugcuuauauacacuggcauacaacacacauacauuagguuacaaaauguaaauauauugguuuacaucuuuuaaaaaaucauauaauaauuugucauggauagcuucacauuccucugugacuacccacaggauuaguuuaacuguuucccuauuagcacuuacguuuucauuauuucauuauuauagcacuaaaguaaauguccuuauacauaaauagaacaaaaauuucuguuauuuauauaggcuaaauuucaaacuaggauguucaagcaaaguguaugcacauuuuaaauuuuaauauguauuuccauguccuuuuguuaaagguuaugccaguuuaugcuuuuaucaacaguauguuucugaaugcucauuuuucuaaguggauucuuacuacuauuaauuuuuucgagguuuaaaauauguacaaaaauacaaaacgauguguucccauggacccaucauucuccaauaauuauccaccucauuuuucuuccacuaaguggccuguauucaaguagauucuacauaagauuuuuauuuuauccauaugaaauauuuuaaaccuuuaauuuccuccaguuugagcaaggagacaguauuuugugggugcuaccuacaguguaucaagauucuuuuuugucuucuauuuauuaauagcugugugaccuugagcaguguugcuugacucuucugucuuuguuuccuuagcaguaaaguaguauaauagugccaaacucaaaggucguugugaagaacuaauaauguauacuacuucuuauggugccugguacauagugagugcauaccaaauguuagcaacuauuuguuuaagggucaucugaugauuuaaaaaaaaaguuagaggugaauguuagcugugucuuccucauuauuucgucccuagcacuuacuuuaaaagcuucugagcuaggauugugccacugcacugcagccugagugacagagcaagacccugucucaaaagaaagaaagaaagaaagaaagaaaaaaccuccugaaaaaugauacgcucagugaacauuuguugagcugcaaaauagcuugggaaguuuuguagcuucccaauacauucuugcucucacauuaucucauuaguccauaaacauuucauuaaaaacagguuguggaauuacuuuauuccacggugguaucuaaucuuuuuucucuugagcaauucaucuuauucaacuuauucauuaauuucacaaauauuuauuaugcugcuuuuacuagguagcacaggcuguggcuuagguacugagguuacaugaggaaacaguggauacaaccucugccgucauaagaguuuacaaucauuaaauuuauuuaacuucagcugagcuuuuucuuauuccauuguacuucagauuauuucaauuaaaaaaauguuaaauggcaaauuacaaggaaauaaaaaauuaggauuuucugguuuuuuaauuaaacuuccaugcugcaucauggaacggacagaacagucuuaucagacaucuucauuuuuaguguagugcacuuugagguaguauauagaaugacagguuugucuaaccuugaagauaagguuaaucuucaguauacuauguuauugagacaggaaacuauacuugccauuuuaggacaguuuucaacaaaagaccuuuuuaaauaccuguaagugaucuuuaacagauccagaaauugugacaguucccauuguuucuuuuaaccacaaauugcagucuuaacagacaguaucauccugcguauuaaacacuagggauguuuuuaugcuguuuguuuugaaaguuuguuuuugaauaugaaauuacagaaacaaaaaaauguauauccaaaguuuuuacucuacuucagaagauaagaguacgaauuuauugauguuguccggagucucucuagcugcccuguuguguuuuuuuuuuuuuuuaauuuuuuauuuugagacagggccucacucugucaccuaggcuggagugcaguggugcggucucagcucacuacgaccucugccucccaggcucaagugauccucacgccucagccuuccaaguagcugggacuacaggcaugcaccaccacgccuagcuaauuuuuguaguuugaguagagaugggguuucaccauauugccaaggcugaucucgaacuccugagccccagagaucugcccaccucagccucccaaagugcugggauuacaggcaugagcugugcaccuggcuucuguucuguucuuuuuaggaaagaauucagcaugucuaggugauguggcaagauuaucugguuugaagguuuuuuucagacuuaaaauauuacauuuagaauauugugguuaguguuuguagugacacaaauacucugcuuuaaaauguuaauaacauuccauuuuuauuuuguaauagccauguuaaugaaauuuuuaagcugacauguauguauguauuugagcugcauaguuagggcucugauauaauuaaugcugaaaucuuaaaccuuuguagucuuuagcaggugcuuucauaguagcacagcaauaugucugacaaacuuguucucugaaagcaaaaguauuuaagaaguagguaaauauauacauaauguauacaagcauacauaaguagcauauguagcucuaguuuguuuucuuccagucacgacaauaugcagauuuccuguuacugcuguacucuauguuauauucucuuguuuuuacauuaaaagcauuuguugcuuaagcucucuguaucucuauccuccucauuugugaaauaaaaauguuaccuacuuuguagguuugugugugaaaaguaaaugaaacaauaguuuauaaaagaccuugugcaaggccugguacauaguagacucagaaauugcugguuucugugaugguauucagauaacuuacacuuggugggggucagcuuuauuucacugcucaacacucagccacuuggaagaaucccucccuccuaauguugcucuguagaauuacucaucaauuuagagauguauauuuuuagauuaaauaaugugaugguuuaugaauauaguauuacagugauuucuacuucugaaagacugcaaagaauguuuacuuuuuuuuucaauucagucauauguagaacaacaaacacugggccugauaucaagagaacugucuaguauucauuauaauacauuuuugccuuuguuuuacauuaaauugauuuuuugcuauuucugugcaaaguuugagugugcugcucugcuuuaaaagguggugggcccaggaaaagaaaauuaucuucuucuucagagccauaugaggaagaugaauuuaaugaugaucaaucuauaaaaaagacaagacuggaucauguaaguuuacauuugaauuacaguaucaaaauuggcugcuuaagguuaggauauguggaguuuguggauauuauuagaccugaaaauccaccuaaaugaauuccuuucuaucacaacuaagggaauuuacgucuacauuuaauuugugacuguuuuugcuuuuuaauuuauccaguaugaagccugcuuaagcacagacuauuuugugucuguggauaucagaccugaaaauuugucuaaaugaaucauucuuucuuuucuuucacagcuaagccagauaauuugugcuugcauauaauuugugacuguuuuugcuuucuuuuaaauuuauccaguauuaauugcuuaucucugcccucuucauuacauuggguucucugaacugugugcguguucaucuccaaauuuccccuuuuuauaaggacaacagucagauuaggucccacucuaaugaccucauuuuaacuugagugucucacugaugacccugucuccaauaaggucacauucugagguacugggcauuaggacuucaacauuugaauuuggaggggacacaacccauaauagugguguuuccagaagcagguggauagggaaggcaaauucauacuuagagcagguuaucuguuacuauaucuuucaugaugaaucgugaagguguaaucauccugccaccagacaguugacugaaucucccaaggaauggugcuauaaugggaacucguuggccucuguuccuugcagguugagcacugaccguaacaauagccagauuaaucuugguguagaaagucuuaccuuguugacuugcaugcacagacucaagcccaguugccauggccauuuguaaaugggccuauugagcaggcauucaaguggcuguggacuuaacugguguucacaaaauggaugaucuuguauaccugaucuuuaaaaauuuucucugccacgugugcacccuuggcugaacauucacacaaacaccguuauccuucuauucuauucucaggauaacuucuuuuuuuuuguuuuguuuugcuuuuugagacagagucuuacucugucccaggcuggaguacaguggugugaucuuggcucacugcaaccuccacuucccugguucaagcaauucucgcaccucagccuccggaguaucugggauuacgggagugcagcaccacgcccagcuguuuuuuuguuuuuuuuuuaauuuuuuguagagauggaguuacaccauguuggccaggcuggucucgaacuccugaccucaagugauccacccaccucggcuucccaaagugcugagauuacaggcgugagccaccacgcccggcuguauuuucagaauaacuuauauucugagauguucagcaauguaccucuuccccagacuuccuggucaccaguuuuuuaagucuucuuuuuagccucuguuccugauacauugcugaucucuaccucuggccaucucuugguacacaaaaugggcaacaagauguacugcccaaaguuguacacagggcuacucucugaguuggguuuauauuauagcaguuguucacuuggcugguucuaaaauuaugcaaauccuuuguaaagucaagcugguucaggcugggugcauuagcuuaugccuauaaucccagcaucuugggaggcugaggcaggaggauugcuugagcccaggaguucaagaccagccugagcaauauagugggacuccugucucugcaaaaaaaaaaaaaaaaauuuuuuuaauuagcugggcaugcuuacaugcagcuguaaucucagcuacccggaggcuaaggagggaggauuacuugagcccagaagguugaggcuucagugagccauaauuaugccacugcacuccagccugggugacacagugagaccugucucacaacauacaaaugaaguuuaaggauuucuucccucuuuaucaggucauaaagaauuuucucuuuucuuucuuuucgagacagagucucauccugucgcccaggcaugaucucggcucacugaaaccucugccucccggguucaagugauucuccugucagccucccacguagcugggauuacaggcgugugccaccaugcucaguuaauuuuuguguuucaccauauuagccgggcugaucucaaacuccugaccucaggugauccgccugcuuuggccucuccaagugcugggauuacaggcggcagccacugugcccaaccuaucaggucauaaagaauuuuuuauaaugccucagguaauaguugaagaaggggcagcagugaugcagaagcagguaccaugagagucugagacaucugcacaugcaauuuauuugugucucuugaaccuacucaaguccauucucaaguauaccauuucuacuugaugauggguugcugcugccaaugcuccguuuuaggcuagguaaaucagauacccagaucacauaacggcucaagucucauggucauuugauguucuguggucaaccauucugcuuuuaucaggauuuauugucaagucaauagcuguuucacaaaaauacaucagucaguucuguuuuuaaaaugugaauuuauuccaguguuaauacauuagagaacgauuugagcauaauccaaaauuugcaugugcuuaugugcaguuuuguccaugagaaauaguaggugaucauagaaaauugcuuccagcugaaccaagccacauaaaacacacacguuuccaguauccacuggcugccucuuuuuaccauguauauuauccuguuagguggugauaugcuauucuuugacauuugugaucuuuucuauuugaaaaaagcacucauucaacaucucaaaccuaccuaagcauucugguucaaaaaugccacacaguacaugcagagggaauguuuugaguauuaaggagaagcuugaaacaagaaaacauuuggaaagauaaaaacauaacgauacaucccaagcaacagauauaaaggaauccacauuauggaccaucaaagauaaugccacaaaaauaaaaguguauguauggcuggaccagguucgagugcuggaaaguccauaagaacaaggcauaaagaaacagaagaaaaagaaagauugucaaauauuuggauucaagaccaaagggugaaaaacuuaaggaacaaccuuucucauacagaucuuuguaauuauauacacagaccuaaaauagaagucacuguacccugcauaaguggcuccuuuuagugcuaguagugguugcuuuaaugauuucaaacagugcuacaguuuccuacaaacaaugcuacaguuuccuaagccuuuggcugucagacauaacuauuaguguagauaugaaagcugcaaaagaauuuuucagcagugauagggaaguaaauugaaggcagcugugcaugguguuaaauucuugguuuugauuaaacaaauaucuguuaugaacgcaugccucgaauaacccaaauaugaaagacagaaaacauguucuaggauuuaaggcuccuaaagguaacauaacugugauauuuggcaccagugccaaauggagauuugaagcugaagccaauaaugucacucaccaaacuuugagccuuuuaaaagauauuguuaacgucagccuuugagguucaugucagguauagcaaaaauguauggauggcugcccacauuugcauuuauauuuuuacuuaguucuucucuguuaaagaggaugaaugccccaaaacauuaaaaaaaaaaaaaaacuuaacuuuaaaaauucuuacaguguaucaagcucucucucuacaaaagcagaauucaaccuaugucacauucuuccuuuugccuccaaaaaccaccucucugauaacagccccuuuuuaagugugugacagcaguguuuauagcuuacuauuuaaagugaacauuuuagauauuaauugcuguuaucuaaggcaggguugcagaagugguuacagaauguuggaagagguuuaacauugcaaugucauuguugaagccuggaguaauauaccgagaguguuuguguuauguguggcagaaaauugccuuugacuugauucuuuauuuugaagaauuugauacuucagagaaauuuuaaaaguuuaaaacaagcuauauugaucuaagaaaaacaguuuggacucggagcagucaaaaaugaggauauugagaaguuucuaggguccuguccugaugaucuaaccacagaaaacauucagcaacuugcugcuuauggcuguauggaugcagaagaugucgaugacagugauaaugaaagucagaagucuguguaugccaugacaguguaauacaaaugaucagauguuuuaaaugcugugaaaauaauuggacugccuugaagauaauggcuuuacugcugaagauauuaggauagucuuguguggcauccggaugaauuuggaaccguacaggcagcuuuaguguaaaaggaggaggcuggcaacaccacagaaauuuuauuuauucuuuauauuuuaaguuaguacagcagacauaacacaaggacagugagcuacaaccuucuguaucugguguuaaaaauuuccauucauuuucagauaaccuguuuuuugccacuuuacaauaacucguaagcuguaacucuuccaauguccacaagcaaacuucagcucauauuuauuguaguauuuagguauuaacuauuuaauguguguaaaauuguaucauuuuuauuagauugccuucucuuuuuauaugucacugaugaaguuuuugacauuguaucucuaacaguuuuucuccuaaaggcugcaauuuuuaacaauuuugcauaaugcaguaauuuuuggaaauauaugugucacagcaaaacugacuguggucaguagaagaggacaugaugaccuuucuuuaaaacucucuaaaacgauuuucccacuggggcuugccaaagacuucauacaacauccuuaccugcaacagauucuuggagaaucauugcaucugcuggucacgaaacccaaguggcggaguaccuuguauugcacucuggaccugguacagagccgucucuuaaccugggccccauucauaacugacauucuuuuuuuuuuuuuuuucuuuugagauggagucucgcacuguugucugggcuggagugcaauggcaugauccuggcucaccgcaaccuccgccucccggguucaagcaauucucccaccucagccucccgaguagcugggauuacaggugccugccaccacgccuggcuaauuuuuuguauuuuuaguagaaacgguguuucacuguguuggccaggcuggucucaaacuccugaccucgugauccacccgccucagccucccagagugcugggauuacaagcgugagccagcgugcccagccauaacugacaaucuuaagagguauuuuauaaaaugaaucaagcaguacacacccuaaugaaguauaucuugccuccagugugcagugagcucccaauguccagucuaaagaggcagauaggugcggccuuucuuuuuucuuaagaguggaguuugcaacaugcuccagacuacacucccacgaaaguggugggccucagagugaggaugguuauuccuucacccugauauguggcauguacguaucugaccaguaccauugaaaauacccacuaccuguaucaaguccagucaacaugaugucaguauaguggaucaagugauacucucuagacugugcaaaaccaucuaaguccaugaguacuguauuauuugagagagccaggaaaguuacucuaacucugaagacugaagguauaucauuaaaccugccaagauaaaaacggauuguuucuguuugaucuaauugggaaaggggaaaaagcaaguacuugauugauaacugcauagccauauugauuugcuccagcaaaaauaccacauccuguaaagcagcugcagcuggaguuugauuguuuaugauacucuuaaauacuugcaagacucaucuacuuuuuguauaggucaaggaggcaucuuacauugggaugggaugguggugucaauaucugcaguuccuuuaggacuguaguaauugcuuauuguuuugauugagagggacaauucuagggacuuggauuugguguuuccuauaauaguagcccauacaucaugggucagggaacugauauaguaugggauuucugccagugccaaauaugucuguuccaacuaugauucuggagauggaaaaauaagcacugggucgaaucauaucccuugggcccgcugagacagauacagucccaaauuuuaucagcuagcuuuuguaaagugucuguguaaccuccuggaccacaugaguauauucagucaccagggauaagcagagcuggcauaagugugggacccaagagcaaacaacacaugauaggcacaccaucuacuaaauauuugauuccgaagagcuguuuacuguuuuccagauauuuuauguauuuuuuuauugaggugaaauucacauagcauaaaauuaaccauuuuagagugaacuauuuaaugcuauuuaguacauucacaguguuguauaccaucauuccugucuaguuccaaacgcugucaucaccucguaauagcaugcuauacccauuaagcaguuucuccccauucccuccucccccuaaccccuggcaaccgccaaucugccuucagucucuggauuuaccuauucugaacauuucauuuagguggaauuauauaauauguaaccuuuuaugucuagccucuuauuuuuuaauuucagaaaaauguguuuuauuuguuuuuucuuuuuucaacuuuauguuagaauugggguacaugugcaaguuuguuacaaacguauauugcgugaugcugaaguuugaaguaugaaugaaucugucacccagauaguaaggauaguacuccauagguaguuuuccuuaacucuucccccacauccucccuccgccuucuuguguuccccagugucuguuguucucauuuuuaugaacacguguacccaauguuuagcucccauuuauaagugggaaaugugguauuugauuuuucugauuccacauuagcuugcuuaggaaaugguuuccagcuacaucuguguugcugcgaagaacaugauuuuguucuuuuuuauuagccucuuacauagcauaaugcuuucagauauacuacaauguucauucauguugugguguguaucaguacuucauucuuuuuuaugacuuagugauauuccauuuuauguguuuaccacaauuuguccaugacgcacauuugauauauuaacaaaugaacaacugaaguuuaguuuucacuuauguagugaaaaagcaguggucuagaguuagauacuuggaucuguucccuccucagcugguuguuguccaucugugagcuuuaaaauacuguucuuggaauuucagugugccugggcuguaaagguggcaguaugaauuuugaagauuuugaaaugguuucuccagauggguuucaccaguaugucuuauuauuccccugcucaaaauccuguugcuucuuaaaaaagacuaaccuuaggcuuuauuccauguuagcucugguuuaauucuucauccuuguaaccuauuaacauucucugcauuugagcccaaguagaccacuuaguauuaugaaacacaugcaauuuucuucuuuaguccagauauccauagcauuuuauuggucucuguuuuaugaaauuuuauuuuacuccauugugcagaggagguaucagaauuuaguuauuucuaucuaagguacugaaagagaaaaauagcaauucaguuguuggauaauaaaggagguugaagaagaagauuguauuuuucuccaucuuguguguauagcauguggugcaguucuaagcagaguagaaaaaugcuuuuugauugacuaaaauuuuuccuaugcaugaacacaaggagucuuuucuuuuugcuuaaauguggacuuuaaccaguuucuucaagugaaguuaagugacagagaagaaggaaaagugagacuauguauagccacaauucucauauuaauuaaucuguucgguuuauacauuauuuaguuccacuuaaauuccuuuuaucauuguuucaguuuuauguugugacugaacaauuaauauuuaagccauucugugaaucaagagugaaguaaaaguaaacucuucucagaauuugaaauuuauagguggauauauaauagugaacauagaugagauauuuguauccuuuuaaaauuuaccguugucuuggagaaggcaucaguauacuugaauuauauugaguuaauuugaggaucauucuaguuuuuuaggagauuuaucucauuuuaagcacugagaauaaaguuugaguuaccggauaugcaaucagggucuuucagugaucuuaagucagcaauauuuuucauccuuaaagacauaaauaugucaauguucacagaaacaaaaagaaacaguuuggauucuucugacugaugaugauaauuuucagaucaagucaaaauacaaugauaauugccuuaagaccauuguuauugauaucucuuaaauuguuuucuuuuuuuuuucuccccauuagggagaggaaucaaaugagucugcagaaucuagcaguaauugggaaaagcaggaaaguauuguacugaaauugcaaaaggaauuucccaauuuugauaaacaggugaguagucguguaugaaaauuuaaucaguguguacuaaguguuuuuauuauaaaauaguguuaagaguucaaccacauaaaagcuuagggugaguuuuguauucuucuaauuaaauguucuccuuuuaucaauguuauaaaguauuuucauacuguuuauuuauguuguuuauuuaccuuguuuacuauaguaucuauacuguaucccuaagucauuaaaaaauaaccguaauaaaaauugugaacucauuuauaacauguaagucaucuagaaagucaucuguaacccugcccccaucaaguaacugcuuaguuuuuuucauguucucauucuugaaauuucuuacaagaauuuaaaaaguauuccauuucagugucuuaauauuuuauaagcuuucuacuacuucccagauagugagaauguuuucagagucauuaaaaaaaaagacucaugccacgcauccuguugcuaaaaggcccucuguuuaaucccaugaucauauauagaagcacauauuuguuuagcauuuagaguacauuuacacuugcacugauuuauuugaguauauauguucagauaguacaucuacuaaauucugaugagcugaaugcaaaaucuuguugcaauauugguucuuuaccuuuguugaaacuacguuuugaaguuagcaguuuguaaaagccuagcugcauauugaaauuucauuuuuaauugagaaaacauuucuugauccucuaguguucacaguacuucauagugagcauuagaaaugcaaaaaaaugucaaguuuucuuuccuuugaagacuauuguguauuuguggaggugaaauuacacagaaagcauuuguaaagcaguguaaaaacaagugcaaaauaaucagaugugaauucucuguuuucaggugauuaacuuauuuuuaaaagagcauagacguuuucugcaaguugcuaauuugagauuuuuaacaaaaagauaaaugacuuauuucuaggaacuuagagaaguacucaaggaacaugaauggauguacacagaagcuuuagaaucucuaaaaguguuugcagaagaccaagguaauuauucugggucauagaaaauacauacuucucauuauagucuguauuuuaguauauaagaaaaugguauauaagaaaagcuauuagcuguuaaucagagggugggauugcaaaagauguugaaaguaaugauguaaaaacauucuuuaacaaccaguuuuuaaauguuuugaccugccuguucuuuaucauaguguaaaacaaaacaauaaauaucuuuuucuauuuguucagucuuucuuaauaguuaaggcuacuuuuaaauugccauguuuuauugaguguaaaauaaccuuuuuaacaacugucaggauggaucuugugauuggugauaucaugucauuacuguaauguagaugucuuagccuauacuugcacagauaucaaaagcacuagcaucaaaaacuuaaggguaucauaggcaugaacacauuuuggaacacucuuaauucuaggaaccaaaugauagaggagaggugguaaggaagaguugagucauacauguuuaguaacauaccuaaggaagaaucaaguagacuagcucuucauaauugcaaacccagcaugguagcuuuugguguuuugguuuggguuuuuuuguuuguuuguuuuuaauaaauuguuuuaaaaggcuauacuaccaauacuguugauggcacagaaaaugauauucuguggcaaaaagaaagccaccaaauaugaguuugaaaaaugagucagaagagccauguuaugaaugugaaaacauuugaggaauacuuuagccaauucauuuugcuuauuuuuuauaaaugcacaaaaauaaagguaugauaaucuguguaagucuaauagcuuucugaguaaguaaaaauuucugaauaaaguauuguauuauagauuggugcauguuuucucacugguacauaaaauaaugguguuaccuucauucacaggcaucuuagaauucuguaaacugauaaucagugauaaaguaguggggcuuuuugauaauacuguauuugaauaauuuuuuuuauuuuuuauuuuuuuugagacggagucuugcucugucgcccaggcuggagugcaguggcacagucucggcuaacugcaaccuccaccucccagguucaagcgauucuccugccucagccuucugaguagcugggauuacaggcaugcaccaccaugccuggcuaauuuuuauauuuuuaguagagacaggguuucaccauguuggucaggcuggucucgaacuccugaccuugugaucugcccgcgucggccucccaaagugcugggauuacaggcgugagccaccaugcccagccuauuugaauaauuuuuuaaguaacgaugcaacuuagaauauugaagauaguauuggaaaauuauggauaguugaaacauacacacuuuuuauuaguaagcuuuauaguaguguaagcaucauucugcuauauucuucaguguuggcauaguugaguggggcugcuaggaauaucugagacaucauacagauacgcagcugccauuuguguucucaggaccuuuguuagaaaacagagauuuauauuuaauucauuuuaaaaacaaguuaucaccugcuuuugaaacaauuguuuaacuucaaauucuacuuaaguauuuuuaaaguguaucaaauuuaacaauaaauugucguugaauucuucuguauucaauaggaauagguaaauguuuuaaguuuuuauuugaagucuaucuuuauauuuauguauuucuaauuuaguuacuguuuuugucuuuuauauacagauaugcaauauguaucacaaagugagguuccaaauggaaaagaaguuucuucaagaagucaaaauuacccuaaaaaugcaacuaaaacaaaacuaaaacagaaauuuucaaugaaagcacaaaauggcuuuaacaagaaacguaaaaaaaauguuuuuaauccaaagagaguuguugaagacucugaauaugauucagguucugaugucgguaguucacuagaugaggacuauaguaguggugaagaagugauggaggauggcuauaaagguaaaauucuucacuuccuucaagaugcuucaauuggugaacuuacuuugauuccucaguguucucagaaaaaggcucagaagauaacagaacuccggcccuuuaauaguugggaggcucugguaaggcuuuauucuuuuuuuccccuuguauguguguguguauuuaauucacaguaccgguuauagucaaguugucuucagcccagguaagcauagauggguggccuuauccuguguaaagucaaacauuacuuucauuguaagccaauaguauuucaaauagugucauaugaccuaauuuugaaugaauuaaggggugauuuuccugaaaaaacccaagcugauuggcugggaauacugucacucauuccuuugcauagaaacuucguucauuucacugcagaagaagaaauuagagcuuacauuuaggaaggaguuguuugcuagccuguucugaucuguuacugcugagacaccaugcagaaagcaagaauguggcagaaauuuuacuacaacuacuugaagagcaauagcaacggccaggggagcuccaugauucaaaaugccagccuaaguguuuuaugcuucaccacaaaagaagcaauuguuuauuuucuuuuuuucuucuaaaaguaacagcucagucucuaacauguuuuuguugguuaagcaacguggccauuuuauggaguguagcaggcugcagcguuuuuaauuggaaagauagaaaaauuucuggaagccuauaauucaagcguuaggugaagggaaggcauaagcacugguaaguacacuuugcaugaucauuuucuggaauuugacuuucuauaaacagguuguauacagaauaccugcauuuugaguuuuaugaaugccaacagucaucaaaucuuauucauacagauaaauauaagaacucuuaaauuuugcuucaacccuuacgugggcuuuuauagcaggaauuguauauaggccuguuguaaaagcaauauggaugauuuuuuacagcuuuaaaagaugcagcgacucuugaugcuuuauaaaauuuuuuaggaaguuuuauucccuaaguuagggagcaaaguugcuuuugugguuaauuuuauacuugaaacaaaucuaaaugagcauuaaaugcccugauaagugucuugaaguggcaauaggggagagucccugaacaaugguuguaaauacauuuuuuuaauuaaaauauuugaaaaauacagaaacaacauuaauaauauuccauagcuuuaaaaaauaauaauaaaaccauuuguuuugccugaagccuuugcuuuuccagagaacaucugucaaagcaggcccuuucaaaacuuguuuggcuuugccugagugauuuauuuguuaaaguauuugcugaagggcuuucuuguucuucuuuucuuccuuuucuucuuucuuuuaaucuuuaauggucucuuauguuguugcagaguuggguugcucaggcuuguugagauucuaauuuauuuaauaagauaugcaauuaucugcacuaguuuguuuaguugcuguaaauacuugcccgaauaucuuauaguaaaaguaaauuauacaauuuuaccagagguauaugugccagauguuuuuaaaaaauauucagcaacuuaacauguggaaagcauauuuccccuacuaauuaaucagcagaguuuaaauuagucuugacaugaauuuggagauuaugcauuacuuacuuaaaccuccuaacaucuugccccuuucuaaaaguugaacauaaagacuauauuguuuguucuaaccauccauccaaaugugaaauauuuuauguaacagucuaaauguaucugaaaaguaaacuuucuacuugaguucagugaagacagcaaaguaggugaaugagcuuuuucaaauuaauaguguaaauuagcaaguaaauacagauaugcuuuaaauuuuaauuugcuuagaacuuugagcuccuacuuuaaaaaccuuuagaauuuuaaaugugauuuauuuauagaguacuuuuuuagcccaaacccuacccuagagcagauuuaauaucuuaauaaaauuaucaaaagucaauauuaugcauauuuuuuaguuaaaagcuauauaauuugcuuuuucccuguuaaucagugagguuugauaauguaccucuaaacaacuucaaaaggaaacaaaagccaaaaaaauuguuuuguguugauagcugccauauuuagaaauuuccuugagaauuaguugagguuuuaaucauauugcucagucauauuuuaaugaaaauuacaagguauuaaauauauuaagaacaaccugcuaacaaauagucugcucuuucuugaaaucauuguuuaaucuuacuuagucuuaagaauuggggaauuucuauuuacaaacuguaaaguucauaaauauuucauuaaaaaaugcauacuugagcccgugaauaaaguacauauauacaauaguaauuuuuguuaaaagugagguuucuuuaacguuggugauuauuaaaugauuaaauguaaucauuaguauuucauugucuuauuauaaaaguaauuugaaugugaaaauuauauugugccuuuuaaaacaacauuugaaaaguuguagaucauuggguuguuuucaagguaguagacauauaaauguaauauaaguguaguagauauauauaaaauguaaguauaauauacuuauuaauauuaccuacuugguaaucuaauuucaguaaguuuagagguuacuaccuuucuauacuacuaugacuuauuugucagauaauuaugcuuuuugaaacuaaaauacucaagauuuuagucacccucauuuuacaugaggaaaauuugauuuuuuuuaaaguauauuaccuaaaaggauauuuaugcuucagcuuuauaaucauuuauuagucaaaauuuaaauauuguuuuuaaauuuuucuucauaauuuuuuccauuuuacuuacaguuuuucugcauaauagcaguaauguaggugccuauugugagaaaaccucaucauuaaaucaaguaggguucagaaauacagcaagccaaaaaugucauuaguuuaaaaacuuguacuguuauugugguaaaaauuggaauuuuuauugccaaauuucacacauuugauggcaucaguucaccauccacuuacuggauuuuugucuagccuugcacacaguagggaggggauauuauuaugucugugaaaaauacuacucuguugcaucuuuauauguuaaucagaguaguaauguuuuuaugcugaccaaugcgacaugcaucaguaacucaaccuggaaacuuucauauaugcaucuacuuuguuaacauuuagaucaguguagauccaguuuuccuuggcugauaaccaagcaacucagguuuaguccaugucacacacugugcuccucauuauguuacucucaucuacuagacuguggauuuucuuuuuugguuuuuguuuuguuuuguuuugagacagaguuucgcucuugucacuuaggcuggagugcaaugguaugaucucagcucacugcaaccuccaccucccggguucaagcgauucuccugccucagccucccuaguagcugggauuacaggugcccgccaccacaccuggccaauuuuuauauuuuuaguagagauggaguuucaccauguuggccaggcugggcuggaacugcugaccucaggugauccaccuguugcggccucuccaagugccgggguuacaggcgugagccacugcaucugguccuuugcuuuguuuaacuggugauuucuguaaaauaccuggccuaaauuggccacuuaaagcaugguaauacauauuucuuccuucugaauaagguggcaccagugaauuuauuuguaagauuacuauauauucaggcuuuguuuuaauuuguguaaguuugauaaguuuguauuaaaaaaaucugcaaguacauuuugaguacuuuguaggcugcugccagguauuuauaauaaugaauaagcuugggauucuguccucagggcugucuuuugguaaguggggauuuaaugauuugaaaauuaaaucugcuuuuaaacaguuuccuccuuccuauggaaauucaaaaauaucuguacaguaagagugacacacuguggcaagagagugauacuucagaugcugacuguuuuugaaagaaaaaaguccuuugaguagucacuugaguuuuuaaugaagagauaugauuggggccauauugaugaguuuuuuucauguaauuauucaggaaguagcaauuagcuuuuuaacuuucuuccuccugaaaaaaagauuuaucauuuuuugagaaugauuuguuuuaccuaaaauugaaacagcaugugcagaaaugaaaaaguaaaguuuaccccaaauucuaccaaagauacccaccauuuaagguguuuugagcaucaucuauuuauguauacauuuguauacuucauaccauguaagcaggaucaucuuuucugugguuuucaguaacuucagauuuacuaauagaucccacauuuacaggguacuuuguauuucuuaaaucuuuuuugggggaaaguuaaguaacuuacaggauuaagugauuuuuguguucagaaaacaguaacaugguggcaguagaguguucuuacaucuuuccuuaagugagagccccucuuuccccauccccaaauuguuuauuuacuuuuuguuaauguuuauacuuuuauuauuuacacauauacuuagauuaacaaauaauucuauaggcuuguucuccgcccccacaaaaaaaaaucuauauccacccuuuuccccagccuguugcccaugcugcagauaacuucuuucaugacuuuuugucucauuguucugaucaccuccauaucuuuauguaauauaguuauaaugcacuuuuugucauuuguaggucuuaucuaucaacuuaauauuauagacaauaggauuuaguucucacugucuaccucacuucacaugcccauuuucuguuccccaguucuguuaauauauguuaauaugguaauuuugaagaucauuuuuagugucuacauuguuaugacuaugcaaaugccuuucauagaugaaccauguaguguacuacaugauuuuuauuuuuuucucauuuuuuuuccuaguuguuauuugucucgguuuuucucuuuauuuuccuauauacuugucauuaggucaacucuaaagucuuuuccaguugccuaaauuucccaucagauuuuuuuuuuuucuuuuccuucuuucagacagucuugcccugucacccaggcuggagugcagugaugcgaucucagcucacugcaaucucugccucccacguauaagcgauucuccugccucacccuccugaguaguugggauuacaggcgucuaccaccacacccgguuaauuuuuguauuuuuagcagagacggaguuucaugauguuggccgggcuggucuugaacuccugaccucaagugauccgcucaccuccaccucccagagugcugggauuaccugggccugucagauuuuagacaccucugguaaucugucaguuucaucucuuuuagaaaaucaggaaucuuaucaccugcucugauuuggaaguggccuuagcauuucauuuuccugucauccuggagaauccuuuugucucucucauuuugagucucuuguuucugaauucagugcaugccacuuuuuuuauuccauugguuuuguaagugcauacuaggugauagaugaauaacauagugaagcuagaugaccugauuuugaauucuugucugucauuuucuaacagcuuacauaucuguaagcaaauaucuguaagugggguguaauuauagugccugccuaugggaaagucuaaaaauuaaaugccaucaguugccuggcucuuuaaaaacauuagcugcagauauucacaauaauuugcauugcaaguguuguguauauuauuaaugaaaugccaagaaacuauuuguuguuuucuguuuguccacuaaguucuagccauauugaaucaaacuuucuaaaaucaaacuauucuucuuuuuuuguuguuguuaaauauccaugcccacccuauagcuuuuuaaaucagauuuauggcugggcuuaugggcacauuacccacaauauauuaagacuaacuguuuuagccucccuugugaucguuugacaaaguucauuccaaugggaugugagcagugguauguuacaacuuuuggaaaguguuguuucuuccugccgguagaagggucaauaugaugguggauguugagguuauugaagcaacagaguuagaagaauccuuaauuuuggaagcaacauaccaaaucugaaucaguuccucagauuuuuauuuacaugagagauuaauaacuuuauuuaaaccugugauauuuggguuuacugucacagcagaaucuaaucacaguaaauucauucaauuaaacucuuuuuccuuuaaaaaacugucuacugcuguuuuacauucgugguuaguggauuguuauuagauagaucuaaauucuaaaucagcagcagucauuuugaucaucucuaaaguugguuuaccugugugggaggggagagguagggaguguuaagggguccuaaggaguuguucugaaauuucaacuucaaaauaaccaaaaagugaaguucaguuaaaaaucucauaaccaacccuuaacuguuaaagcguccugaaguaagaaugaccuuguacuccccuucauugccucccccauuuuguuauuacaagaaauuuaagcacacaguguuauaaugaacccccauguguuucuuccauacucuuguccacuuccuuccaucauauuauuuugaagcacaucucagacaucauuuuauccuuauaauuuuaaauguguaucuccugaagaaaccauaacauucuuauaucuaauaaaaaucaucaauaaugucuuaauaucaaaauauucagaguucaaauuuccaguugucucauaaaugccauaguguuuguucauuuguuuuauaguuuguuaguuugaauuaagauccaaguaagguccacuuauuaagauugcuugauaggucuuuuaaucuguagauuccucaucccucucucucucccccuucuguuuuuccaguuuuugguaaagaaacugggucauuuguucuauaacucuccugucuaaacuuuucugauuauaccuccccaguguaguuuaacauguuccacuggacuaguacuuucuguaaaacgaucauuagaagguuaaaugcacccaccaauauuauuacauaguuagugauguguucuuucaucagaagacaguaauaucugauuguuacuuuuuguaacauuagcaucuguugaugcuacaugucuggauccauaauucauuagccauugcaaaauuaauacuuuuuauuuuauuuuuuuuuauuuugagacagucucucgcucugucacucaggcuggagugcaguuucgugaucuuggcucacugcaaccucugccuccuggguucaagaaauucuugugccucagccuccugaauagcugggauuacaggcgugcaccaccacacccaguuaauuuuuguauuuuuaguagagacaggguuccacuguguuggacuugaacuccuggggccucaagugauccaccugccucggccccaaaagugcugagauuacaggcgugagccaccaugcuggccugcaaaaauaauauuuuaauacuguuauugcugcuuguugaggaaguaucuauaaaagaacuucuuacaucuaccacucuaaauguugccguucauauacaaaauucagaauaaauguuuauucuuuccuuuaauuuuccagcucucaaagugauuggucacccccaccuuuuaacccuuucuuguggcuuccaaaugaccauaauuaauuuaugcucucaaaaaauaaguaaaaggaagaaaauuuuuuuaauaaauaaaaagacaucaaacuuaaauguguaaauugguacagcuuaagugaauuugugauuuaugucugcuguaauuuuuuuuauauuaggaaguuucagcuaugaaggaaauuuuacacuucaaaaagcuguucaguggcagaaaauaugauaaugacagauuagaucacaauaugcuaauuuuuucagaguuaccucucguguaacacagcuuuugaaaauauuugaauaguacuauauucuuuuuuaagugaaaaaaaaaaagaaaccuguaauugcuuuauaaagauucagugugcuucagcuucacuuugaauauauccacuuaguauaaucuaacauugguuuucuuaauaaugguugugugacuuacauguuaggaaucuucacaguacacauuuuacuuuuuaucuguuucucagaaaauauugacuguuauuuaucacuaaacucauaauaugcuuaggcacuaaccuucaacaauacaguaacaucuuuagauuucuaccgaauugugaauauguuauuagaugaauauuuaccucuccauguguuucuggcacauaucuucaaagcauaacuauuaugaauaaaauuauacauuuauaaccacugugaauaguuacguauuuaauuacucagaacuguccaugagaaauacuauagaaauuauuuaccaugugguguauuuuauauaaauucauuauaauuggugaaagauuaaguuuguuuguuuguuuuugagacggggucucacucuaucacccaggcuggaaugcaguggcgucuuggcucacugcaaccucugacucccgggcucaagccaucgucccaccucagccuccugaguagcugggaccacaggcacgugccaccacaccggcuaauuuuuuguauuuuugguagagauggaguucugccauguugcccaggcgggucuugaaauccuaggcucaaacagugcucuugccuuggccucccaacaugcugggauuauuggugugagccaccacaaccggccaguuuauuguuuuuuggcaguuaaaacuuaacacuucacuuuuugaaauuauuucuuccuuggcuucucugauaccacauccuacauuucuucuugcucugucuuuuuaaaugcuucuaaauguugguguucuucaagguuuugcucucagucuucuaaucuccaauuucaugugcuuuuccuuagguaaucucaucagcaucuuugacuuugauggucaccuguguggcaucuuuuucuccagcuuacaucucuucccuaagauacagaucuuuauuuaacuaaccacuggcucuuucucgaaaauuugguagcugccccaaauuuaauauauccagaaacagacuuccuuugccaucuugguaaauuuuaaucucaauagaugguaccacuaaucuguuagcauugaagccagaagucugggagucaggcuuaacucuucauucaucuccccacacuuaauggguucuaccuccugaagaucgugaaucuuaucaguuucuccguguccaacacagaccacuauugucucucaacucaaagccuucuuaauaguuuuuugcucucaagccuucuucacauuacucucauagaguucuuucuaaacaggaacucucuaaaacccuucaauagcuuuuuaaugcccauaaguucaguuuagaacgcauuaaaaugauucauacccuuacugccuuccuguucagacuugucuguugcuucucuagguucugacaugugaauuuaucuuuccauuaaaacaguucuuuuauuauuucuggcuucuuacuccauaaggaauuacuaggucuuagauuuuauuagucuuuuugugaugagugcccaugaacuuuuguuguuucccuuguuuauaccagagguuaugcuugaaauuguuacuuguguuucccaauguucguagaccacaaggacagggcugugucuaucucccagauaauucaacaguuacaguaauuucuguuaaaaaaaaaaaaaaaaaagaaagaaaagaaaugguaguugguuacagaaaaaaaaaaguguauuuugaacuuuuaaggucuuaaauuauuuuauuuagggagguacuaguuauacagugaaaagggcauggaauuuuucucuuacccagcuuugugauguuggaaauugaaccuuaguuuuuucaucuagauuugguaggcuagucuugguaguuguuacgaggauuuaaugaguuacugaauaaaagguaucuaauaguuacuagcacauaaauggcaccuaauguauguucauuccuuauuuccugauuaauuuguuggguuucucucacauuucaauguauuacacacacauacuacaaucagcaugagauugguuuauggccuauaauuuuugguugcauuuaaaaauaaaaguauuuuagcuaaaaguucuaauagaaccuccuuaagacacugauuguuaucuauacugcugcuuaugaauagaucuuuccccugaaaagcacaaaguagggggaguaggagaucauauugugauuaugaauuuugucccugugaaaaauauagaguaguaugcaaauaaacuuaguauuuaacagugccauuuuugaagugcuaagaauagauuggauauuuuguauauuuccaaguuauucuaggauaaauauggaaaauguauauugcuauaaacuguauuuuauuuaguuaucuuaguauauccaaaaagcacuuaauuacuauugcuugagcuuuuugcugaacuuagaaauacugugaucacagugauuacuuagaguuguuaaugugauucuugucauaacuuggaaaaauaugcuaaauaggaugacaugaauaaaaaucgugugguauuuuccuaauagaugguuuuauuuuaguuuccuagauuuaguucuggcuuaugggauuuucauuuuugccccaaguauuucaaauagcuuuuggacuuucucauccuuuccacuaaaaauauuuuuugucauguuuuauagaauauauauuuucagcuaucuaucugaaaaauucuaguucugauauagcuuuuacauaugaaguauucagugccuccuuuugaaaaauaaauacaacuauauuuugaaagaaauucugugaguuuucacagagaaccauuuauaguauuauauugaaauugguuuuuaaaaaccuuaucuaauuauugaauuggucauaguuaacuuuugauucaugugauaucucuccgugugauagucuguuuagaaguaaaguaucaagugacaaauaauuagaguuuugaaaacuugaggggcuauacuuugaugauagauguggaaaaauaucuuuuaagauuaaucuuaauauguaauagucauaggaaaugacaaguagaggugagagaucagauuugcagugacuacauuugauacuauuaccuuugguauuagggaaaagugaauuuaagauuuugaaauguuuuuaaaaacuugauaggagauaguaacaauuacuugugaauguuucucuuauaagagaauagcugccagggucaaaguaacaaguuugggauuaugcauuuuuugagguaagauauauuuuacuuuaacauaaugaguuugaugugugacaguagaauauaaaagugaaacauguagcaacucaaauauaaacaugaagaaucagguucucuuaguaguugacuauaagcucauuaaguaaaaguuuaaauuagcaaacuuguuuuccucauaaagaaaucaggauugccuuucucuuuccuagaucugaacuauucaauuauuuuucuuuuuaugcuauaguucacaaagauguccaaaacuaauggcuuaucagaagauuugauauggcacuguaaaacacugauccaagaaagagauguaguuauaaggcuuaugaacaaaugugaagacauuucaaauaaauugaccaaacaaguuaccaugcuuacuggaaauggagguggauggaacauagaacaaccuuccauucuaaaccaaagguaaucuuuguugaauauauuuauucguauuuuaucucaauuauacaaaauaucugaauuuauuucuguaucgugccuagaaagugauauggcaacuagugguaggagagaacccccagguuuucuguaauggcacauaaguggacuaugaacuguuuuucauugauuucccccacccccaaguaggguauuuuauucuaucauaucauuauaaauuaaagggggggaugguaugauacuauaugaccagugucuuuuuugccucauaacagguaauuguuuauauaaucagagaaacugaaaaagugguuuuaguuacuccuauacacaaauuugauauccuaaaaaaagucagcugcuuaauugcaucagcguaaaaccuccuuuccuagcccauuuucuuuuuaaucauaaauaaaaugaaaugauaucccauacugugaugaaauguuuuaaaugauaaggccagcuuuuuaaaucuccuuuugggguagaaauacaucagcaagggaaaggacagauacuuugauuaaauagaucauauaagucuacauauuuccccaauuugcuacuuucaauaaaauacuugucagaauucaugcaaaaaaaaaauacugucuaguggccaguacauauuaaagugguuuuuguaauugugaucgcccacauuuugcauguuguuggcagauuggggugggggaaauuguguugaacuuccuuuaaaaguuuguauauuuuuaaguaguuuggagacucagaacuguucagaauacuucccuuuuuaaaaaaaauaauauaaaacuguuaauaguaugauauuuauaguggcaaaaccauggaaacaaauggaguuccuaaaauuagggaauaauugaaaugaauuaugguauauccauacuuugcaauguuacacaacuuucaaaaugaguuacaucuguucaaaguauuucugauagguuaagauuagcaguaggaucucauuaaaauuaauugccuuaguugcugauuuuauuuacuucugauauuuuucuaaguuaaugaucaaagcauauuugcugaucauugguuaauaauuuaaaaucaagguauggaaaaaaaaacaagaugauuacuggccuuuaauaguaagcuacaaucuuuucugugcccuucuagggugcuaugggaugguguagggaaacgugaugcaguucccacaaagaagcucuuuucucuguugcauagaaagaacuauaucagcaaauuucaucuccuaaaaguguaguuggagcugcugcuucuuguucuccagcauuggauauggggaguucuucacucuacaagacuuacccaguugagucuacuuuaucauaauuuggauuuuuaaaaaucaagugcuuuauugcaucacuuuaaaaauuucucucucaaaaccacauucacaaaguccuguuacuuguaaauaguuugaucagguaauaaacuauccuuuccauuagacugaggauuuuuuaaaugaaauacuuaauagaugagaaaaauaguuguuguuguuguuuuuuuaagugcuuguuggaucuuauccaaaguacaacuucuaaaaccuauauggauagucucuuuaaaguuuauuuaagugcacuuuuagggguuagaauuuguugucuugauuuuuguucuucagccaagguaagaguugcauaagcaauuuuuacuugguguacuggccaggcauuguggguacuuaguauguagacauuuaaaguugucuccuugcuuuaguaaaggauuuauuagcacagaggaaaauauuagacuauccugaugaauaaccuaucaugcuugcauuuuucucuaaacagaacaaguucuucaugacgaaguuuacuuugcuacaaacuguugcaaauuuaugugaauuguaggagaagaaaguuugccuuuuagaaauacaaauauuccggaauuccuugugaaaaaugacaucuuuauagggaaaagcuaaaguuuucauauguacuucaaaaccauuacuuucauaaucuuuauuuuaaaaugucaaaauuuaaauuguuuaaaauauaauacagugaggaaaaagaaaauaaauccuuaguauuucuccuguuuuauucuuacuauagauguagccaucucuaaagcuuuaguuaauuaaucuauaauuuaucagccuuaaaagauuucucacauguucagaauacaauauauuuaaucaagugugucuugccuuuugagcuaaaucugccaagguucuucugaucuuguucauccugaacuugacagcaugguuccuacccuguucuuacacaggagcucugagacccuuugucagugaugugaacgcaaauuaacacugcagaugugguuucacuaacucaaaaguaguaggauguaaauguuuaguuugaacauuucugucacuacagacuaauauugugguaguauuugcagcagccaugucauacuuacgggacauaaacuuuuggucggacagcauccguaaccuguuuucuaugaacugcuuuaaacaagucucucuagcccuguauuucuguauuuuaaacucaaauuuaucacaucacauguaccccuguuguuucuauuuuacgccuuucucaccuuugaaaauaauuuuggaacuaguuucucuggcagauuuaaacccaauugaauuuucagacuguggagaaaucauaguaacucuggagggaauuuuuuuuuuccccuaacaaaacaauaacuucaaaauagccuguugccucauuuucuuucauuaucucagaaaaucuuuaaaucacuuuuuuccuuagugagagauaaaaaaucuucaguucagagauauuuuaauacucuguugagaagaaagcacuuaacuuauucagaagaccugagcaaauccccauguucuuaacaguaaauuggugguucagauauauauuuggucaugaaaauucuuagaaaacugugaagcgucaaaauagaugggaaauaugauuauauagcaucuaaauauuagaaccaacuagaaaagaauauagguauccuauuuuuaaauguuguuauaauaaauggguucagagucuaucaaaauugcauuuucuuugguccuuuuacaugcugagaaaggaucuguaauuggcagcaguuccgugauaguaagcaacaaagcuacuuguaauuuagacaaaucuaacagaacagcaaacauauauacacauuaauacuuuauauuuuuauaacaaauauuucaauguaauaaaaccauuucauguccugaucaaaacaccuuaccauaauuugucauuuugaauaaagcaauuuuauuuaaauuuuaaaaaucuguguaguuuuuuaaauuuccucaucacuuuuuaaaauuugauguuauagugaguauuuugacaguuaaauagacucuuuucccaauguguguuggugaugaagaauuucaguaauuuuuguuuauuaagaauauuucguggcuauuugugauagguuguauguugggauggcauguggguccuuggcugcauuuauaagugauguaugccuaccuuaucaaguuucauuagucguaaauugugagccuuaugugaauaggaugacuaaagaauugggaaggaugcauaaaaauaauggaaaacucaguguguugaccguaggaugggugggucaggaugaaagauaauuuuuucauuucuacuauuuacugguuaagugcugagcucuggaucacaccuggauuggauacugacacuaccauugcagauacagauuugguuagcuacaugaccuugggcaaguuacuuaacuucugugagccgcagugaacuucucaucuguaaaaugcagauaauuaauauuuccuauuuuuaauauggauuaaaugaaauaauaauguauauuaagcccauagcauagucugaaauaugguaaauauuccaguuuuagcauuuacucucaccguuauaguagaaauaauuguuuuggaucuggaaauuaaaaugucuaugauaacauguuccauuuguuacuacuuuuauaguaguagcauagaaauuauauugauugggaaagcaaagaccuuuuuuaaaauucagcaaaagaauuguaaagacagaauuagaaaauuauaaagacagaauuagaaaagaauuauaaaaggcagaauuagaaauacugcuuuuucuccuaccuauacuuuuaguuguauuaaaugggaaauguuuuauaaguugcauaccccacaguuaaaacauagauucugauuuaagauggacaucauucaacuaccuguucuucacucaguucuaauuaugucuugauuucagaguuugauccuucaacaauuuauuauacuauagcuauguccagacccuucccugugugcaaacaggauauaugcaagaggagauuaaggggacaggauaaaagcuggagaaugggaggcauggccuuguccuauguuuucacauuaauguaagguguuuuagugaauaugagaauaggcuuuggagugagaucgacauccugaauuaaaaucuuagucuuaacacuuuguagcuaugcaaccucaggcaaauuaaguuuuuuuuuuuuuuuuaucuguuaaagugaugauaguaacuacuuuaugggauuuuuaaaggguuaaaugaggugauguuugaaaaaugauaucugugccuauguauaauagauguucaauaagugauaacuguuaauaguuuuuaaccauuugaacuauuguuuucauucuguuguuguuguuguuguaauugagacagggucuggcucugucacccaggcugaagugcaauggcaugaucucagcucacuauaacuucugccucccaggcucaggugauccuuccaccucagucuccugaguagcugggacuacaagcauacgucaccaugccuggcuaauuuuuuuuguauuuuugguagagauagcguuuugucaauguugcccaggcuggucgcgaacuccugagcucaagcaaucugcccagcacagccuugcaaagugcugggauuacgggcaugagccacuguuuucauuccuuauaacucugccauauuacuuuccaaacaauucauucucagggauuagucuguuuauauguuuccaaauuaaauaagguuuuugacacuugaaugcuacuuucuacucacugauguucacugucuuuuagcauuugcuaaaacaucagugaacaucagugaguagaaaguagcauguaagugucaaaacaaauaauuuugcuaaacaugugcuguguacauuuguacguaguaugcacauaauacacacauaaaugcgugcuucagaauuauacauaccacugauauuaggagugauugacacacauucagaaaguauuuauuaaaccuaccuggccaaaguagcaaauuauguuuguguuuuuuuguccuaauacuuuuaaguucuuuaaugugcuaaaaaucaaaucaacacaauucaauuuucuauuauagauacuagcuuaguauuaauauuaucauaguuaauauucuaaucauuuauggaauuaauuuggagguacuauauuaugaccaaauauggaaaugcuugauucuuacugccagaagaaauagaauagagaauaaaguuugagaagaucugaaaaaucauuuaugucuuggguucauuuuuuuuaaguagguguacauagcaucuaacaguuaaaagguaagauuagaccuaggcauuuuaguuuuuaugugcauuguaauaacuaauagaaaacugauagaaauauagauguguaauauuugguaacucucucuuuaccaguuugucacucaagcccuaucagaagguugguuugaauuggcuggcauugguacauaaacauggacuuaauggcauuuuggcagaugaaaugguaaguguacuuuauuucuaagauuuguuguugaaagugucauuaaaagguauucuugcugucauuuaaaacaugaaacuuuuuuuugcuacuguaguuaacuacugccaccucaguaccuuauauuuuaucucaucuuuguuuuugauagaguuaguucuacccuccucacuccuccccaagaugaagauagauuuauugucuuucugauuaucagauuaguaaauacauguugcaaacauaaaaauacaaauuaaaaaaucgaaaucaaagucaccuguaauucuaccacuuaaacaagaacuaguuuggugucuucuuuucuagauacuaccuucugcagauguuguguauguacauguguacguacauacauauaugugcuuuuucuacagcugccuuuaaaauuguaacuuagaucccuguccuugucaguaaacaaauccacauauauaucagcaacaucauuucagcuauuuuauuuuuauuagcggucucuccgggucucuguucuuucucaaaucacauugccuuaaagcugaguucacaaaguuuguuauagccaguaguccagguguugucauauggaaacuugaccuuuaaucuaacaucucuauuccuccagcuauacuuuuuugaaguguauauuuaaaaugagucauguucagcaaagaaaauguuacacuguguguuggauuccuaaaauaaaaguuaacacagauaaugauauuuguucccucauuagccucuaagaaaguaaucuuuagcauuguaagauauuuucccauauauauuucauacugucauuaaaacacagauacuguuuaucuaauagaaaagugaauaauauucacaggauuucaaaauacuuacagaaauuaccgaauauaugucauuucaguugugugacugcacuuggaaaucagaccuggguuugggguccccagcuuugccuuucaggagcuaucugauccuuuccaguugaccuaaucucucaaaacuaauaauaaaauguagauagucuuuauaucauaagauugcauuugcuaucaaaugagguauauauuaugugaaacuauuuuuguaaccuguaaagcgcaacacaauauuuauaaguugauggcuuagucagcuagcauugccauaacaaaauaccacagaccaaguggcuuaaacaacagaaauuuguucuucacaauucuggagguggacaguccaagaugaguguaucgguagcuugcguuucuccugaguccucucuuugacuugaagacagccacuuucuuacucuguccuuauguggccuuuucuguguauguacacaugccugauauuucuucuuacaaggacagucauauuggguucaggccccacacuuaugaacucauuuagccuuaauuuccuccugaaaagccuugucucuaaauacaauggcauuugagguuacgacuccaacguauguauugucagugggaaggagguggacacaauucaguccacaacaguugauagcauucaguuccccugaggaucuguaucuccuaaguaacuuuuuuaaaccaguauuuuaaugaugucuaauuuaguugcaguaaaauguacaaauauacagcuuagugacuuuuuacauauauguacacccaugugacuacuacccagagaagcuuuuccaucaucccagaaaguuucucaugcuuuuuuccaguuacugcuaccacuauucuuauaccuauccucguggauuuuuuucugguuauguaguauaugcaguauacucuauacuauuuguuuuugguucauuuggugcaacauaauguuauugagaucuaucuguguucuuauauguaucaguaauuuuuuuguuucuguuuuuguuuuuuuaaauugccaugugguaugguaguccgugguauaaauacagugcaauuuguugaucuucuucuguuggauaugaauauuuagguuauuucuuuucuuuucuuuuuucuuucuuuccuuuuucuuuuuaagcaggugcuugcucugucacccaggcuggagugcagcggcgcacucucagcucacugcagccucgaccucuugagcuuaggcaguccacccaccucagcccucccgaguaucugggaucacagacaugcgccaccaugccuggcuaauuuuguauuuuuguagagauggaguuuugccauguugcccgggcuugucucaaacuccugggcucaagugauccacccaccucagcguccccaaguucugggauuacaggcaugcaccauggcacccaaccuauuuagguuauuuccaguguuuggcuauuaagauaaaacuaugaacauucuuacccaaguccuuuugccaacauaagcgcucauaucucaugauuauauucuuaaggguagaauugcugggauagauuaggcauauguuuccuccauuuagucaugggacauugcccuuaaaccauucaguggauauuaaacauucacugugucuaagcaauaaccaaaauuauauccuuuccaugcaaugcaaaaagucuuccauauuaauguguauuguauaugaacuagcaaugaagaucuauccacugcucaguaaaguaaguuauagcaucauuuggagauuauaaucaauucugucauuugagaacuaagaacauaguagaaauuccuuuagaguugcauucugggaaaucaaaagugaauacagcacagaauuacugcuuuuucuucuguauuuuuauguauuuauuuuuuguuuguuuuaaaauguuauauauugucuuuuaaacuuuuuagggccuaggaaaaacuauucaagccauugcauuucuggcauaccucuaucaggaggguaauaaugguccucauuugaucguuguuccagcuucaacuauagguuuguaauacuggagacaacuguauuuaacuuuaucauguuuuauauagguagaagagaguguguguaagggugugugucggagggguguugugguuucuuaguuuguagagaugaauauuaauuuuauggucucuuuauacuuuucuccuuuguuuauauauguguguuugauuauauuggcagucuuuuaaaaagaacucaaauguaagucaguuuuaaaauuuuagaccaaggacgauuuauguugguuucauaauacuuuuaguuacuuuuaaaagugacuaagagaaaaugaguacuuuuaaauguagaauuaaacagauacguaauuaauuccuacacacauaacuguuccauucuuucucaauucguuggauguagaaguuagaauaagagaauauuuguacaugugaauguaacaaagaaaacccccuucucuuuaaauuggagguuaauaaucaacuguaaauauaauauuuggucaucugcccuucauuuugaugccucacaaaaccucaagaucauuuuacauagguuucauaaggaguaauauuguaaagggucugugauaaaaacaaucgccaugguauuuauauuuuaauuuuuaauuuuuauuuauuuuuuuuaagacagucucgcugugucacccaggcuggagugugguggcucaaucuuggcucaccgcaaccuccgccucccagguucucgugccucagccucccgaguagcugggacuacaggcgcccgccaccaugccuggcuaauuuuuguauuuuuaguggagaugggguuucaccauguuggccaggcugguaucaaacuccugaccucaggugauccacccgccucagcuucccaaaguguugggauuacaggcaugagccaccuugcugggccaguauuuacuuuuuauaaaagacugauuucugaguagcacuugucaaaguuuaguguuaauuuaaccaugugaacauacccuauuguagcagaugcaaauaaugucucuucuguuccauagauaacugguuaagggaaguuaauuuauggugcccuacuuugaagguccucuguuacuaugguaagaauaugucauucugcuuuuaacuuuggaaauuaaaaauaaaguacagcacaauaaauagucauguguuuauuguuuuuaaauucuagguucucaagaagaacguaaacaaauuagauuuaacauucauaguagauaugaagauuacaauguaauugugaccacguaaguauugagaaauuuggggaggauggauauuuaugcagcccccaaauuuaaaaaagaaauuguaguaguacuauguaggaaaguuuaugcuguuaacugugauacgaaaguaauagaaugacuaauguugaggauucaggcauuuuuuaguuugguguguaauacccauauaggagguuuuuguuagugaaucaccucauuaauggugacuauaaaaagguuuugccuaguuauugaaaaaagucgucuuguaauaguaauuucucaguuaagcuuaaaguaaaauuugagauaucccaccaaaauuauuuauauuuuuaacuuacaaauaaguaucuguaauaaauacaaugaaauuucauuuucucaaugaaaaauuugaguuagggcagaaauaaaaaugaaaaauaauacuaauaauacuacuugguaauaauugauguaaauaucuugcacagaacuuaaugcucuuguguuacauuaguugauuuauuuaaaguucuauuuuaacuguaguuauuauuucucucuacuggcuucuuguguaggagucuguccuuuaaaaauucaugcggaauuuuauuuuuucuuaauaaaacaggcuccauaugcagucucaagcugcuagcuauuaacuauuauuucuuggaucuaaucugcuaguuuaauaaaauauuaaguuuuaaagagaaacauguuuuagcuucacguucuuuuuugugcuuauuaaaauauaacacuucauggagcagauuacuuacaaguuauacccaaauugaccuccuccuggguauguagaaguuguccgauuguaacauuaacauuuucuuuuuuuuuuuuuuuuuugagacggagucucacucugucccccaggcuagagugcaguggcgcgaucucagcuuacugcaaccucuugccucccggguucacgccauucuccugccucagccuccugaauagcugggacuacaggcgcccaccaccacacccggcuaauuuuuuauauuuuuaguagagacaggguuucaccguguuagccaggauggucucgaucuucugaccucgugauccgcccgccucggccuccaaaagugcugggauuacaggugugagccaccgcucccagccuuuuaacauuuucuuucaauuauguauugcagcuuucauagcuugguuacaguguacaucaauaauuauuaaauacaaguacgucaguauuuauuugaguaucacccgugucuagugcugugcuuuaaguacuggcuguuagaaauguguaaauaaaaaaugauuuuauaagacauuaaauuucacuagacuccaagcucuuaaagguauaaccuuagagauguuuuuucuuuuggugacagauauaacugugcgaucagcaguucugaugaccguagucuguuucgacggcugaaacuuaauuacgcaauuuuugaugagggccauaugcugaagaauaugggcuccauucgcuaccagcaccuuaugacaauuaauguaagagaauguuuguaaaguuuuccaaauuacuguaaaauuuagauuacguaauuuaauauauguaguauuuauuagcagaaucuguauuauguaguuuaauauauguaguauucuguguuagcaaguuuuuucuguaaaagggaagauaguaaauauuucacacuuuauggacuagauggccucugucacguauucuuugauuuuguuuuuuaacaacccuuuaaaaaauuauuaggucauaagccauaauuuaccuguucuauauguuaaacuauuuauaaauaaucuuucaucaucucauaaaggugauacgaggacacaaguuaccuacuuauaaaagaagaccaaugguuuucguauucauugcuguugauaauagcggacgucaauuauuuaaauuacuauaucauuuaucacagaauguuaaauuauuaauaaugguuuuaauuuaucucuccucccuucaccuuucacuggggaggauagacaugaaaggaguggcucuuuaagaaaaagcuaauauaaauuuuaccuucauucacaggcaaauaaccguuugcugcucacaggcacaccuguacagaacaaucuguuagaacucaugucgcuguugaauuuuguuaugccacacauguuuaguaguagcaccagugaaauacgaagaauguuuuccucuaagacaguaagcauaaaugcauauuuucucccaaauauguuauuuguguuuuaucugggccauucuucuguuaggucucuuuuguuguuuucauagugcauaugcucuaugaaguaacuuuaaguaggugauaacucuauauuuggauugguuuggaaaccagccaaaauauaaugggaaagaaaauagcaauuucccuaaucaauggccagaagucuugguuaauauccuaauuuucugaaggaugacgauuuuaaauugaugaagagcucagauauauaguaugugcggaaaguuugaucauuacaucaucuguaucaaaauuggcuacguaaauuaguaacauuucuuuauggguaaacuauaaaacuagacaaagcuagaauauccagaaaaugccuaugcugagaaauauauucugaaauaaaaguucauaaaaccaaagucacaacuaaaagcgacaguaaagaaauccucuucacaagaaaaguuuuguuacuucuuuauuguuuaggaaaaguauagucuucaagaacucccaguuuuuucaauaccgcaguguuuacacugauucuuggcucucuuccacaucacuaaucuuuugcaagaauuuucugugauacucguccacugcaaauuaacugccuuuuaaacauuuacuaauuugaauucccucccacuuaauguacaguguuuuaaauggccuagcagauuuuaugaaccauuuucuaucuucaguucauaauauauggaggacuccuucacauccuagaauaaaauucuacuucuuaauucuccagagucaccaguucugacuaagcacuauuccccauuuuuagaccaagugauuugcaucagucugcacuagcuuccuuuuggggccauuuuccacaaagaaauaaaggauuuucuaccccccacgcuccuccuuacccacacuuagacacauuuuucaaugagaguuaucuagguaaucgauacaugacucaucaguugaugacuucugaacacccaucugguacaguucaaauugauuacuucaguagagaacaugauuacguaucauaaaacuucaaaauacauauggagcuucaagaaguacauggcagcccagaauucagaugugaagugccaucuagaaugaaucaaguuucugcagaaaauaacucagacucuaaugagggagauuuuuauguuguguaauaauacuguuauugcaauaauuuaagugaauaauuccuaaaaggauauguuuuuauuuugcucagaaaucagcagaugagcaaagcauauaugaaaaggagagaauagcacaugcaaaacaaauuauaaagccauuuauucucagaagaguaaaagaagagguaaugcauaucuacauguuuuuuauuuuuauuguuuuuaaaacuuagguuuuucucuuuacuagaaugauuaucuuaaacuguuuuuucugucucagguucucaagcaguuaccccccaagaaagaucgaauugaguugugugcaaugucggagaagcaggagcaacucuauuugggucuuuucaacagauugaaaaaaucuaucaauaacuuggguauaaucugauuuuuacucuuuuaugugaaaaagaaucuuguacuggggaugcauuuuguuuagucauauaaugggauuugugcauuuuaaaaaauuaucuggaauuugaggaaauaauuuuaaaacuuaguugauauauuucaacaguuauccgcuugguuuuauuuuuuacuguguucucuuugagucacagaaaaaaacacagaaaugugcaaugucaugaugcaguugaggaaaauggccaaucauccuuuauuacaucgccaauauuacacagcugaaaaacucaaggaaaugucucagcuuaugcuaaagguaaggauuucauauuauguuaacacuaagcuuuaauaagagguuaaguuguuaggcuauaagauuggugaacccaaugggcauacuaaaccuuuaacuacauauuuaagaaaaacuuuuuuuuuucagaccaggucugguucuguugccaaggcaggcagucugggcucacugcaacuucugccuccuaggcuuaagccauccuccugcguuggccugcugaauagcugggacuacaggcacgcaccaccaugcccggcuaauuuuuuuguacggaugggguuuugccauguugcccaggcuggucuugaacuccugagcucaagcgauucgcccgccuuggccucccaaagugcuggaauuacaggcaucagucacugcacugaaacacgaaaaacacauuuuagacuaaguucaaaaugaucugggggacauaaaaacaaagaaggacugauaaccuacauuauaagucagcaaacuauggccuuacggcagugacuauuuuuauaaauaagguuuuacuauaacacagucaugccuguuuuuguuuucugggacugcuuucucacuacaggggcagaguugaguacuugccuuacaggucauuuugccuacaaagccuaaaauaugaucuggcccuuuacaggaacaguuugcuaacuccuagucuagacuuccauaaugcacuucuuuuucauuuuauuucuuuauaauuuuagcaauuacucuuuauuuuugccucuuucuccuuuaacauuuuaaccuuauuuauccuuacugaucuuugguugaaagcaacccauuuucuuccuuuucuuuacuuuuuuuuuugagauagacuuuugcucuugucgcccaggcuggagugcgauggcaugaucucugcucacugcacccuccgccucccagguucaagugauuguccugccucagcauccugaguagcugggauuacaggcaccuaccacuacgcccagcuaauuuuuguauuuuuaguagagaugggguuucaccacguuggccaggcuggucucgaacuccugaccuuaggugauuuacccaccucggcuucccaaagugcugggauuauaggcgugagccacugcaccugaccaacccauuucuuuuuaaauuuuuuuuuauuauuuuaaacuuauggagaauuucaaacauuuauaaaaguagaauugcauaaugaaacugcccauauguuacuucaccccuuugaaaguuaccauuugauaauaacaccacccuuguuucaucuauaccccagacuucuccccaggguuauuuugaaccaaguucuagauguuauuucaucuguaaauauuuuaguauguuaucucucaaacaguaaggacuucucccccuuuauuauaccuaaaagauuaauacuaauuuuccuugauaagucuguuacacuaaaagguucuaugauuuagauauuuuaucagguauaaacaguuuuauuaaacuuuucucaucauauuauuaauuauuuuuauuuugaaguauacuguguuuuguuuuguuuuaaggaaccuacacauugugaggcuaacccugaccugaucuuugaagauauggaaguuaugacagacuucgaacuacauguacuuuguaaacaguaccgacacauuaauaacuuucaguuagacauggacuugauuuuagauucuggaaaauuucgaguuuuaggaugcaucuugucugaauugaaacagaagguauuaaaaaagaauggcguuucuuuuguauuuucucaauuacuuuaacuucuuaaagcaauucuggcacacugacuugcuugaauuagccuaugucuguucugcauucuuccagaacuuaguguuuugaacauuuucuugacguauuuucuugauuaccuccuuuccucuguugaaccucagacaaaaacaauagaaaguuaguagacuguaucuguauugauguuuuaaaaaaaucuuaauugucauuauuucauaggugacaaucuguaugugugcuucaaaauuaguuuuuaaagacacuauuuguuaguuauuuaaguaaugcugccguuuaugugugaaauagccuaaauuuguaaaaucacaguccagauaauacauacauaagcaguuguccacauuuuccgacguuuuucuuaugaaaaggaaguaauuuaacuguucuuaaaaucaaaacugagagcuagcuuuuagcccugaaguuaaggcaguuuauucauauauaggcugcaauaagacauacgucuucgguauuacugauuuguauuaaagaagcaguuuaucacagagaauuuucugcaaauuuaucaacaugauauaaguaacacuucuaacuguuuaaaccugucaaggcuuugaguaguaaaacgauuuuuucuauuucuaauucauguauguauuuucacagggugauagaguuguguuauuuagccaauuuaccaugaugcuggauaucuuagagguucuauuaaaacaucaucagcauagguaccucagauuagauggaaagacucagauuucugaaagguugguauaauucauguuaguuacaaaaaaauaacucauuuauuauuauuguuaggauuuuaauugucuaacaaacaauugauaguauuuuguuguuuuuauguuugauuacuucaaaucauuaccuuaaaauaagaguaauuucaauggucaggcaugguggcucacgccuguaaucccaacacuuugggaggcugaugcgggcggauugguugggcucaggaguucaagacuacccuggacaacaugacaaaacccugucucuacuaaaaacaccaauagcaacaacaacaacaacaaaaauagccaggugugguggugcacgccuguggucccaacuagggaggcugaggugggaggauuguuugagccccggggggcggagguugcagugagccaagaucgcaccacugcacuguagccugggugacagagcgggacccuaucucaaaaaauaaauaauuuucuuuuaaauuuucuuucugaauuacaugcaaauacguuuuuuuguuuuuuuuuuuuuuuuugagacggagucucgcucugucgcccaggcuggagugcaguggcgcgaucucggcucacugcaagcuccgccuccuggguucacgccauucugccucagccucccgaguagcugggacuacaggcgccugcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggcgcaaauacguuuugaaacagcuauuagaauuguauuuuuuaugguuuucaccuuuaaauuuuuuucaaagucuaaaacaccuuaucuuucaucaagauuguuuuaaaaucuuucacauuuuaaggguaauuaaaguuuuuuuaauucccaaagguuguaaagauugagcuuaguaaagaagggauugucuuaauaaggacggaauuguguaguauguuuaaauugcauuauauauuuugauuuauuuuuuuucuguuggccagagugguuuuuucccacccgcauuagacuaaagguaaaaguaauguuuuuuuuuuuuaaagaagagaauccacuuacacaauuugaucaugaaguccuugauucaucagaaauguugucugccaguaggagccgauauacuucugagaagguuaaagauugaaaagccauacacagaauuuagcuaagccacaaguuuaaaaaggacaaaauagucauuuaggaauuaauugaaucugaauaguugaauugaaguaagaguugguagggguagcaauaucguagaaaagaaguuggggaauugaggaggcucuucagugauauagccagaggagaaauaacugcaauacuaagagauguacauacaucuucagguuucuuuuucaugugauaaugauuguuuuccauuuuaauuacauuauacaacuuuuuagugagauuuaaccuaauuuguuuaucuuacaggauucaucuaauugaugaguuuaauaccgauauggauaucuuuguguuucugcuaucaacaaaagcugguggauuaggaauaaaucugacuucagcaaauguuguuauacuucacgauauugacuguaauccuuauaaugacaaacaagcagaagauagaugccauagaguaggccagacuaaguaaguguuuuuaguuggaauguauuuuuaauucagugccacuuuaauuuguguagaccauuagaauauaguguuggauguccugccuuaguuuuuguuuuuucggcaaagcauggcuacugauguauuuuauaccagcaguguugaacaucaacugcacuacguaacccuuccauuuucuaguaauuauccacccacauuccaaauaguucugcaguucaugaaguauuaacaauugacggccgggcgccguggcucacgccuguaaucccagcacuuugggagacugaggcgggcggaucaugaguucaggagaucgagaccauccugguuaacagggugaaaccccgucucuauuaaaaauacaaaaaauuagccgggcaugguggcgggugccuguagucccagcuacuagggaggcugaggcaggagaacggcgugaaccugggaggcagagcuugcagugagccgagaucaccaccacugcacuccagccugggcgacagagcaagacuccaucucaaaacaaacaaacaaaaaaauugucuaccccuuugaaaaagaugaguaauuaaaaaaacuugcuuguuagaucaguuaagucccagacaaacuugguaauauacaaacuugcugggcuguccuguuacccuuuaggaaguaaauugaguuguaaauuauuuuagaugaaugguacauuuugacauuggucacagcacuguaaagaggugaagauagccgggcacgguggcucacaccuguaauccuagcacuuugggaggcgaaggcggguggaucacgaagucaggagaucaaggccauucuggcuaacauggugaaaccccgucucuacuaaaaauacaaaaaaaaaaaauuagccaggcgugguggcaggcgccuguagucccagcuacucgggaagcugaggcaggagaaugacgugaagccgggaggcggagcuugcagugagccgcgaucgcaccacugcacuccagccugggugacggagcaagacuccgucucaaaaaaaaaaaaaaaaaaaaaaaaaaagaaaaaaguaauuuccaucugaacacagaacuguuuguuguaauguaguuguaauguuuuguuuuguuuuugagacagagccucacucuggcuggagugcaguggcaccaucucugcucacuucaaucuccaccucccagguucaagcaauucccaugccuuagccucccaacugcuaggauuacaggugugugccaccacacccagcuaauuuugguuuuuguuuuuuuuuuuuuucguuuuuuuuuuuaaguggagacaggguuuugucauguuggccaggcugaucggcugaucucgaacugcuggccucaagcaauccaccugccucagccucccaaagugcugggauuagaggcaugagccacugugcccagucaguaauuuacuuuaaauacaaauaucuuucucuuuucuuccaucuguaggagugucuaaaaguuaaauagucagaaaaugucagucucaaguggcuuaaauaaaagaauuuaaggauauguuugucguaauuuucaaaguauucuuuuugaacucuuaaauauaguuuacauauauccaaauaacuauauuuaguaaccaauggacauauuuuguauuuuuuuuuagagaaguacuaguuauaaaacuaauaagccaagggacgauugaagaauccaugcuaaaaauuaaccaacagaaauugaaacuagaacaggauaugacuacaguagaugaaggugaguuguuuguaagcagaaacuucaauauuuaucuauaugaccaugcaucuaauuagucagugcaagaggaugacaaagauggcuaccuuaacuagcuuacaguuuagggaugaugugugaugugggagaagguaagcauguuuauuucaaaauacuaaaauaauuuuuuugaaguuucuuaaguucaaaauuuuuauuuuuguauauguuuuugaaaagaauauguucaaaacucagaaaugaaagaacagacgccuccuagucgccccaucucccaacuuccccaauagaggugacaaguguuagccuuuuguuuuugugugugugugaccaguuauuuuauguguauaaaaauaaacacguguucuuucuuuuaugggagaaagggugcaugucaacuuacgauacacucuucugcaucuuuucuuauuuaauguuaaauuaauuggaaauaagcaaguuuuuucauucuaauuccuaauauugauaauuguucauuuuaauuuagcaaauuucuguucaugacagacacuguuaugucuguguuauauuaggcacucuguucuguaaaaaucaauauacuuuaaucugucuacagcgagagagaagugcguaugaucaaauaauuacuagucuuucuugcguagcauuuauuucagggugcuguggaagcuuggggaggugggcgguagagaaaguuugaguaagaagcaacugagaucuuuaagaguaaggauaaguagagugaucauaguuaaacaauuagcagucauuacuaggcuuugugugcauguggcaacuugccaguuucagguuguccaggaaauacaguaaagugaaugcauaaggcagauucucuuugggcaauguuuuccuuauuauuuugguagggcagcuuuuagaauuuaguaaagcauuuaaauucuuuuucagcaauacuagcaaauauccaaauauauggauuuuauucuaacaaguuucuaaauauaauagaaccauaauaguugauaaaauuaacuauaagucuuuucuuaugggcuaguucauuuccucagagggaaauuuuucaaccuccugugaagugaagagagguagggagagaggugguaugagaauggcccugagaaaugaaggagggagguuuguucucuuauuuaaauauuaauaguuaaucugccuguuuucagcagccucuuucuucucuucuaugacaaguccagaguuccucagacucauguucuccaaagagaauaaaccuucaguuuuauacauuuggagcaaauggcuggcucucuugggcaagcuuuagacaucuuaccuguucaagcugauuauaacuucauguuucccauuuacccccauuuccugagcuuugaagguagaaggguaaggauucugggugugaacuagccuugcauuucccaccugcagacacuuaagcuuuuacuuuauuaucgaaaaucaguuuccauucuuucaucguuuucuuucaaaaguuguagacaacucucugucugcuguugucuuuuucuccuauucuuucuccuuugucuaauucccuuacacuuuuuucucccaucguauuuuaaugguauuaugggugaugggaacagaggugauguguauguuugaucauuuucagucauaauguaaauuauuuguauuuguauaaauuuggucagucuaaaauuuugccuguuauguucaccuacauugucuguuaaaauagcaguguauuuuuagcugugcucucaagccaauagcuuugaaguguuuaguuaugaagaauccugcccucuccuuaccacuuuuuucagagucuugcucugucgcccagacuggagugcagaggcgcaaucuccgcgcacugcaagcuccgccucccggguucacaccauucuccugccucagccucccaaauagcugggacuauaggugcccgccuccaugcccagcuaauuuuuuguauuuuuaguagagacgggguuucaccguauuagccaggauggucuugaucuccugaccucgugagccaccgcgccuggccucuccuuaccacuuuuccuagaaguuuuccucuaucuuguuaaagcuguuuauauguguuuuucccaguguguauuuuauuugcuagaauaaggauguaauggcgucucuuauuuacucguuuagcuguaaucauuugucuucagcugugucccggguuucauuuagguaauuuugacacuggacugaugauaauacauguaugcccuucuuuccaucucucacagugagguccuuuuccucuauaaacaaaaauguauauuuguaauugacuauguauugcuuuuuguuaccaaucuguuuguccccucuuacaugaaacuaugaaagguaaagaccaugauuccucucaaauaugcuuaucagauuuuuguguuccuagagcuugccuuaguuguuaccagaguaccagcagcaggagcagcaucuccuaagaaauuggcaauuugaaaugcaaauucccaagccccauucuauaccuacuuagucaaaaacucuggcgauggcaccuaauaauacuugguuuaacaggcuauugaagugauucugauaaagcuaaaaucagagaaccacugcuuuaaaauaaagauuguguuuggguuuuuuuucauuaacuucccuuaauguauuaauuguauuaauacauuuuuuaccuuuuggaacuuuaaaaauauauauauauuaccacaaucaugacuacauacuuuuugaauuuuuuuauuacagaaauagucauacaaaaaugaaagcaguggcugggcgugugguucaugcuuauaaugccagcacuuggggagacaggcgggaggaucguuugagcccaggaguucaaaaccagccugggcaacauagcaagacuccaucucuauuaaaauauauauauauuuuuuuaauuguugaaaguauaguaugaaugaaaaauacagcgauuuaacaguugugacauuugcaguguuuguuuuuucuacuucuuuuuucccauugauccauaauaaagucaauuguaaacauggcaauuuauuuucaauaucacagcauauuccucaaaguugguacaauaccauuguagcaucuaagaaaauaaacaguaauuuucagacauuaucauauauuauucauauccagauuucucucauuuguccccuuaaugucuuuuauagcuuuccuuaaaacacuaggguccaaaguucacacacagcauuuuauuguauucugucuuuaguaucuucaaguuuaaaagaaucuccuuauucuuuuccuucuuuucucuucucccugcauucuuccuaacauaguaucaguuuauauaguaauuuaugaagugucaauuuggauuuuaugggcuauuuucaagucuguggaugagcuuggaagcaaggaugucagugaacugacaucccuaagaguugauguacuauuuuguguuccuguggauauauguguuuuguuuuguuuuuuguuuuuuuaacagagaaaagaagaguggaugaaaguacucauaauuuuagauuauagcugagguguauauuugugagagaggggaggaggagagaagugguuaguuuugcuacauuucagccacaucuaauuuauaaaauuauucauaguuacagaucuaucacagaucagcaaauauuugaauugccaccugugcuguugucacuaacuaguaaauuaaucaacucaucucaaaauauucucagugcuaaauugaauuaaucagggauggcuagauuaucugccacugugacacaaagagauuuagaaaaucucaaauaauuccuguaagugcuuauacuggggccucauuuaauuaaaauauagggcaaacauuggauaaaccagguaauuuaaaguggcuaauuuaaucaucagcugguaugcugugcucagaauguuguuuauauguauacagugugggucugagucagugauuauaucuuuagaugaaaaauaagaauauagauugguuuucguugguuuagguuuggguuuguuauccuuguuuucccuacuccauuucuuacauaaauguuuuuuauuuagcaaaugugagaaguuaaguaccaugaauuagauacgauccaguguauuaccguguauuuuuauauagcuuuauaaaauuggaaaaauaaccuuagauugcuauguuggcaauaugaacaagaacauagaggaaauagcccuaaucuaaguagagcuuaggaaaguuuuuaacaggggugagugacacugaagcaaacuagcccuugaaagaugaguaagaauucaccaaagaaaaaaaauaauugagacaauuuuuuuuuaaguaaaauauuuuuauaaagcuuuuaaugcuacuuucugaccuacaggugaugaagggaguaugccagcagauauagccacauuacuaaaaacaucaaugggccugugaaauaagaacugugaacucucaauugaugaggaaauaucaacuuggugcacucaaggacauuuacauuaugaugaccaugggguuuaugaacauuuauaacuuuuuauaauuuccauauuacauuucucauaguauggacaacuuuuugccacuaacugaauucuccaaauacucacacgugaaauuucaaaaaagaagccacaaauauguaguucugaagauguugaauaaucauuuuacaaagcaguuuucugaauggggauuaguuggugauuguuuguaacaaauaugcuaaugcuuuagaaaugucaguauuuuuguaauuauuucuaccuccaaauauauauauauugucuuucacuggauaauguguguagauuuuuacaugugccuuauuugacaaugcuuaugucuuguuuuugcuugucucauuugaaguucuuuuuuauuauguuaaagaaugcagcuguauagauuauauagcuuucauuuuauugcuauuugaagcagauguucaccaaugucagcaagaacucaaccugaauuuaaagguggcauuccauauacuaacaucccccagguccucucaaguacuucugcugaaacaaauuuauuuggcuaggcacuaaguuguuuuccagugaauaguaacuaaagaagccccuaccuugcuccauggauuaauuccuucuguucauuuuccaacugcacuaauugugcauauuacucugccuaaucuugugcauguuuucauugauuucccucucccggcuuuugcuucucuugaaacuguugcccagucacuucugcuccaauucucuuccucucuaaauaguaguuuauuacugccacaucuccaugcaucagcaaaauguuggugacauuuuucuagccuggcagaacagauuacuuaaagcuauuucauuucaaagcagacugaaugugacuucaucuaaaggcagcauuagguacugcauggaaauaggucauuaacuugaaacucuuaucaaaauauauuuuaccaguuuccagaauuuccaguacaggaccgccugaagagagagccauuguucaauuccaauucagugugagugacaaagugaaauuuagaagugaaguugucuauuugauauuuaacucuuuauuaaaucuuucuuuaaauuucugccugucagucuauauugcuguuuuuauuauacaucaguuucuuuguauaacuugugaguuccauguguuuuguuuuuauuauguaaauaucauuauaaauaaacuuauuuauaaaucaaagauuuguuaauuuuuggaaaucaugcuuuucaaagcauccuaacuugcuaagaugcuagguaguacgacccucuggauuuggaaggcaaauaaaacucuuacagugauuauuuagauauuaaagacugagaacucacggcuuaaccccagucuugaugguauauugaacagacugaauauauuuuaccauuacagggcuaaaaggagucuucauguguuaauacuaccuccuuguacaucacuauacccaaaucaguuauucaaauuguuaggaauuuuaccuuuuaaaaucucauaauggauaucucauguuuucuguauuaauguauuuucaaugauaggcuguuucuuuuuuuguuguuauuguuguuguuguuauauccauacuuuuaucucuaaugaaauguaguuggguucuuccuguaaugcgcuauuaugucuugggcuuaauaaaaauauuugugaucauaa

SEQ ID NO: 191620 - RNA, 60068 nt, Homo sapiens
gcaugcgcaacauccccuagugccgccgcucccuacucuggggguugggacuaccuccuuuuccgcgggccccgcccaggcggcugcccgugaccugccugggcgcggggaacugaaagccggaaggggcaagacggguucaguucgucauggggcuguuuggaaagacccaggagaagccgcccaaagaacugguaagggcuacggcggcggcagauaagcggguggaucuguguggggcguagugaaguugguaaaugacaggacacucuucuccccaccgccugcccgauaccgcccggcccccauuuccggggacucccacucgacaggggggccggaggaagagucuuuaggagucggcugugggacgcgagagcuccuggugccauggcucucgaacagguagccgaggguggaugaagaguuucuccaccucgccacugagcgcguaggcagcgacaccguccuggccucggaaaccucuucccccugcgcgcguugguacgacccgcccggaaccuuuucccagcguaggccccaccccuccagcccggcugcggaccacccggagaaccuucuccugcccgaagcguuguuuggagcgggccgggucgcgucugccggaggagccgucuguucuccguccucccuguuguguugaaaaagaggcucaguuuccucuuuccccagcccuuguguugacccuaggcacauaccguagcggggcagggacucgacccagaagaauguuacagaagauagcucuggacccggcuucgaacucucguuaccuauuaauugagauaauauugggaggcaaacaguugaaaaugcccugcagucagucaaccuaaguuugaauccugccuucccacaucucagcucugugaucucuggaaaguucacuucucagugccuucucgacugugaagccagaauaauaguagugucaccucagaguaauugaagauucagggauguaaaguuuucauauugguaguuagggcuaauucuuuaaauacggcacagcuuugcuacucaaaugccaaccagcagcaucaacaucaccugggagcuuguuaaaucucggacaccacuccagacccacugagucagauuuugaauucugacaagcucccuaaugauuagugugcacaucagugcuuugagaagcacugcucugcaacaccuaggcuuguccauaauggaaaaaaaaaauccugaaauccuuuaauaaaugaucuuaccuguucagcucuagcaggcacauuuuaaaaacuaaucuuaugcaucuugcaauuccuggcacauaaugugcguuaauguaaauuuguuguuguuguuguuaaaggcccuagaacaguagacacucauuauuuucgucaggaaacuuacucaguuuugcuccuugguaaaauaaaaauuguggcgcuuaaaugaaauaacgguauaacaucacuuuggaaacuauagaacauuauauagaugcacauuuugugacaucuguauauucuaagauucuuguuauuguagaagugugguagggagagauuauuuguugucuucaguguuuggccuuggcauugccauucguaaauugagauaagauuauggagaagcaaaaaagaugcuggggaaaugguugcuuuauuguuuaaacuagucucuaguauauguacuacuauacuacucuaguauauuguacacuuagauuguuuuuaaaugauaaauugcuaagaacacgauauugguacacucuucaguaggguaaucuaccugagaaagcugauugacacuggaaaauggcaggguugaugcaugagauugguuuuuaaaacuaugcuugccagagccgaacagguaagaucauuuauugaauaaaaaauuuuaguuguuuuuccccccauuauggacaagucuggguauuguagagcagugcuucucaagcauuagugugcacacuaaucauuagggaucuugucagaauucaaaaucugauucaguaggucuuggauagggucugagauuucuaauaagcucccaggugauguugaugcugcuggucuacacuugaguagcaagauuguagagugaauuaagauuagcccuaacuaccaccaccuuuagcuaacauauugaaccaggcauuguguuaagcacucugcaauguuaugagguaggaacuguuauugucuccacuuuacagguggcaacugaggcauacaguauuuagguaauuugcccaaggucauacaguuugugaauuacagcaccagagguuauguauucuaaggccuauacuuagaauuaucaugccauuuauacuaccucccaaagagggauuauaaaggugaaauaagaagccaaagaacuuaacuucuagcaaguaagauaaacauuuuaagagcugguuuggauagggcaccugauaugguuuggaucuguguccccgccaaaucucaugucaaauugucauccccaguguuggaggugggaccuaguaugaggugauuggaucaugggagcagauuucccaugagugguuuagcacuaucaccuuugguacuguccuugagauagugaguucucaugagaucugguuguuuaaaaguguguagcaccuucucccucauucucucuugcuccugccauguaagaugccuauuucuuugccuucccccaugauuggaagcuuccugaggccuccccaaaagcagaagcugcugugcuucccguacagucugcagaacugugagccaguuaaaccucuuuucuuuuuuuuuuuuuuaaauuauacuuuaaguucuggguuacaugugcagaacgugcaguuuuguuacauauauacacgugcuguggugguuugcugcacccaucaacuggucaccuacauuagguauuuuugcuaauguuaucccuccccaacccccaaccccugacaggccccggugugugaugauccccucccuguguccauauguucucauuguucaauucccacuuaugagugagaacaugcgguguucgguuuucugaucuugugauaguuugcugagaaugaugguuuccagcuucauccaugucccugcaaaggacgugaacucauccuuuuuuauggcuucauaguauuccauggugccacauuuucuuaauccagucuaugauugauggacauuuggguugguuccaagucuuugcuauugugaauagugcugcaauaauuuuuuuuuuuugagauggagucucgcucugucgcccaggcagugcaguggcgcgaucucagcucacugcaaccuccgccuccuggguucaagggauucuccugccucagucuccugaguagcugggacuacaggcccgugccaccacaucuggcuaauuuuuuguguguuuaguagagacagaguuucaccguguuagccaggauggucuugaucuccugaccucgugaucugcccgccuuggccuccgaaagucugggauuacagguguaagccaccgcgcccggcccucuuuucuuuuuaugaauuacgcagucucagguauuucuuuauagcaauguaagaaccgacuaauacaguaccacauacacagguauaggaguucagugguuggagugauuaucuccaggcugagaugaucagaaacaguuugaccuuucacugucauguguuccauccucuuccugccuaugaauggguucuugacuauuuaguaggauuuuuaguguuagauuauccacuuuaucuggugcuggagauacccugcccaagguuuucuucaaguuccuccucaguucuucaagguacccauucaguuuugauauguuuuaguuuguuagaagaauguccauccacuuuagggucagcuucuaccaagugccaggcuuucucucacaccugugacuugugaacaaagaaaguguuuugucaccagcugugguuacuuagcauuagucuguaauucaagaaggugccaauaaagcagggaugguguauuagucaggguuuuccagagaaguagaaccaauaggauggauggauagauagguaguugagagggaauuuaauauggaaauugacuggggauuaugaaggcugagaaguacuaucauaugcugucuguaagcuggagacccagagaagccagugguguagcucaguccaggguugaaggccggagaaccuagugaguugggguagcacugauggaagucccagaguccagagaguagagaaccuacaguucugaugucuaagagcaggagacggguaucccagaugcagaagagagcaagaauuugccuuucuucugccuuuuuguuauguccagacccucaacugauuggauggugcccacuuacauugggugggggcugaucuucuuuaguucacugauugaaaugccaaucucuuccagaaacacccucauagacauauucagaaauagugcuuuaccagcuaucuggguaucccucaacccagcugaggagauaccuaaaauuaaccaucacagaugggaaauacuuuuuucucuguagaacugcugaugcacugauaaaguauugagagcuguguaugaauaagaagccaaguaauguuaguuuggcuuuuuuuuuuuuuuucuuuuaagggagaaagaaaauacuuaagaggccaagugaaggaaauuuucaaagauaagaaaauguuggcagaaauggaaggggcauuagagagagagggaauugacuaaaugcuguagucucagcugggcaguuuuugaguugggauaaacuuacaagacagcuccuucuguugggggcugaaagaugcaggcaggugggucuggguccuggcacaggauaagcagaggccagguguagucauaucacaccaucaugguugucacacaugguaccauuuaggccauggugacaggucaauucgggcaaguaagauacauuaugggugguaucuccagagcucugauauaauaugcagcgugcagugggugcuaaguaaauauuuguuaaaugaugagugaguaucagaauaagguuuaguaggguuuaaggucagguagucccaagaugagcaauguuucaaggaacucucuagggaaacauuaacuauguuaggagccucugcagacuaaaaucuuugccccugcacaaacugugguggagacauuuuaguggugaaucuauucuguuuuaaaggaugcaaguaaagaccagacugggccugcugaggaugaggaugccuuaaaauccauuuagaaaccuguaacagucuuggggugggaaucaggaggacauggaauucugcuggaaagagauucuucucuuagacuugagguucugcugggaaaauuguucugucuuacuuagggacuucacuaauuuagucuugggguagagugcccccuuccauggcaucagaauucuuaaaucauaugacuuauguucuuagacugggucaugacucaugguugugggauucuaucagaaaagggaagaaaaugagaaagggagauggaguucauacaacaaauaucgagugauuuuggugugcguuggauuggaauaaggcuuacaaaaauaagacacuagaugacuucaaagaauauaguuuacuggaggagacugacauguaaauaaacacuguagggagauaggagcaauaauuuaaguauauacaaagucuuugaugccauaguggagggagugauuauucagaauggggaacggaagcuggucagggacggucucggucuugucacaaguggcauucaccagguggacgguagauauaggaucaggaaaggggaggcaucccuagcaaagugaacugaauaugcaggguuuagaaguguggaacauauguuagaggaacuagggaaaaaauucagaaugguuggaggaugaaaugcuauucugaguggaaugcaagaggagugaugguagugguaagauguaacauuggagagguagguagagggcagauuaauaaaggucugugugucaugccuacuaaagauggggagcaaucagaacaguggguuagggcaugaacuagaaggaagagauuuagguagggaggccgguuaguggcccaggugauagaugaugugagccuuagaauggcaaugggaauggagaggauaggaugaguuuuagaaauauuuagcauagauagucagaauuugcugaacuacugcaugugggaugagugcaaagaugauucuuagguuucuguuuaacccuaccccagucaaaccuguucaucccccugaauggcagugccaugagcugaaauggagagaauucaggaaaggagcaaguuuguugggaauggugauaguggaggagaaggagccagagcucaguuuuggacagaauuuaagagaugagagaagauagacacagggaaauucuggaagaauauuuuucucuucugcuuuguguccucagcaaaauuguaaacuuaagagcaaggauuauguuucuguuuauucucuaucauccacugggcuggcauaauguugaacuuucucaggaaguguaaagagcucgucagguacuuguuucauggacaggaguagggaugguguuccggguccgacccgcagauccuggccaaacgacggaugaaagaauacacucagacacagguauccagugaaaaagcgggcuaggggaccaggcugcucacagaccccgaggaggguguuguagcaaccgcggcccugacaagccggcgcugcgaguauuuauucaguacagauguaaugacaaaggcuuugagucaacacacuuguggguaauuaacauggucccuccccgccuuccccgagagagcaguccugcuggcggaugauuaaaggccagguuccgaggccuaaguaaacuaacuuaucuagaucaguuucuuuacauccccuuacaucucccagguaagagaaucuggcugccuucagccaaauccuuuucugaagcuuuuguaaaaaccucccgaccuuccaugaagcuuugcaucuuuuuacaauuuuucccaccacccugaccgaucuccuacaauggugagagaaaacaccuggacauuugaaaucuagcaugauugagcugauauauacucagcugacagugacaggaauaggcagauuuugaucuaaggucacuuguauuuguugcuuuuggcugauuucuaguuuuauguauauuuuagauugucuugaaagauaugcaaaauccuagauugccuccaggagaggagcuacguagcugagggucaaaaaugggagggaaacuuuucacuauuugccuuucuauagcuguugaauuuguaccauuaaaauguauuaucuagucuggaauuaucuuaaaaauguuuucuggagucaguaguuauuuuccuacuuuaaauugauuuuauguauuucuguauuuuaaggauuugcuuguuauauuuuuccaguccuuuaauuucgcucuuaaauauguaaaaaaaucuuuaauauuuuaaguuaaaaaacagaggauaacauauccauugugguaggcugaaaaagcuccccacccccaaagagaucagguccuaaucccuggaaccuauuuauguuccuuauuuggaaaaagaguccuugcagguaugaauaaauuaagguucuugagauggggaguuauucagguggcuccuaaaugcaaucaccuguauccuuauaagagggauuuagagggagauuugacauacacagaagaagagaaggcaaugugaggauggagcagagacagcacugaagaugcuggccuugaagauuggauggugagacugcaaacuaaggaaugcugguagccauuaaaaguuggaaggcaagaaauggauucuucccuagauccacuggaggaagcauggccuuccugcuaccuugauuuuggcuuagugauacucagauuucuggcuuuagaacugugaaacagcacauuuauuauuuauuuauuuauuuuuuuuuuugagauggagucuugcucugucgccaggcuggagugcaguggugcgaucucggcucacugcagucuccaccuccuggguucaguugauucucauuuauguuuuaaguacuuuguuauggcagccucaggaaacaauacacuuauauacaugcuuacucucuuuauugcauuuucuuacgucagcacacagagugacagucacugucauaaauuugguaugauuucuuucugcucaguauuguuuguauauuuugaaaaugaaguuuauucauaccaauauauguagauguauuucauguauuuuaacuucauggaguuugauuguauaaaucuaugacaacauauuaguucuaaggccgggagcgguggcucaugccuguaaucccagcacuuugggaggcuggggcgagcagaucacuugaggucaggaguucaagaccagccuggccaacauagugaaaccccgucucuacuaaaaaauacaaaaauuagcugguugugguggcaggcaccuguaaucccagcuacuccggaggcugaggcaggagaauugcuugaacacaggaggcagaggucgcagugagccgagaucacccacugcacucuagccugggcgacagagcgggacuccaucucaaaaaaaaaaaaaaaaucuacacacacacacacacacacacacacacacgcgcgcacacacauuuauucuauugauggacuucuagauuguuuccuuguguaauacaacaauccaaugaacauucuaauaccuguaugcuuguguauuugugagagaguuucuuuaggcuauguacaagggaaauuuuuggaucuuaggauaugacuucuuuguacaaaaauacugccaaauugguuucuaaagggauugaacugauuuguacauucaucagcaauauaugaaaguugcuugucuuuauauucuucucuagcacuuguuauuaacugaauuuuugacuuuugccagucuuagaggaaugaaaugaauaucaggcuuuuuccugauuaucagugagauugaacaucuuuaucuucuccaguuaugugacuugucauuucauuauuguguauauuaucauaaagacuuugucaaguuuaauuucuucuugaaauagaacaccuaugaaaugccaacuacuuuauuuuaaaguuuuauuaugaaaauuuuuaaauuuuuagaaaaguagaaguaauagcagugguuaguacauuugaguugcuaucacaaaauacuaccagcugaguaauuuauaaacaauagaaauuuauuuucuacaguuauggagaccaggaagucggugauuaaggcgcugacagguacagugucuggugagggcacugcuuuuugguucauagauggugccuucuugcuguccucacaugguugaaggggcaaaagagcuaccuugggccuauuuuauaagggcauuaauuccauuccuaagggaccuaauaaccucucaaaaggcaccgccuccugauacugucacuuugaggauuaggauuucaacauacgaauuuggggacaugcaccaacauucauaccacagcagaucguacagugaaaaccuguauaaucaaauguugauagcacuuugcuauuauuugauauauauuuuucagcucggucaguuugaaauagauuauaaauauaacacauuuugcaacauuucauauugcaucucuggaauauauggaaauucuguauaacaaaaauaccuucauaucauugaauaucuaguccauauuuaaauuuucccagguguucccaguaugucuuuuauaacuuuuuaaaacuuaggauucagcgagguuuguguuuggcuguuacuugauuuuauuuaaaaaucuguuuggggucgggcgcgguggcucacgccuauaauuccagcacuuugggaggccgaggcggguggaacaugaggucgggagauugagaucauccuggccaacauggcgaaaccccaucucuacuaaaaauacaaaaauuagcugggcgugguggcgugcaccuauaaucccagcuacucgggaggcugaggcaggagaauugcuuuaaccagggagucggagguugcagugagccuagauugugccacugcacuccaggcuggcgacagagcaagacuccaucucaauaaauaaauaaauaaauauccccugcuuucuacuuauagcauuguaagaauaaagacucguuuguaaaauagagcauuuguuuuguagaauguuccuuguuaugguuuugucuaugucuugugguuaucgcuuuuuuuuuuuuuccuccaacuuuuaaguucaaggguguaugugcaggaugugccgguuuguuacauagguaaacaugugccauggugguuugccgcgcacaucaucccaucaccuagguauuaagcccaguauccauuagcuguucuuccugaugcuguuccucccccaccaucccccaucaagcugcccccacccgaucuccacccccggcugacaggcuccaguguguguuguugcccuccaugugcccauguguucucaucauucaacucccacuuauaagcgagaacaugcaguguuugguuuucugauccugcauuaguuugcugaggauaauggcuucuagcuccuuccaugucccuacaaaggacaugaucuuguuccuuuugugguuagcuuuuuucucuacccccuguguuuucuaugaaauggaaguuggaucuaaguuugauaagauccagguuaaacaauuuuagcaagaaugccucacagguaaccugugugauucauaguguaucacaucaggaggcauauaaugucugucuuguaauuaaugaugcuaauaacuuuggccaccugguugagguagugacacaccagaucuuuacauuauguuuuccuuuuuaugcuaguaacuaaccugaggggugauauuuuagcaccaugugaauguccagcucuucaguaauccuucacuuagacacauuaacauuuauaggugucccuuuccugaaucagcuauucuauaaggguuuuuagaguggugauuuuucuaauucucugauuucuuuuucauuuuuagcuggcaguguucuauaaagaucugucccuuauuagcuggggcuauuugguuaccuugacauagaguuucuauugaaaaugcaggauaagugcuuaaugcucuuuauuuaauugcuaauauuuagaauaaagaauugguauaauaauauccggugguaucaacugcauucucucuccacccguuccucucagaagcaccguuuuggacucauggauuuuuauauauuuaguguguuauaguucuaaccauuauucuguuugauacugaaaaacuuauacauuuggucagugggagcuauuucaagccaguuccuaucugcuuuuagcauaacuuuacuaaucuuugaauacuuccuuguuuucuagcauauauccugguaugauuugugaauuccuagccugagaccugaaaucggccauuucuccaagaugcagugguuucuuuuagcgggaaugcuauuuagauaccaaaauuugagugagccugaugcuucuugcuauucgaguaucccugcuucuaagccuuuuuauggaacagaacugggaaacauguucuuuaaaaaaucaugaagguguuuauagacuaaguugcuuugaaccaacccuuugccaaaaauaacuaaaagagcuaaacaaaaaguguaacuauuugaaaucacugaaagcuaccagggcagugagaaauugcaaaaucaagaucucagcaaagagggaagcucaguuacaugaacccaaucauuugggacuaccuucccccuaaagagauccucuaauuccuaaugcagugggugacaaauagaauuugaguagaguuuuugacaaacccugugguuggggaguauaaaaauuggaguucauggccgggcaugguggcucacaccuguaaucccagcacuuugggaggccgaggugggcagauccccugaggucaguuguuugagaccagccuggccaacauggugaaaccccgugccuacuaagaauacaaaaaguagcugggcgugguggcaggcaucuauagucccagcuacuugggaggcugaggcaggagaauugcuugaaccugggaggcagagguugcagugagccgagaugggugacagagagagacuccaucucaaaaaaaaaaaaaaaauuggaguucauaagcagauauucagggcuugugguugggacucugaaagaauaccccuuagcaauaauagugaccuggaaguagacuggcuuucacaaagacugaagaccaguuucaaauaaucucuauccccugauaggauuaauuaagauuaguuaagaaccaauugccaggacacuuaagcuauauguuugccagaagcaaauguaauuccucuuuggaagaagacaauaucauucagaaacuuaaauuauccugcagauuuucauauguagucauuucucgguaucugaggaggauugguuccagggucccuccgcccauaccaaaauccauggaugcugaaguacuugauuuaaaaagaaaaagguaauugcauauaacguauguacauccuccuguguacuuuaaucucuagauuacuuauaauaccuaaugcaauguaaaugcucuguaaauaguuguuacacuguauuuagggaauaaugaugggaaaagucuacauguuccauacagaugcagccaaccauuuguuuuuuuaaauauuuuugagcuguaguugguugaauccacacauguagaacccauggauauagugggcugacuguacaauauugagaauuccauucuuaaaaaauaaguaaaugccuuuuauuuauuaccauuuauaugauuacgaauauaucucccaguuuguaacauuuuacuuucuuaauggagucaugaugaauaaaaauucuuaauuucaauauagauaaauauaagaagccuuuuccuuuuagugguuauugccuuugugucuuguuuaagaacuccccucucucucucccucucccuuucucccucucccuuucucccucucccuuucucccucucccccucucucccucucucccucuccucuccgucuccgucucccucuguugccgaggcuggacuguacugccguggucucggcucgcugcagccucccugccccgggcucccgugguucuccuaccucggccugccaagugccugggauugcgggcgugcgccgccacgccugacugguuuuugcauuuuuggaggagacgggguuuugcccuguugaccuggcuggucuccggcuccugaccucaaguggucugcccgucguggccucccggggugcugggauugcagacggagucucacucacucaaugcucaauguugcccaggcuggagugcaguggcgugaucucagcucgcugcaaccuccaccuuccagccaccugccuuggccucccaaagugcuaagauuacagccucugcccggccgccaccccgucugggaagugaggagcguaucagcccagccgcccauugucugggaagugagaagcgccucugcccggccgccccgucugggaggcgaggagcgccucugcccggcugccccaucugggaggcgaggagcgccucuucccggccaccccgccugggaggcgaggagcaccucugcccggccgccccgucugggaggcgaggagcgccucugccuggccgccccgucugcgaagugggugccucugcccggccgccccaucugggaggugaggggcgucucugcccggccgccaccccaucugggaagugaggggcgccucugcccggccgccccgucugggaggugaggagugccucuucccggccgacccuucugggaggggaggggcgucucugccugacugcaaccccaucugggaagugaggagcgccucugccuggccgcccugucugggaagugaggagcgccucugcccggccgccccgucugggaagugaggagcgccucugcccggccaccccaucugggaacugaggagcgccucugcccggccgccccgucugggaagggaggagugccucugcccagccgccaccccaucugggaagugaggagcgucucugcccggccgcccaucaucugggaagugagaaaugccucugcccggccgccccgucugggaggcgaggagcgccucugcccugccgccccgucugggaggcgaggagcgccucugcccggccgcccugucugggaggcgaggagcgccucugcccggcugcccagucugggaagugggcgccucugcccggccgccccgucugggacgugaggggcgccucuucccggccgccccgucugggaggugaggggcgucucugcccggccgccaccccgucugggaaguggggggcgccucugcccggcugcccuucaucugggagguggggagcgccucugccuggccgccccaucugggaggcuaggagcgccucugcccagcugcccaucaucugggagguggggagcaccucugcccggcccaucaucugggagguggggagcaccucugcccggcugcccaucgucugggaugugaggagcgccucugcccggccaccaccccaucugggaagugaggugcgccucugcccggccgccccgucugggaggugaggagcaccucugcccggcugccccgucugggaagugaggagugccucugcccggccaccccaucugggaaguguacccaauagcuccgaagagacagugaccaucgagaacaggccaugaugacgauggcgguuuuguugaaaagaaaagggggaaauguggggaaaagaaagacagaucagaugguuacugugucuguguagaaagaaggagacauaggagacaccauuuuguucuguacuaagaaaaauucuucugccuugggaugcuguuaaucuauaaccuuacccccaaccccgugcucucugaaacaugugcugugucaacucaggguuaaauggauuaaggguggugcaagaugugcuuuguuaaacagaugcuugaaggcagcaugcucauuaagagucaucuccacucccuaaucucacguacccagggacacaaauacugcggaaggccgcaggaaccucugccuaggaaaaccagagaccuuuguucacguguuuaucugcugaccuucucuccacuauuauccuaugacccugccacaucccccucuuugagaaacacccaagaaugaucaauaaauacuaaaaaaaaaaaaaaaaaaaaagagaacuccuccucuaaccugaaaucauaaauguauucuccuauacugucuucuuaaaacaccacaguuuugcauuccauaugucuucaguccaccuagaaugaauuucagugaaggauggaacaggaauucaaucauuuuguuuucuauuugucuuaagcugucucucagcauuguucauggaaaauaaccucuuaaugguguuaguuuccuuugccuaguuucgcauauaauagaccucugugaaugaauuugaauaaaggauaauauuuugguagugugaaacucuuucuauagguuccuugugguuuucaaauauauugucuaauuuacuaguugauuuuuuauucuguacacguuauguucuguuuuacuuaauuauaagggccucauuuacuacugaaauccuauuggcacuaaauaaauauuugucaaauuuucuuuacaucuguuuuaaauuuccuuuuauuguaguagucuuuacaguuaugagacuugcuugauacauuuucuugagcucuuugucuuagacuguguuucuuaacucuaacauaacauuauagucaccugaagagauuuuaaaugcuaccugucauuugggcucuaccucuggcccaguuaaauuaguauuuuuaaaguuucccaguugacuuuuguguaguucagguugagaagcacuggucggagacaugacuggauacuuuugguucuucagauuucucuuagguaaguuuuucuuuuuugcaaagccccuuuugauuuuacaaguuuagaaggaauuucucuuuuugacagauuuuaugaaacuuuuacucuuugacauuuaaaaacauacauagaaaguuucugaagauuguuacauaaguguuauuuauggcugaaauuuuuugucccaucacaucuuguauuccgugcaaucaaauucaacagauauuuauuauccuuugugccaggcauuaugcaagggcuuggugaauaagagaaggucuuugacuuucuggagcuuauagucuauauuuguaaguaaucauaaguauaaugagcucuccaaaagagguggggguauaggguucugugcaguuguacugccuggaggguugaaccuauucugugagucagggaaugucucccugaaguaacauuuaagcugagacuuuaagaagaaguucagaaaacacauucuuuagauaaacuggacuuuuucaaaauuaaaaacuuguguuucaaaggacauuauugagaaagaagacuuucuugaaugggagaaaauauuugcaaaucccauaucaguaaagggucuacuacuaucagaagguaaaaagaacucauacaacccaacaaacagacaacucaauuaaaaaaugggcagaagauaugaauaaacaauucuccagaggagauauacaaaugaccaacaagcacaugaaaagauguccaacuucggcugggugcaguggcucacaccuuuaaucccagcacuuugggaggcugaggcagguggauuaccugaggucaggagguguagacaagccuggccaacguggugaaaucccgucucuacugaaaaugcaaaaauuagccaggugugguggugagcgccuguaaucccagcuacuugggaggcugaggcaggagaaucacuuaaacgcuggagguggagguugcagugagcugagauugcgccacuguacuccagccuggccaacaagagcgaaaguccgucucaaaaaaaaaaaaaaaaguccaacuucacugggcauuaagaaaauguaaaucaagcucuccuacucccccucccccucccccccuuccccucccuucgggucucccucuguugccgaggcuggacuguacugccgugaucucagcucgcugcaaccucccugccuugggcucccaugauucuccugccuccggccugccgagugccuaggauugcaggcacgcaccgccacaccugacugguuuuuguauuucugguggagacgacgggguuucacuguguugaccgggcuggucuccagcuccugaccucgagugaucugccugccucggccucccgaggugcugggauugcagacggagucucgcucacucaaugcucaacguugcccaggcuggagugcaguggcgugaucucagcucgcuacaaccuccaccucccagccgccugccuuggccucccaaaguacuaagauuacagccucugcccagccaccaccccgucuaggaagugaggagugucucugccuggccgcccauccucugggaugugaggagccgcucugcccggccgcccugucugggaagugaggagcgccucugcccugccgcccugucugggaagugaggagcgccucugccuggccaccccaucugggaggugaggagcgccucugcccggccacccaucgucugagaagugaggagcgccucugcccagccgccccaucugggaugugaggagcaccucugccuggccgcccuaucugggaacugaggagugccucugcccggccaccccgucugggaacugaggagcgccucugcccggccaccccaucugagaagugaggagcgccucugcccggcagucgccccgucugggaagugaggagcgccucugcccggcagucgccccgucugggaagugaggagcgccucugcccggcagucgccccaucugggaugugaggagcgccucugcccggccgccccguccaggaaguggggagugaggagcgccucugcccggccaccccgucugggaaguggggagcgccucugcccggccaccccguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucguccgggaggugaggagcgccucugcccggccgcccuucgucugggaggugaggagcgccucugcccggccgccccgucuaggaagugagcgucucugcccggcugccccgucugggaagugaggagcgccucugcccggucgccccgucugggaaguguacccaacagcuccgaagagacagcaaccaucaagaacgggccaugaugacgauggcaguuuugucaaaaagaaaaggggcaaauguggggaaaagagagaucagauguuacugugucuguguagaaagaaguagacauaggagacuccauuuuguucuguacuaagaaaaauucuucugccuugggaugcuguuaaucuauaaccuuaccccaaacccggugcucucugaaacaugugcugugucaacucaggguuaaauggauuaaggguggugcaagaugugcuuuguuaaacagaugcuugaaggcagcaugcucguuaagagucaucaccacucccuaaucucaaguacccagggacacaaacacugcggaaggccucagggaccucugccuaggaaaaccagagaccuuuguucacguguuuaucugcugaccuucucuccacuauuauccuaugacccugccacaucccccucuuugagaaacacccaagaaugaucaauaaguacuaaaaaaaaaaaaaaaagaaaauguaaaucaaaacagugagauaccacuucacacucagcagacagcuaucauaaaaaaauuagaaaauaacagguauuggugagaugugguagaaaugguaaccaaaagguguaaacaacccagauuuccauuaacaguugaauggauaaacgaguuguguuauacacauauaaaagaauaauuuccagccauaaaaaggacugaaguacugauacaggcuacaacauggaggcaccuugaaaacaucauguuaaauaaaccagaaacgaaaaguuaacacauugugugauuccuuucauauucagaauaagcaaucccauagagacaggaagcaaauuagugguugccagggaacuggggagggggagauaggaagagauuauuuaaaggguauagggagguggugguuguaugacauuguaaaugcacuaaaugccagugaauuguauacuuuaaaaugguuaauuauauaaauuucacuuccaaaaaaaguacauaaaccugauuagauuuuuaaaacuuguaugaccacacaguuuuaagugcauaaguauuuuuucugaguggaguuggucaaccuaaauaaaaaacagagagagguucccuagaagaaaaugaugguuauuuggcaacagcauugcagugggaauguacuugccgugguaaacuauguauauauucaaggacguaaaggaagacagauuuuuaaagggaaaaggaggauuauguaauuguuuuaaaaugauuaugauaggcuacagaggucaauaacaagagugaugccaguccaaguuuggacaggcaguugcugggcagauguccuuguggaaguauuuuuuguguaagauugcagugccuuugagcaagcaaggcugugguuuuugcagaaucuuuugugauagguuuuguuuagguauacaagugugagaacccucuuagccuuuccagcucuauaugucagauuuuuuaauacacuagugacuucauuuugauucugacaacuuucacaaauuauuacaauuguuguugcauaauaaauauuuuacagauuuuguucaauauuaaacauuaaaaaugaaauuuauuggaaauucaucuucuaaugguauggacuuuuaaaaaaugccauuuagucuguauguccauggaugacugcuacaugaaugaaugcuacaaggguucagcauaaauucuguucuguuuuaugauuuaucagacucaagugcugagaaaccuuguugauguaauaaaaugguaauggaaggaguuuaguuauagcagugucacucaguuuuuugagcuucugagucauguacuaaaaagcacauaguaauuuagcauaaaauugacuuuuaaugauuaauugacucauaacucagguuuuccuucaguguuuuugaaacgugaagaauuggaaaacaguucacuugcauaauaauuugguaaucauuagaguaauuuacuacuuucucaacaccuccaccagcauuuccaguccacccuauguuuagugcuucagaaauuuuugccugucaggaaacuaccaugguaauaagagacauagguuaggggaauguuuuucuuuuguaaaauggaaaagcauuauuuuuaaagggaaaaagggaaagaugaguucucaugacacagacagaguaguuuuugaaaugacuaccugugaaagaugaaaauuuucugaugcucuuaaagcuaacugugcacuuggaccucuucaaaucuuuguguaccuagacaguaccguacucuuuccgagguuuuauauaaagugcugcuuacagccugcccucggcuacgaaucuuugaauaacuuaaaacuccugugcacugugaauaaaaagaggugaaauuaaaaaaaaguaaaauuugacccuaaagcucugucuuugaaaauggcuuuuuaaauuuugugucuguaauaaauguggaguuaauacaaaauucuuaaauuagauugaguuaggaguuucggcuuuucuccucauuccuuuucuaaaaauuuucccaggucaaugaguggucauugaagauaagaaaggaaaugagaguuguugacaggcaaauaagggguaaguuaucauuuuaugucuucuauuuuucacccucuugguauauuuugcuucaguucauaaaaauaaacugcauuuauauaucauaagacauaguuuauuccuauaucaguuauuuauagcugucugacugauuuugcuuuuuaauucuguaaucaguauuaaaaaaagauaaugaguuagaagaaacuuuauauuuuggaagagcaaaagaaaccucuugcuacuuauaaagaaaugccuuuuauggaauucaaauuaaauaaauuauacauaaguaagaaauacaauuucauugucacugcucuaucuuagcaugacuguaaauugaggacaguauguuuauaaauaaaguugauuuuuuuuguuuaguaccauuuaagaugauuugcaaagggaugguaauauuuaaaacuuuuaagguuuuuaacacuuucaugauuggagaagaguuaauaucauaaagguaucccaguaucacuuucuuuaaaaagaauuggagagggaaauuccacucccagccaugaaggaguaauugcuuuucaacuugcauucucaucguaaauaaaaauuuggacaaagcaagagagaaaaaaacuggacaaaaaucugugaaacagcuguuuucaaacauugggcagcuggcaguacaggguugugaucacugagagaauagaaacaaagacagagagucuuaauaugacccugucauucugcuuggagauacuuucuggauuauagcccauggaaggacauuccaagcagagcauagugguuucacuggguugagaauagagauaaggguucagggaguggcuggaauuuguggggccgaguaucagagagaauggaaauacucagagaaagaacuucaaaugucuccauaggauccauuggagucuuuggcugaauacuaagcugugcaugcuuagagugaaauuucaagagacugggcaaagaacaauuacuaggaacagaacaacuaccaggaagcuguaagcugaauaauucuuagagcuaauaaaggauugagaagugguugagcucugaucagacacagaaaagagacuuuguugaaccucugggauguucaauagagaccucagaagagucacaccuuaauaauaaggaucagguagguaguccuagaaaaaaggcuaccacaagcccauaccaaccaaccaacaagacuuaaaagacuucacggcugauuugcagguaauuugacugccugccaaaguaaagauuaacacuguuuaagggaagacuacaaaaugcaggcacccaacaaugaaacauauacaguggccagcauccaauaagauacuauuaugaagaagcaggaaaaugugaccccaaaacaggagaaaagccagguaauagaaauagauuuaaaaaaaaaaaacacccaaaacccccacaaaaaaagaugauugaauuugcagucaaggauuuuuaagcagcuauuauaaauauguugagauuaaaggauaacuuaaacauaaugaggagauaaauacaaaauacagaaaacaacaaaauggaauuucuagaguugaaagaucugaaaugaagugaaauuaaaugaagaaucacugaauggguuuaacagcaaauuagacacuacagaaaacaagaucagugaaauugaagauauacaaaauccaaaauguucaaaugaacauuuccuuugaguauccugucagcaacccaaauauuucagauuuuggauuucggauuuucugauuagggauacacaacugguaugaugcaugguaugaugcaaacauuccaaaaucuaaagccugaaagacauuuggucccaagcauguuggauaagagauauucaaccuguaauacaaauuauccaaacuguaguacagacagaaaaaagaaaaaaacaacaacacagagcuucuaguaucaagugagcuaauguguauaauuugagucucaggagaagaggggucaggaaggaucauaugaaauuguagcugaauguuuuucaaacaugaugaaaacuauuaagcuugcagauccaaggaacucaucuccaaauugaauaaacacaaaaccauacaaaggcaaagcauaaucaaauuacugaaaaccaaaaagauuacugaaaaccgaaaagauaaccccccaaaaagacaaauuuagguccaauaaacagugauaagaaugauuuuaaaauucuuauuagaaacgaugcaaacuagaauaucuuucauauggugagaaaaaccccacaaaacaacccuauguuauccuagacuuaaguccaaugaaaauaacauucauaggugaaggugaaauaaagauauuuucaaacaaaagccagaaagaauuuguugccaauacaauaaauguuaaaagaaguuguaggcugaagaaaaaucauaccagauagaaacuuggauuuauaugaaggaauaaagcaugcuggaaaugguaaauauguaaguaaauauaaauuauuuuuuccucuuaagaauguuuuuaacuuacugacucuuaaaaguaaaaauaauaauguauuguggggcuuguaacauguagagguaaaauguaugacaaugauaauaauugaucagugucaaaaauaaauguuagaaacuucauaaguuucauuagugucucacagccuugcauauuccuuuuuugugcuaugcuuacuauaauucuucucacauccauagcucauuuuuccuuuuaaaugaugaucuucaagcccaauaucuuucauguagguuuccuguuauuugucauuaauaguaauuuauuaauuuacucuaacaugauauaggaaaaagaucauggauuuuggagucuuaacauuaccagguuuaaacucugauaucaccuguccuuaguaaacuucuuugaaucucauagaauuguugugacaguuaagucugugaauauguauaaaguguuuaggacaguaccuggcaugcaguagagacuucacuacuugauggugauaccaaaaaaggggauggggcacuuugauaaagugugacuaugaaguaaugugauugcuuuaaauguuacuugugaaagaaagcaugugaggauuuaucacagaaacacuaucaggaucuuucauuugguuuuaugcuagcagucaaggugaauggaucuaaaaagaaauacuaggguaaaaaugagcaacugcaaaaugaauuuauguucucagaagucaagcuauuggcuauacuuacucggggggaaugguggauuaaagguaacguaagggggccuuguggcauguucguaauauucuguuucuuaaucuagguccugguuacaugaguguguuuaauuugugaaaauguauauagcuguacaguuauguuuacuuuucuguauauauguuauacuuaaauaacaaguuaaagaaaaauaauagcaacuuaaagcaaaauauaacuauagggaguucuagcuucucauggaagauuuaugguaguccacauuuuuaguuuucagucaaauguaacacauuuugaacacucauuauaggcaauaauuggaaagaauuuagguaauucauuucaucugcuccucaaaugaaaauaaucagcuugggugagcacucaugacuauaaagguaguuauacacaugugaaaaugcagaaaaguagaaaguuaaaaucacccugaaguucgaccacuuagagauaaccaccacaaacacuuuggugaucauccuuuuccagauauauuucucucuguuuuuguauuuauacccaaacauuuguuuauaagugagucauacuagucuugcugcugauuuuuauuuauauuguaaaauuuacauaaagcugaccaucuuaaccauuuuuaaguguacaguucaguggcauuaggugcauucauaauguugugcaaccaucaccacuauccaucuccagaucuguuuccucauccauacugaaacucuguaccuauuaaacaauaacuuccuauuucucucuacccccagccccugguaaccacuauucuacuuucuguaucuaaguauuugacgauucuaaguaccucauauaaguagaaucaaauaauuuuugucuuuuugugucuggcuuauuucacuuaacauaauguuuuuaaggaucauccauguuguagcagguaucagaauuucauuccuuuuuaaggcugaguaauauuccguugucuguauauaccauauuuuauuuauauacucaucugcugauggacauuuagauuguguccaccuuuuggcuauugugaauaaugcugcucugaagauggauguacagauaucuguuuugcuuucaauucuuuucaguacuuuugcguacauaaacaaaaguagcauuacuggaucaaauaauuguaucuuuaauuuuggggggaaccauuuacuguuuuccauggcagcugugccauuuuacauuccuaucaucaagagcuaggcuacucaaaaguaacuguauauaugagggaauguagaagucacugugcgugcccagggaaugguacaggcucauaaaauagcucagaagaccuugaguuuauaccuugugcugaucuuuacuacagacacccuaugccaauuuuaaaaaagcaaaaaagaaaaccaaaccaaaccugaugagcccuggggaaucagcaucugaucuccagaguuaccacauuagaagauucaaacauucaguuuucaacaacaguaaaaucauaaggcauacaaagaaacaggaaaauauggccuacucaaagcaggaaaaaguaagucaccagaaacuugcugagaaagacuagaugguagauuugcuaaacaaagacuuaaagcaaguaucgaugugcaaagaacuaaaggaaaagguggauuaaguuaaaaaacgaagugugaacaaaauggaaauaaucgauggaaagcuagaaaacaagaaaagaaaccccaaaauuccagagcugaaaaguacaauaacugaagugaaaaccuuacuagaaugauucaaaagcauauuugagcagguaaaauaaagcaucagcagacuucaaaauagagcaauugaaauuaucaagucugaggaacagaaagaaaaaaaagagacugggugcaauggcuaacgccuguaaucccaacacuuugggaggcugaggcagguguguugcuugaggccaggaguuugagaccagccugggcaacacggcaaaaccucaucucuacaaaaaauaaaaacaaaaauuagccagguguggugguacaugccuguaguccuaccuacccaggaaguugaggcuguaguaagccaugaucaugccauugcacuccagcaugggcaacagagcaagacccugucuacugaaaaaaaagaaaaagaaaaaaaaaugggcagagccuaagagaccugucagacaucaucaaguagaccaacaugcauuguggaaacuuuaggagaagagagagagaaaggugcagagagauuauuugaagaaauaauggcuaaaaacuuccuagauuugaugaaagauaggaauauaaacauccaagaaguucagugaacuccagguaggauaaacucaagugagaucuugccaagaaagacacauuauaaucaaacuguagaaagccauagacagugagagaaucuuaaaaggagcaagagagaaacaucuugucacauacaaaggauccucguaagauuuuagaagauuucucauccgaaacauuagaggccagaaagcaguggauucaauacugaaagaaaaggccuaucaaccaaaauuuuaugucuagcaaaacugucagauaaacaaaagccaugggaguuuauuacagcuagaccugacuugcaagagguaauaaagggaguccuucagguugaaaugaaaggacauuauacaguaacuugaugauguaugaagaaauaaguaucuccauuaaagguagauucauggacaauuagaaagguuuaggccgggcgugguggcucacgccuguaaucccagcacuuugggaggccgaggcgggcggaucacgaggucaggagaucgagaccaucccggcuaaaacggugaaaccccgucucuacuaaaaauacaaaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaagaaagguuuauaacucuacuuuuuguauucuacaugauuuaagagacaugaauaagaaauaaaagguagucuguuuuuggacacauagugccuaaauguaacauugugacaucaguaacugaacugggguagagacagaguuuuaugagagcauaguuuucuuacugcuuuugaaauuaagcucaugcaggcugggcgcaguggcuuauaccuguaaucccugcacuuugggaggccaaggugggcggaucaccuaaggccaggaguucgagaccagacugaccaacauggugaaacccaguuucuacuaaaaauacaaaaauuagcugggcguguggugcgcgccuguaauagcaacuacuguggaggcugaggcaggagaaucgcuugaaccugggggccggagguugcagugagcugagaucaugaugccacugcacucuagccugagugauaaagugagacucaaaaagagaagcucaugcagauucacauuagaguguuauaaguuuaggauguuaagcauaauccucaugguauccacaaagaaaauggcuguacaaaaggaaauaagaagggaauaaaaacauuucauuaaccaaaaaaaucaaguaaacacacaagaaaacauuaaugcaggaaauaagggacaaaauagcuaugccauacagaaaauaaauggcaaguuggcagaagaaaauuuguccuuaucaauaauuccuuuuuuuuuuuuuuuuuuggagauagggucuugcucugucacccaggcuggagugcagcgucgugacacagcucacagcagccucgaccuccugggcucuagcaauccucccaucucagccugccaaguaccugggacuauagaugcaugccacugcaccagcuaauuuuuauauuuuuuguagagacaggguuucaucauguugccuaggcuagucuggaacuccuggacucaagcaauccuccugccuuggccucccaaagugcuaggauuacaggcaugagccacugugcccagcccacaguaauuacuuugaauguaaauggauuuaaagucucuaaucaaauuggcagaauggauuuuacaaaacauaauauuauauuuaaaaacauauauacugucuacaagagugagacuuuagauccaaaaacacaaauagauuggaagcaaaaggauggaaaaagauauuuuguggacauaguaaauaaaagacagcagggacagcuauguuauuaucagauaaaauagauuuuaaauaaagauuauaugagacaaaggacauuauauauuaauuaaagauuaaauacagcaagaagauaauacaaguguacauauuuuuguauacaguaacagacugucaaaacauaugcagcaaaaguggacagaauugaagacagaaauaguucuuccauaauaguuagauaauacugcacugucaacaauggguauaucaacuagauaggaauuagguaggaaaacaggggacuugaagaacgaaggcagagugcaguggcucacaccuguaauccuagcacuuugggaggccgaggcaguuggaucaccugaugucaggaguuugagaccagccuggccaacuuggcaaaacccugucucuacuaaaaauacaaaaauugcugggugucauggugugugccuguaaucccagguacgggaggcugagguaggagaauugcuugaaccugggagguggagguugcagugagccgagauugugccaccacaguccagccugggagacaggcuccaucucaaaaaaaaaaaaaaaaaaaaaaaaaagaaauaaagcaauuggaucuaaagauguauacagaauacuacccaacaacaaacuacacauucuucucacauauacacaagacauucuuuaggauagaccauauguuagacuguaaaucaagucucagucaaauuuaaaagauauauaagguaucuucucugaccacaacaggaugaaauuagaaaucaguaacagaaagaauacuggaaaauucacagauguauggaaauuaagcaacacauucuuaaccaaugggugaaaaaagaaaucacaaagcaaaucagaaaauacuuacagacaaguaaaaaccaaaucagaacauaccuaaaguuagaaggugcagcaaaagcaacacucagaggaaaauuaauagcuauaaaugcuuacauuaagaaugaaggccaggugugguggcuuaaucccaacacuuugggaggccaaggcgggcagaucacuugagcccaggaguuugaggccagccuaggcaacauggcgaaacccugucucuaucaaaaauacaaaaguuagcuaggugcuguggucuguggguagucgcagcuacuugggaggcugaggagggaagauugcuugaacccagaggcagaaguuacagugaguugugauggugaccaaccuugcacuccagccugggugacgggagugaaacccugucucaaaaaaaaaaaucucagaugagcaaccuggcuuucaacuuaaaggaaacagaacaagaacaaagucaacccaaaucuagcagaaggaagaaaauaauaaagauuaaagcagagacagaacagaaaaagaauagagagcauuaacaaaauccauaguugguucuugaaaaagacaaaaaaauguauacaccuuaacuagauugacuaaggaagaagagaaaguugaaaguacuaaaaucagaguugaaaguggagacauuacuacugauuccacagaaauaaagauuauaagaauacgauggacaauuguauguuaauaaauuguguaaccuagaugugauggacaaauuacuagaaacaugaaacuuaccaagauugaaacauaaagaaauagaaaaugugaacagacuuauaccuaguagggagagugaaucagugaucaaaaauauccugacaaagaaaagcuguggaccugaugacuucacugguaaauucuaucaaacaguuaaagaagaacuaacaccaaugcuucucaaacuucaagaaauugaagagaagaaaacacuuccuuauucauucuauguugccaguauuguccugauaucauaucagacaaagaugcugcaagaaaacuauagaccagugucucuuaugaacauuggugcaaaaaucuucaacagaauacuagcaaaccaaauccagcaacacauuaaaaugaguauacaucacggccagugggauuuauccuggaaugcaagaaugauucaacauguaaaauuugaucaguguaauauaucacauuaacagcaugaaggggaaaagaaacucacauuaucaucucaauugaugcagaaaaagcauuuggccaaauuuagcacccuuucaugcuaaaaacaacaacuaggaauagaaagaaauuaccugaacauaguaaaaaccauguaugaaaaaaaccacagggacuaucaaaauaaauggugaaagacuaaaagcuuuucgucuaagaucaggaacaaggcaaggauacccacuuuugccacuucucuuuaacacgauacugaacuucuagccaaaggaguuggacaagaaaaaaauaguuaaaaguauguaaauuggaaaggaauaaguaaaaaucucuguuugcagcugauacuauauguauaauacccuaaagauuuuucaaaaaagaccuauuagaacuaauaaauucauuaagcagcaagauacaaaaucagcaccaaaaaaaauuguauuucucuauauuaacgauggacaaucugaaaaggaaauuaagaaaacccauucucaauagcaucaaaaauaaucaaauacuuaggaauuuacuuaaccaaggaggcaaaagacuuguauaaugaaaaugaugaaauauuacugaaaggaauuggacauaaauaaauggaaagacaucacauuuucauguauugggagauuagauauuguuaagaugucaguaguaccccaaagcaaucuuauacauucaaagugcaauccuuaucaaaaucccaaugacauuuuuuguagaaauagagauaucuguccuaaaauucuuauagaaucuuaagagacccuaaauaaucaaaauagucuuaaaaaaagaaaguuuaacaacucacuuccugguuucaaaacuugccacaaagcuacagagauaaaaucaauguaguacugacauaaagacauauaaacgaauggaauagaaauagguauccagaaaaacuaugugucuguugucaacugauuuuugacaaggguagcaagaccauucaguggaggaaaggacaguuuucagcaaauggugcugggaaaacuggauauccauaugcaaaagaauucaguuggaccuuuaccuaacaauguauacagaaacuaaccccaaauggaucaaagaccuaaauguaagagcuaaaacuauaaaacucuuagaaaaaaacacagaguaaaacuucacaacuugaagaacaaacugcugggcguggugaugugugccuguagucccagcuacucgggaggcugaggcuggaagaccaguugaggccaggaguaugaagcuguaaugugcuauaaucaugccugugaauagccacugcacuacacccugagcaacauagauccaucuccaaaaaauaaaaaagaguagacaaacuggacuucaugaaaaucaaaaauuuuugugcaucuuaaaaagauuaccuggcagggcacagugguucacaccuguaauuccagcacuuugggaggcugugguggguagauugcuugagcccagguguuugagaccagccugggcaacguggcgaaaccccaucucuacaaaaaaagaaaaagaaaaauuguacauuaaaaaaauaaaaagauguuaccaacggaggaaaaggcaacucauagaaugggagaaagcauuugcaaaucauuuaucugaugagagguuguauucagaguauauacagaacaccuaaaaugccacaacaauaaaacgacuuaauucaaaaaugggcaaaagacuucaauagacuuuuggaauuucuccaaauaagcuguacaaauugucaguaaguacaugaaaagauguuuaacaucacuaauuauuagggaaaugcaaaucaaaacgaccucauacccguuaggaugacuacuaucaaaacaacaacaacaaaacccccaggaaauaaccaguguuggugaguaugugguaaaauuggaacuuuguauacuguuagugagaauguaaaaugaugaagccacugugaaaaacaguacagcuguuccucaaaaaauuaaaaauagaauuacccuauaaccuaacaguucuacuuuuaggcauauacacaaaagauagcagggucucaaagacauuuguacauucauguucuucacaauagcuaaaaguuggaaguaacccaaguguccacugacgaaugguuaaguaaaaugucguauauacauacaauggaauauuauugagcuuuaaaaagaaaguucugacauaugcuacaaaaugcuugaaccuuaaaaauauuaugcuuagugaaauaagccagucagaaaaagaaaaauauuaugauuccacuuaaaggaaguaccaaggguaguaaaauucguaaagacagaaaacagaaugguggaugccaggaguuaggggaaaggagaaauggggaguuacuguucaaugggugcagaauuuuaguuuugggaaagaugaagaguucugggccaggugcgguggcucaugccuguaauuucagcacuuugggaggccgaggcagguggaucaccugaggucagcaguucgagaccagccuggccaacauggugaaaccccaucucugcuaaaaaugcaaaaauuagccaggcaucguggugggugcuuguaaucccagcuacuugggaggcugaggcagaaucacuucaaacccgggagguggagguugcagugagcugagacugcaccauugcacuccagcgugggcaacaagagugaaacuccaucucaaaaaauaaaaaaaaaagaguucggggugucuggguggaggugacgguugcacaacaaugugaauguuacuuuauuccacugauuguauacuuaaaaaugguuaagauguuauauuuuauguauuuuaccacaguuuuaaaaauuggagaaaacacuacugaucauaaagcauauaauaaagacuuaucuuaccuuuagcugaugccaguaugagacuuauaauauguucaggcuuuccuuaaguugcagguuuuuagaaaugauuggugacuguauagaaacuguacucuuauaauugugggaauacuacuuauugauuauuggagcaagcucuggaaugcauuuacaguaauuuuuuaaaaauucuuagggccaguaccaacaaauguuagaaagguguuuagaaauucaaguauaauaggaucguacuuuucuuuuaaacuuugauguuguuucuggaaaugaugaauauucacuacguuauuuugauuuuauguauauccuucuauauguuuuucuauuuaauagauacauuuagaucacaauaagaauguauuugagugccaauaaaccugacuuacccuugauuuuugguguucuguucuaaauuuagauauccaaagagaagaagaaaaagugaaacgaucugugaaagaugcugccaagaagggccagaaggaugucugcauaguucuggccaaggagaugaucaggucaaggaaggcugugagcaagcuguaugcauccaaagcacacaugaacucagugcucauggggaugaagaaccagcucgguaaggcugcacuuaccuuacagucaccucauaaugccgggguugcuguuauuaucaacacggguuccuugaauaggaaaaacucaacucugguuuuuauucuuuguauuuucuuaguguugaguguuguagaaaugcaaaauauaauaauguuguuuguuuucuuuuguuaguauuuucuaaauaguaaugaaaucuacauauaaaucugcuuuguuuagaaguuagaauguauugaacaguguuaucacguggccugagaauugaguuguaggaguaagaggccagccuagauguuuggagggaggaugaagaaaagagcuuucuaccuuuguccuagguccagagcagccccaggcaaaauguuacaacaggcuguggggcuuugguucaccuccuuuucugcuucaucucugccuaccuaaugcuuccucacaucuuaggaaucuguagaccacgugauggguauucagcauacaugugaacucuccauuuuagaugacuuuuaggaacucaugauauuuaaaauaggaauaaacauuguuuccuuucaguguccaguacaguacuguuuguggucguucaucuaguugguuucuuuucuuaauuuccauuaaauuaugaaguaguccuaacucagaacuauaguucuuugguaauggcagcaagugacugucagauauuuagauugaauacagacucagaaaucauggagagccaggcaugguggcaugcaguuguagucccagcugcucaggaggcugagcaaggagaauuaagugcuugagcccagggguuugaggccacagugagcucugauuacaccugugaauaaccacugugccugagccuggacaauaaauauagcaagacugugucuaaaaaagaaauaaauuauggagaaauuuuucacugaagaauauuuucaacucucugucagauacuucauugaucacacucaaaagaaguuagaagaugaaguguuuuaauuuauaggauggugccaaauggguuucuaaugcauuauuugguuguauuucguucugaagguauuuucuucacauucaauuuuaacauucgaaugugguuuuaaaauaugccuaaccaugaauguaucauuaguuucuuucucgagauacugaagagaauaaucaugggcugggaaagaguaaaaaaaaaaugacaaaauguuuguaccacaucauccuuuaaaaaaucuaucaagauuaucuuuuauuuauuuauuuuuguuuuuuugagauagagucuuucucugucacccaggcuggagugcaguggugugaucucggcuaaaugcaaucugcgccucccaggcucaagcgauucgcccgccucacccucccaaguagcugggauuacaggugcccaccacuacucccagcuaauuuuuguauuuuuaguagagacgggguuucgccauguuacccaggcuggucucaaacuccugaccucaggugaucuaccuuccucggcucugcaaagugcugggauuacaggcaugagccaccacuuccggccuaucuucacuuuuaaaugccauguuauuacagcccuaaaaugaugauuuuaggcucuugaaauacuggauauaucaccuagauaugccuuuugaucaaacugaguaucagugccauaaagaaauaguuuaauccugucauguugaaagcucaaguauuauugucuuuuauagccagcuugaaaaauucagauugauucucaauuuuuccugcaacaugcucaaaagacacauguucaguugaccaugauaagcuuguuuaaacauuuuucacucuuuccuuauugcuuauuuugccuuuuucccucuaugaauaaagcaguguaugcacagccucuuuuuuuuccaauuguagagaugaaagcagaggauaauguaauaagucuuuauguaccuauuauacagaacuaauaaaauuuaucuuuuuuuuuuuugguagagacgggguuuuaccauguugcccaggauggucuugaacugcugagcucaagugauccacugccucagucuuccaaagugcugggauuauaguugugagccgcugcaccuggcccagaacuaauacaauuuaacguuuuguuguauuugccugcuucuauauuauauauauauaaaaaaagcauuauuacaaaaguugaagcuccuuuaauacaccuucccaguuucauucucuucucucccaaccucuccagagaaagccacuaucaugaaucuuaaaauuuuuaugaaugguaucauacuauagauaccauucugcgucuuuuugcuccauuuaucaucguuuuugaaauauguucauguggauaaauguaggcagggugcaguggcucauaccuguaaugccagcccuuugggaggcuguggcaggaggaucacuugagccaggaguucaaaaccagccugggaaacauaaugaaacccugucucuauaaaacaagacaaaacaaaacaacagcaaccacaauaaaauuaucuauguguauguguauauauauauagagagagagagagagagagagcaugcucuaguccauugauuugaacuacuagaugaaauuacauugauguaucacauuuuauuuuucuguuccccuuuugauggauauuaagguuauuuucaguuuuugcuguguguaaagguuuaggacaguuguauacucagaaguagaauugcuaaguaaguagcuggguuuaaauuuugcuagaauuacaaaauugcucuccaaagaagcuuuacuaauuuauauuuccagcagcaguucaugaguucuuuuuuuccauaccuuuucaccuuuuugacuugguauugucagacuuuuuuauuuuugagaaauguuaucuuguguuaauaguucucucagagcuacuaaacucgagcauucucuuuucuuugcccuuucuuccuguguccugauuccaaaauaccuuuucagccaguuaucgucauaguaaguaaucauuagucugcaugcaaaaacucuuuuaucauacacuuucagcaguauacauaacaaaagcuucccugugcacugcacauaagagccuaucguuuaaauguacacccauaacaauauguuaaguuguucauuucauauauacuguagcuuuaccagaauugaaaaguaaaguauuugcucuuuggccucugaauguuaaggugcucgagggcucuauucuagauccucugcuccuuuccaucuuuacucccaguagucgaucuuaucuaaccccaugccuuuaaaugccauugaguuuuaucuucagggcugacuuuaucucuaagugcguaauuggcaucuccacucagaugucucaagggguaucucaaaauugauauaaaaaaaucuugauuuuccuucucccaccacuuugucuucuuccagucuuucuacuaugagaauuuuuuuuuauuuuaauuuuuggcaucauuaaaaaauuaaacauauguauacucuggguuaccuuauaauugaugaguuucaugagacuugaaucccccauuugcauuuuuguuuaugagguuuggugucaaauuucacuguggcaauccagugugaaaagagcaaaacccaacuuacuguguaaauguccuugccgagggaaucccaucugaugcaaggauuuuaaguaguuuuuuuuuuuuuuuuugagacaagaucucgcacugucgcccaggcuggagugcaguggugccaucucggcucacugcaaccucaguagucuuaauggagaaaagcgggaaaggagucaccagacagauagaugagaacaguauauauaugcauaguuaucaaguauuuuaccuguagcguaacccacauuauaagugguguuuuaguucagcaaaguaucacaugaaauuuacguuguuaaugugaauuuuauugauuuugaaguuuuuuguauuuaauuuuguuuuugaaauaguuuuauaauuguacaauuauaggcauugggaauuuuuacccaauuaguaaaauacacauaauuaaagccaacaacagaaaguuauugguaacaggggaacugcuaacauuuuauuuuucuucaguggaggacugaaucaguaaauuaugauuuauuuagguuucagcauaguauucagcuacagaaagauguuaaugaugcaucauuuaauaagaaagcaaguugcagaacaguauauauagcaugauagcacucuguaaauaaguagaggauguguuuguguaguuguguaaauaaaugauaaauggauaaacagaggucugaaaaagguucacuucugaggagagaaguuggauuguuugaaucauccuguauuguuuucucuuuaacuucuuauuauggaaauauuaagcauauacaaaagcagagugaauacccaaaugaaucucuauguaccuaucacccagcuuaaacaauugucaacucuuggcugauuuuacugaauuuauauucaucccaccuagucccuauauuuuccucugggaauccauauacauuuaucccucgguguccacaggggauugguuccaggauccccacagauaccaaaauuuguggauguucaagucccuuauauaaaaugagguaguauuugcauauaaccuacacauaucuuccuguauacuuuaaccucuagauuaauuauauaauaccuaauacaaugcaaaugcuauguaaauaauaguuauacuauauuguuuagggaauaaugacaaaaagcuuauacguguuugguacagacacagccuuucauuuucguuguuguugaauauuuuugauauugaauauuuuguugucuuugguugguugaauuuacaaacacugaacccacagauauggaggaccaacuguaauuucaucuauaaguauuuacauauggauuucuaaaagaaaaguguuguauccuucuauuccuuggugcauccuuucaguccuggggacuuguauccuacagugcuuggaugugugcauguacauugccuuugcacuguauuuucuguuucuuucugaaagcaaacagucuuaguuauuggauuucucagacuguuccuuuaauuuucuuaccuuucccauguuccauuuugaggauaauaauaguuaguaccuuccucauaagcagguugugaggcucacuucauugccuggcauaguaauugcuguauauauagguucuaaauauuaucaucauuaucaugaucaauuuugucuguguaaucuacuuucugcaaaauuuccucaacuuuauuuuccauuuuuucucaugaauucuuuauuuuggcuaucuuaaccuuaauuuucaagaaaguucucaguuucuuauuuuuuaaaaaaucauuccauucuuccucguuggugcaguauugucuuuuguuaaugacaguugucuuuuugaaauuuucuuacauucuguguauuguuucucagaacugcuucucccaaucauccucuucuuuccuaucccacuucucuuuuuaaagaaagaggugggagggagggaggcagaggagagaguggaagggaggaggguaggggaagcuagauuuaaguauacgcuuucugaguaccugcccucccucgucuuuucaggcauauagacugagcuacaaaaaccaaaauguuaauucauuuaauaaauaucucuuuuagcccuauuaugugcuaggcauacuucugggcacugggguuaaaaucgugaauauuacaggcgcaaucacugcccucuagguaugggguaaauugcagaugauugaagaaauauaauaaaaaauaaaaauaauaaauuuaauaaucaaauggauauuuauaauugcuuacugugauaugcacuaggagaacgugaaagagaaauguagagucaggaauggcuccuuucaggcacugaugaauccugaaagaagaugaacuauuaaguuugugggggugugggaaguggugugccaacuuggauggcuagcaugugugaaggcccuggggccaaaaagaacugugcauucccaacacggaaggaaggucugggagguuggguaccgagcaagugggagggauagcuggagaggaugggcaaggaggugaagaugacaauuuuuacagcuguuaggagagcaaugcuucuccaagacaaguucaaaauaagacgugcuguagcaaugcagauaaagugcaaugggaguuaagaggaaaaguauuuuggggagaaucagggcagcgucugaguguagagggauuagguauacaaaggcacaguugaaauauuucaggcuauguucaggaaacaguuugacaggaaugcaugaaggggagcagugggaggugagacuggaaagguaaguuggagucagaguucugagauaucaggcugaggaauuuaaauuauucuguagacauuugaaagcuuuagcacauuauaagcacagagcacaggugcagggagggacagugcagugugauuggaggcagugggaccuaagagguaauggaguggaguaggggaauggaauagguuagucuagugagaauggaguagaagacagaagaacaggugcagagugaagguauaaacaaggcugagaugcucugagccuuugagccuggaaagagacugcagggccauuaacagacacuggaaacacagggagaggaacaggucuaagagaggaaucuucacuugggcugaccagacuagccccaggaaaucaguggcuauuugguucaccuggcuucugcagcaccuaagcuuuugcugacaggaaggauuccuagacaggguuguuguguugguuuauaguggaguguugcuuguugggagauuaaauacagcagaguagguacgaggauagaacuugggacaaggcaggaaggaaaaggcuacauuuugggaguggaaaaagagaaaacuaaguguaaccaaaguuccugagaugucuuugucaucuuucuauggccccaucccaccccuagccuguugcugcauugaaaagccaagauuugacaaagucauuccucuuucuuaagauguuccccuauuaaaaugcagaugccucuggggagggguaaucuauucagccuugucaccuauuaauacauugucaugauuaggugcuuuccaggugacagcuuucugacagcagcuccuugcaguguaagacagaugaugaguguguuuugauuggaagagaggguuaagggagagguucaaagguggggcaggaaauagaauuaccauaugcuccagcuauuccacuuuugagauauacccgaaagaauggaaggcagggacucaaauagguauuuggaugccaguguucauagcagcagcauucacaauagccaaaagguagaagcaacccaaguguccauugacagaugaauggguaaacaaaaugugauaugucuguauaauagaauauuauucagccguaaaaagggaggaaauucugacuuaugcuacaacaauauggacgaaucuugaaggcauuaugcuaagugaaaugagcaccucaaaaaaggaugaauacuacgugauuccacuuauaugauguaccuugaauucucaaauguagaggcagaaaguagaguguugguugccaaggguaaggggaaauggggauugauugagugauggugcagagguucaguuugggaagaugagaaaaguucuggagauggauggcggugaugguuacacaaaaaugugaaugaauguaccuaaugccacuuaacuauauacuuaaaaauggauaaaaguuacaaauuuuauguuauguauaauuuuggguuaaaauaauguauuuuauguuauguauauuuuacuauuaaagcagugggguaggugugagugcugagcuaucgugggauucugaguggcagagaugcaugagagcuccaagcucuuauauaguuuucaugcgcguccaugugaagagaccaccaaacaggcuuuguaugagcaauaaagcuguuuauuucaccugggugcaggugggcugaguccaaaaagagagucagcaaagggugguggauuaucauuaguucuuauagguuuggggauaggcggugaaguuaagagcaauguuuugcggacagggguggaucucacaaaguacauucucaaggguggggagaauuacaaagaaccuucuuaagggugggggaaauuauaaagaaccuucuuaaggguggcggagauuacaaaguacauugaucagugaggguggggcagaaacaaaucacaaugguggaaugucaucauuuuuacuucuuuugugguucuucaguuacuucaagccaucuggauguauacgugcaagucacaggggaugcgauggcuuggcuugggcucagaggccugacaauagugaugacagugugucuagaaggacaggccaugcaauaaaagggaggcccagguaggauaguacauccaccuagcuaccuuuguccuuuuguuuuguuuuguucugugcuuugauuggaguaccugaaaaugaauuugcaagguauggaucuuuggggucaagcauaacguuugugaaauuuaaaccaauuuguugaaucaaaacacauuuuuaaagacuguucuaguauuuuuaacuuauguguuacagacuuugauaugauuuggcucugugucugcaccuaaaucucauguugaauugugauccugaguguugaaggugguccuggugggaggugauuggaucaugggggugguuucuaaugguuuagcaccaucccccuaguggugucucaugauagaauucucaugaucugguuguuugaaaguguauagcaccuccccuaucucucucucucucucugucuccugccggccaguggagaugugccugcuuccccuuugccuuccaccaugguguaaguuuacugaggccuccccagaagcagaagccuguacagcccacagaacugugagcugauuaaaccucuuuucuuuauaaacaacccagucucagguaugucuuuacagcagugugagaauggacuaauauugacauugcuuuuaaaaaugcuacagaaauauauaaaauaaaaguaauuguucaccaauuucuuugucuuggccucagcccccuuacccacugauaacuacuauucaagugcuauaugaacuguccugcaguuugcuuuuguuagucuaacauuaugucauuuuauacauaccacacacauuuauuacucaggucuacaaauuugagccguuaaauaaacggauuuugcauuuaauauuaaauugugaucuagcauauauaagauuaaaauucaguuucuuuaaggcuugcugaauaauaaguaauuuccuaaaauaaauacauaucugugucauguauuguucaugauguguuuauucaaggguuuuaaguuuuccacuccaaaacuuuuacagauuuaaguucuacaguucauaauugucuuuuucaaaugaaauauuuuccccugcauaaacaaaauacaacauuaaaugaaauuuuuaaagggagugaaaaucaucugccuuccucacaaacugauuguuucauauuuuaguuguuauucauaugaauguuuauuuuacacuguaugaauguuuauuuucauuauacucauauacucauaugaauguuuauuuuauacucuguaaauaccauauaaaaacacaucauuggcauuaagugagagugacaugaggcagucuucccucuagaauuuuaaaguccaauuccuguuagcaagcuggauccucagaaacccuuuuccguccuccaguuucuucccacagaaauggcuuugcugagcuguuuucauaguauuccuuugcuuuuuuuuuuuuuuuugagaugaaguuuugcucuuguugcccaggcuggagcgcaguggcacaaucucggcucacugccaccucugccuccuggguucaagcuacucagccucccaaguagcugggauuacaggugcccaccaccaugccuggcuaauuuuuguauauuuaguagagaugggguuucaccauguugaggagccuggucuugaacuucugaccucaggugauccaccugccugggccucccuaagugcugggauuacaggcgugagccaccgugcccggcccuccuuugcuuuuuuaugguggauaagaaacagccacauggagauuauuucuauaacgucuauacaaucaguggugcagucaauaaagauuauauacuuuaauauuccuuaauauuaaaagccauggaauacauuuaucuuagaacuuagccugaaaaaaaguuuuucccagugaaacaguguugcuuuuaccagugaguguccugcaacccaaaacaugauuaacuuucauguuuuagcuguugagauacagcuaaacuuuaucucaguugcaguagcuuuuauuagccuacgccacugauucucaacuaggggcauuuuugccccuugggggacauuuggcaguauuuggggccauuuuugguugucacaacuaggaggaaaaggggugcugcuacuggcaucuagugggcagaaaccagggcugcugcugaacacccuagaaugcguaaaacagcugccuccaacaaaagaauuacccagcccggacugucaauagugugguuguugagauacuccagcccacauuuauggaaucaacucacacuuuugagcuuuuuuuauuuuauuguaucugccauauacaucuuuuuaauaaacugcuucaaguuauuuuuuuucaaguggaggcauguaagucauaaauaaacgugacuuuaaauuuuuaaaguuucugaaauguacaugguuucaacauucuuuugugacauccuuuugguuuugguucaccauauuauagaauguuuguacuaucuccuuuuucuuaugauuuuuaucuuucuguucauuauuauuauguguuagagauuucuuuggaaaucaugauguaccuuuuaacuuuucuuuuuucuuaaccuuguuucaaggaaaaguugucuuacucucaagggauuuuuacuuuugaggcucaaauguuuuuaauaucccuucucugagcuuucauuugucagaaaugucauaagauuucauauuuucuuauaaucugauucauuguguuuguaaaugccuguuuuaaguuggcuuuuaaaacccacacuguuggucuagugugucaauauuuuuacuucauuuuauuuuugagauagggucuguugcccagucaggagugcaguggugugaucauggcucucauagccucaaccuccguggcuuaggugauccucccaccucagccuccuggguaucugggacuacaagcacgagccaccucacccagcuaguuuuuuguagagaugggguuucaccauguugcccaggcuggucucggucuccugugcucaagugauccgcuugccugggucucucaaagugcugggauuacaggugugagccacuaugccuggcccuauuuuuauuugcuaauuuuuaaaaaauuuaacuguaauucccaugagagccugugauagguagagagaauucucuguuuuuguugcuuucauuauugguguccagauucuuuucagaauauuuucacuggguuccacaucuacugauuaugaaacuaauuuuuuuuuuuuuuuuuuuuugagacggagucucgcucugucucccaggcuggagugcgguggcacgaucuuggcucacugcaagcuccaccuccuggguucacgccauucuccugccucagccucccgaguagcugggacuacaggugcccgccaccacacccagcuaauuuuuuguauuuuuaguagagaccagguuucacuguguuagccaggauggucucgaucuccugaccucaugaucugcccuccucagucucccaaagugcugggauuacaggcgugagccacugcuccuggccaugaaacuaauuuuuuaguuauuuugcuuccagcguuaguuguugauauuacaacauggucauauuuauagcagaaauuguuuuaugcauacaauauccuuuuuucauuuguaucaggugugggaauguaauguuacuuuauuuuuauaugcuuuaauuuuuuuuaaauuaaggcuuauguuuuuagaaaauaguagacucacauacauguaguacaccuguauuugcaagaaauaauacagagagauucuguguacccuucaccuaguuucccccgauaguaacaucuugcaaaaccagaguacaaucucacaaucaggauauugccaucgaugcaaucaaacuacagaacauuuccauaaauacaagaauccgucauguugcccuuguauagccacacguacuuuccucccaucuccaccuucuccuuagcagccacuaauucuccauuucuauaauuuuguuacuuuaagaauguuguauaaauggaauuauguaguuauguaacuucuugggauuggcuuuuuucacucagcauacuucuauggaaauuaacucaaguguuuacauguauccauaguucauuucuuuuuauugcugagugguauuccauuauauggauauaccaguuuauuuaaccauuuacccauuguaggccuucucaguugcuuccaguuguuggcuauuaugaauaaagcugcuauaaaaguguacagguuuaaauucccaccagccaauguaugagugauccuguuuuucuacaucuucuccaacauuuguuguugucacuauuuuuuauuuuaggcauucugguaggucuauggugcugauugugguuuuacuuugcauuuccauaguggcuaaucuuuucaugugcuuauuugccauccguaucuccucuuuggugaaaugauacuucucuacuuuucugugucuucaaaauucucuuugaugaaauguuuaaaagugaacccuuuuuuauuucugguuuuuaauuucuuuuccuacaucaguugcuuuuugucaccaguauguggauguucugucuguaauuuaaaacacugggagaaugagcuucuauuuccuucuccccacuuuuugccauauaaauuuuuuuuucuuuuuuuuuuuuuuuuuugagauggagucuugcucugucgccaggcuggagugcaguggugcgaucucggcucacugcagucuccgccucccggguugaagugauuucccugucucagccuccugaguagcugggauuacaggcgugcgccaccacacccagcugguuuuuguauuuuuuaguggagacgggguuucaccauguuggccuggaucuccugaccucgugauccacccacaucagccucacaaaguauugggauuacaggggugagccaccaugcccagccaaaaauuuuuuuuaaauaaagaaauguucuggaauuuuaaugaucaauacaaaaaagaaaagagaaaacauauuucugacccaauacuaaaucuuucauucuauguaggagcacuugagucuuuauaaaaucaccucaguguuaaauucauuuauuguuuuuuucaacaaauauuugauuguuggcugugucaggcacagugcuaggcacugggaauaaaauagugaguuguccuccaaauaaaaggaaucuaguggcugggcacaguggcuuacaccuguaaucucagcacuuugggaggcugaggcggguggaucaccugaggucaggaguucgagaccagccugaccaacauagugaaaccccacuucuacuagaaauacaaaauuagcuggcaugguggcgcacaccuauaaucccaacuacucaggaggcugaggcaggagaaucgcuuagaacccgggaggcagaguuugcagugagcugagaucgugccacugcacucuagcugggcaacagagcgagacugucucaaaagaaaaagaaagaaagaaagaaagaaaucuaguguucucuugggcagcacauauacuaaaauuggaacaauacugagaagauuaauguggcccugcacaaggauaaauacaaacuucugaagcauuccauuuuuuuuuuuuuaacuuugucccccaagccucuacauauggggcugucagugggacuggcacuccacacugagggaggaccauguggagagacccugaaguuggagagagccugaacccagagagaucugcagacaggccugggguggggaaggauuucagcaaaaagagcugugaccaaugaaaugcugcccaguuuauuucauauuccucucuguguuacuuugaucuuuguuguuuuaaauguggucaacuagcuuuuacauuacugacuuaguaauguuuucucuagaauuuuaaccuuuuuugggggauguggggagguuuuauaguaaaauauauguacgaaaauuugccauuuuaaccauuuuuaagcaggaaauuuggcauuuuaauuaacauuuuaauuaaauauauaacgauacuuugaaugcucuagucuuuugaagauuuuagauaggaauuucuguuucagucuaacacaugcuuucugggacuuucuaccauuaaauaaugcuuuguuuauagauugauucauuuauucauucagcaccuauuuguugauugcauucuaugcauucaacauauuguuaacacagugggacgcagucacuacccugaugccauuuauauuuuaguauauaauguguguucuugguuuuugaaugugguauuuuaagauuaagccacccaugccuauugaaugugaauccacuguggucuuaauggguuuguacagucuauuugaggauaguuuuauacuuuaaauagcacgugagcucauuagaaugcuaucuggcaaaacuaugauuagaguuuuguucagacuuuagaauuaguguuacauauacuucauaaaauauaauggaugauauuuuugcuuucuuuuguuauauuaacuaaggaauauguucagcagcaaauaacggaaaacuugaccacuguggcuuauauuagaacagaauuguggaacuaggccucuuucaccucucauugccugucccugcuucgagcugguuaucuuguacaugggacaugggccuuuccaucagugcuuucucagagucaggagcugaccagcagcacaccaagguguggucaugcauccuaaccaacucucacucaucugggacauucuuaagauauauuuauaaacugcuucagcaguagcacuuuauauuuguaugugugugagaguuuacaaagcucuuugacauaugugaucucauucaaucuucacgaauaaggaaaauaauucagcuugcuuaagauggcagugaggaaauggcggagcugggguucaaacccaauuaucucuagucuaagucauaugugcacuaaaacaaucaggcaggaaaaaagcccaacggcucucuggcagguugguuuuguagauucuggauggaaugccugaugccagguguugcugcaguggaguccuuucagucucaugauacaaauggcaaucuugaaugcagacgacccuucuauuacucuugauuucaccuucaggguauaguuguuuuuauuuuuuaguaaacuuauuuuuugagcaguuuuagguucacagcaaaauugaauagaaaguacagaaaauccacauaccccugcccucacacuugcauagccucauucacugucaacaucccacacaagagugguacauuuguuacaaucaguaagccucuauuuacaugucauuaucacccaaaguccauaguuuacauuaggauucacucuugguguuguacauucgauggguuuggacacauauauaaugauauccacaauuauaguaucauacaaaauaguuucacugcccuaaaaauucucugugcuguuuauucaucuuuuuucccuacuaacucuuggcaaccacugauuuuauuacugucuccauaguuuugccuuuucuagaaugucauauaguuggaaucauacaauauguagccuuuucagacuggcuucuuucacuuaguaauaugcauuuaaguuucuuccuugucuuuucauggcuugaaagcucauuuauuuuuaguacuggauaauauuccauugucuggacguaccaguuuguuuauccguacaccugcugaaagacaucuugguuucugacaaguuuuggcaguuaugaauaaagcugcuauaagacaucugugugcagguuuuucuguggacauauuuuuaauucauuaugauaacuaccaaggagcacacuugcuggaucauaugguaggugugugucuggcuuugucuuccaaaguggcuguaccauuuugcauucccaucaguaaugaaugagaguuccuguugcugcacauucucgccagcauuugguauugucaguggucuggauugggccauucuaagggguuuuuagugguaucucauuguuuuaauuuacaguccccaaaugacauaagauguugaacaucuuuucauaugcuuacuugccauuuauauuaauauaucauguuggugaguuaucuguucaggucuuuugcccauuuuuaaguucaguuauuuucucauuauugaguuuuacgaguuuuuuguauguuguggauagcaguccuuuaucagauaugucuuuugcaaauauuuuccugcagcuuggggcuugccuuuucauucuuuugaagguguggcuauuuuuauuaugaaauaauuuuuaccugccacaccuuuuuucguuuuuccuuuuggaacauaggaaauacauuuuuuaaauaccugucuuaguuucuuuugugcugcuauagcagaauaccugagacugaguaauuuauucagaguagaauuuuauuucaugcaguucuggagucugggaaguucaagauuaaggugcuggcaggguugguugucuggugagggcugcauuuucuggaggguaggcaugcuguguucucacguggcaggaggaagggcaacggagaacgaacugccuccuguaggcccuuuucuaagggcaccuaauccauucaggaggguggaaccucauggccuaaucaccucuuaaaaacuccaccucuuaauacuuaucacaguggcaacaccugaauuuuggagaggacguauucaaaccauagcaaccaccuuugucuugaguuucaaguguacaacauacaauuagucuggccuuuuaaaaauccacuuaccuaauccauuuugguugguuaucaacuugaguguuuuuguaauaaguuuuauuucuaaguuuauuuuuguguccccuuuuuccuacaacauugacucuucccuucuuguaccuucuaauaaucagaaauuuauaccuuuuucagaauacaaaugauucaguguuuaaauacuucucuagucacaguuuuuuccaugucucccaucuguuuacuuauuuucacuaauucagcccaaaaauguuuacugaacacauaccauguucagguacucucucuggguuacagacucaggaugcaaauaauaauacaacuuauaauauguauaaggauguaucaggaugcaaauuauaaaauaauaauacaacuacaggcucauguagacaucaggcuuuauaaacaaaacuggauggaauuugcuuuauuuuuacccuuuucuucccaccuuuauauaaucaauaguaauuuuuaacuuuuuauaaaauuauaaaauuuuauaaauuuauaaaaguaaauuuauaaaaguaauuauaacuuuuuuaucauuuuaauggcauauguaauuuauugcuuauuucagccucacagauucuuggcacuuccucugucauucuacuaauauuaauaaauauuuuauuuucccauuucaguguuaagagaaaugaaguguucucugcaacuagcaaacucccuuacuccuuuagaaaaaucacagugcuaugaaugucagacaggcauuucucuggucacucuuguuuucccuuagaugugaaagcuuccuagggucuggauuccaccagaaguaaaccuguagugacuccugguuuagccaggaggaaggaagucugugugccgguuuuagggaacagcuuguauaugacagcucucagaacuucaagucucaugaaauuccaaaacagguuuagaugguugccaacucuuugacauguuaaagacauugaggguggggcaaugaucuuuugauacuaccgugauuucuuauaaagaagauuguaguaggcauacaaucucagacuacagaagguuuuucucuaguaaggaaccaccucacauugacacacauacacauauucacuguaucuguccuaguuucucucauuuuucugaggaccaaugauaagcuggcuccauacugaacagauacuguccauaggcugguguguggggagcucugcucggguccugaagccuucucuuuccuaguguggccuuuacaaggucuggagcucuuucucccauuugugauuuuccugggugucacaguuacuccaagcuggcuuccuuuccuaaaagucaagaguggcuucaggccacucuccagauuggucauguggugugcaugcucauugaauucacaucaguaguaacccagauagcauacaauuuaggaaagucaaucucuuggucaacuagcacaguaauuaauuuaaaggcacacaaauaacuucgggaguccaucugcuacugcugucauuuauuggaauggcucauaauuuggcugucucucucuauuccauccuguugaacaauccugacuguacacauucucuuucagcggucuugcgaguggcugguucccugcagaagagcacagaagugaugaaggccaugcaaagucuugugaagauuccagagauucaggccaccaugagggaguuguccaaagaaaugaugaaggugacuuggggcuagcccugcuuuccuuuccaaaccccagagucacucuaaacaaguaacagggggcuagggaugaggguggguggggaugaacagacuacaccugcuagacagaauuaauuuuaaggaguagcuguuaacauugauugaaaccauuugagcucagcauagcagaggcugggucagauugccagaguguucuguagaagaagcaaaagucuacccagagcucuagaggaggugggggauccaaggagcaaccauuuagggaucaaggaaauaaaguuugcaggguccaacauaggcaaggagauggaaagaaacuugauuuacaaaaacaggcagagaccguauuuggccugcagcagcuguaguuugcugaucccuguuuuaaacuaaaaaaggagagacugagaaucaaauagaaagugcguaaauaccugccacccccaggaucagggucuggcaaggaccuguacucguggcccucagacaaggacagggauaaagaaggcauugcugccgagccccggcagccacauacuguccuaucuccuagucuguucuucuagccaucgugagaaguagggauuuuuguccucguuuuacauagacagaaacugagcuuuugggucaucagguaguuucccuaaggucaccuugguuguaagugaagauauagaguuggggcacugcagucugaccuuaucacgugaguugucacagaggaaaugaggaugggaggucccucacacagaugcuguuucaugcuucagaccuguggcugacaaccaagaguguacaccucaaauucuuguauagaggcugugcauagaaaucaccucccuuccucucagggaauuucauuuaugaacuugaauuauguacaggguuuagggcaugggagagaggggcuggaaaagaaaauugcagaaaaaugacauagaaagcccagggcccagguuguuugaaugagaacuccuugggcaguagcaguaaggaaggaacugggucaggaggguauguccuuuacaaauagcauguaggugucuugcccccaaguuggugaucacuguucaucuagaaccagauaagaagaucauucuuggagugccuucaggcuugcucauuuuaacucagccaccaggaucugagagggaagccuuuuucagaaucugggaucuuuuucauaaugguuucugaauacugggaguaauacagauuuggaggaaggcuugcguguaguacauucugaaggccccaguaggggcucagcuccucaagggcaagaacacaucuuagucauucuguuuaucccaggccuauuguguggcacagagcaggacuuugaugaaucguugcugauugaaugaauaaauaaaugacaacuucuaccuccagagugugaagggcuauuacaauuaggauucugguggacucuuuuuaaccaauuagcaagcauuuauugcacuucuuuuaugguagcccccaguacuaagaugaucccauucaggaaggcccuaggguuucaccugggugaacaugaauaugaauuuauuuguucauuuugguugggaagaacggaucugaggaugggcagaauagggugcuaguuagauucaggcaggcaggauagaggguugcuuuaaaucugaacccuucagcauagucacugagaauuguacccuggcugaguacaagggagccagggccggagcugcuacaugugaccuucugcuccuugaaucaccaaaacaucaagguacaaagcaagggacuuaguuuuuucagguggcaagacaaccaggauuuucuuuuucuagcaacuucucagaaaccugaacccaugcccuccaccacagccacucagcacccccaguaccuguucugcccagggaugucagcagcccucuuguugacuuuggagguugcuguuccgacccuuugcuucaguaacaaagaacauucaguagggcccuaucugggaguugaggaacugcugagcacaaagacugcagggcuagguuggguugggccaguguuaaagccauuugcuuguguccugcaguggugccaugcugccuugagaacagaggaggcugacuggcuggcuccugcaggcugccaggcacaggacuuccagaaaagugucuggccuuuaccuuguugaguccagaaguauugucuuaguucucccaggagugggugaucagauuuugguuaauugauccuugcagaccuaccagauuaccccauucuggcagauguaaccuggacaagcuggaguccucuucaggccuuuuuuggcuuuuacccugcuguuggcauuuuuuuaucacggcaucuacuacggcuccaaccacuuuucauaccauauuccaaccccugcguucacggauuauauuugcaguguuaggacagaugcuucccaaaacagcgcuggaaauacacucaucugucagugagcuguuucucaggugcugccauuauauuaagucuggguuacuuuaggaagcucugcugacagccaguaguagcacuccccaccccuaggguguuaaauuuagagagccguuucccuuuggggcuuuugcauuucugcagagaggacaacauccaguguuuccuuuggccagcugucucgugugucagcucuugaaaggauagacuggacuuaggcuagagcucggucuaggugauguguagggugucugaugggaacagauuuaacaguugaccgaagugacauauuuauucuguuuaggcugggaucauagaggagauguuagaggacacuuuugaaagcauggacgaucaggaagaaauggaggaagaagcagaaauggaaauugacagaauucucuuugaaauuacagcagguaugaccgugagauccauccuuucuccucucuuuuuauggccauucuuccuucauucacuaaauuagcuaguagcuuuuucuuuaggcauuaacucccuucuacauuuuuaacguuuuacacugugcagcuuauuucuugaaaaguaagcacaauaucuauaaccaucuuuuaaaaaacacaauucuuaaaauuuuuagaguuugcaugauuuuaaaggaagauacugcucucauauacugcuguugggauuuuaaacugguguagacuuucuugaaagcaauuuggccauagccauucaaaagcccuugccuucgccaagugcgauggcucacgccuguuaucccagcacuuugggaggcucaggugggggaucgcuugagcccaggaguuugagaccagccugggcaaccauagcaagaccgcaucucaaaaaaauauauauuaaaaaaaaaaauuugaccuaauagauugacuucugggaguuuaaugaaauaauuaagaaugugcugaaauauuuaauucaaggaugucuguaguagcauuauuuauaaaaaugaaacguuugagggccaggugcaguggcuuaugccuguaaucccaacaccuugugagggaggcugaggcaaguggauugguugaacucaggagcccagccugggcaacauggugaaacccugucucuacaaaaaauauaaaaauuagguaggugggugugguggcacacaccuuagucccagcugcuugggagacugaggugggaggauugcuugagcccaggagguccaggcugcaguuggccaugaucgcacuacugcaguccagccugucucaaaaaaaaaaaaaaaaaaagguucgaaacaaacuaaaugccuaauaaaaucauuuguguuauauuuauuuuaauggaauacuauauauugugauagaugguauagaaauauacucguuaacauggaaugauguuuacaacaugugaauaaagccuuuuuacugaaauacauacuuuuguguaaaaacaugucuauagaagucuggaagggagaugauaaaaauaguaaucuccaagugaugguuaaugaguuuuuaaacuuuauuuuuacuucuagauuuucugaguuuuauguuuaauuaaaaaaauggugggguuuaauuuuuauuaguucauuuguuggguuuaaguuguuggggaaaggaagacaguuacuccaagaaaauauuuugugaagauuuagaaacaauuuaguuuuauucagaaagaagauuuaaaguuuucaguagcauuuaggaauuuagauuaggagcuucagaaccgagauucuuaaaauccuuacaauuauuaugacuuugguaucauuacagguagcuauuugcacauuucccagagugaguaaacccccccaaaaacagcuugcuguacugucucauuuuuguaucuggucagauugguccaggaaugaaaggcagggaagauugaggggcugcuuccuuaagccaaugugguguucaucuuugcucuuucuuuucaggggccuugggcaaagcacccaguaaagugacugaugcccuuccagagccagaaccuccaggagcgauggcugccucagaggaugaggaggaggaggaagaggcucuggaggccaugcagucccggcuggccacacuccgcagcuaggggcugccuaccccgcugggugugcacacacuccucucaagagcugccauuuuaugugucucuugcacuacaccucuguugugaggacuaccauuuuggagaagguucuguuugucucuuuucauucucugcccagguuuugggaucgcaaagggauuguucuuauaaaaguggcauaaauaaaugcaucauuuuuaggaguauagacagauauaucuuauuguggggaggggaaagaaauccaucugcucaugaagcacuucugaaaauauaggugauugccugaaugucgaagacucuacuuuugucuauaaaacacuauauaaaugaauuuuaauaaauuuuugcuuuagcacuuggccccauuguagauugcccugugcaguaaacuuucaaggugucggcugccccagauugcuucauuugcuggguguggaaagaguugcuauggccaggcauaugggauuuggaagcucagcagaagugacuucugcucugugguugcugcuccccggcuuucacagacaugguauggcagccauucuuuuaucuauuuaaccaagaggaugcuggggaauugugcugcuuguccuguuggcugguggcugcauuauguccuggggugugcaugugggucuauuuagagcuucugucccuuccuucccauugcaaguugcacccagaugagacagcuguaguacuaggucucuuucaccucucauugccugucccugcuucgagcugguugucuugugcgugggacaugggccuuccuaucuguguuuucucaaagucaggagcugaccaggagcacacuaagguguggucaugcaucauaaccaacauucacucaucugggacauucuuaagauacauuuauaaaucauuucagcaguaguacuuuguauguguugagaguuuacagagcucuuugacauacgcgaucuuagucuuuacaaauaaggaaaacagcucaguuugggaaguaucagagaugggauucaaacccagauccucugguccaaguuguaugugcacugaacuaaucaggcaggaaaaaagcccagccacugucucacagauuguuuuuuguauauuguagcaaaauccugaaacaaugggguccuuccagucucaucauacaaaauggcaaucuuggcugggugcggugguucaugccuauaaucccagugcuuuacaaggcugaggcaggaggcucucuugagaauaggaguucaagaccagccugggcaacauagcaagauccugucucuccaaaaaaaaaaaaaaaaaaaaaaaaaaauuucauuuuugaguccagaggacccuccuauuacucuugauuucaucuucagaguguaguuaaaaaauuauuuuaaauaauuauuuuuuuaaaucaguuguagguucacagcaaaaguggacaaaaagaaauuucucauauauccccugcccucacacaugcauagccucccaccacuaucaguaucccacaccagagugguacauuuguuacaaucaauaaaccuccauugacacaucauuaucacccaaaguccauaguuuacaugaagauucacucugguguuguacauuguaugggcuuagacaaauguaugaugauaucuacaauuauagaaucauacagaauaguuucacugcccuaaaacuucucuaugcuucaccuguucaucccuuucuucccuaauccccuggcaaccacuuuaaaaaaaaaauuagguucaggggguacaugugcagguaaacucgugacaaggggguuuguuauacagauuauuuagugacccagguacuaagccuaguacccaauaguuacuuuucugguccugucccuuuucccacccuccacccucagguaggccccaguauguuauuccuuuguguccauguuauuucacucccacuugugagaacauggaauauuugguuuccuguuccuauguuaguuuguuaaggauaauggccuccagccccauccauguuccugcaaaggacaugaucuuucuuuggcaaccacuuuuuacugucgccauaguucuuccuuuucuagaaugucauauuggaaucauauaguauguagccuuuucagacuggcuucuuucacuuaauaauaugcaauuaagguuccuccaugucauuucauggcuuaauagugcauuuauuuuuagcacugaauaauacuccauugucuagaugaauaguuuauccauucaccuauugaaagacuucuuggugguuuccaaguuuuggcaauuaugaauaaagcuguuguaaacaucuuugugcagguuuuucuaugggcauguuuuuaauucauuugaauaaauaccaagagcuucagugcuggaucaua

SEQ ID NO: 191621 - RNA, 124087 nt, Homo sapiens
guuucuuaugcagaaagugcugagcaacggacagacugaagagguuaggucuggauccagguaaacccuuuaugaggcuaacgcacuagcugaaugagggaugacagcaucccaccuagacaggugcagacagauucccgagguucagguucggacuucaguuucuccgcuggaacgcugaggguggggcagcacccgggucccugcccugcaaacggggccgcugcaggguuccuuuggcggggccggugccccggggagcgcgcaggacgcgcccgccuucagccgggggccagggcgagcgggacggggcgggcccgcgggugcccugaccagcucaccgcccaaucgcugcgggcccgccgagccccggggggcuggggccgccgccgccgccgccagaacgugccgcggcugcgccaacgcgcgaacgccgggcagggcggcgggcgcgcucagucuggcggcggcugccgugagcugacugacguuccgggaacgccgcagcagcccgcgccgcccgcagccuagccgagccgcgccgcccgggccucgcccgcccgccugcccgccauggugucauggaucaucuccaggcuggugguguaaguggccuucucccccgcgccccuccguccccucccuccccgcccccggccccgggcugcgcgcgccccuacagcgcccggucccaguggcucgggcuauuaauacccggcgcagcuaaauuuagcagguacaguagccgccgaggacgccugcgggcggacgggcggcgcaggacgcggcugcugcccaggaggcagccggcgccggcggccgcuugcggggggcugggccgggacggcgagggcuggggcgcucggggguuccgugggggcugcgucucgccgcgcgcuggccgcuuuguuccucagcucggucgauuugcagaggccccgaaugggcgcaccgcggacacgcgucucucuccuuuggcagaaaugugaggucgcccggcgccgcgccccgccgccccagcuuuugucagguggaaaggacagcgcagacgaaccaggggcgcugccuggagggucagcgcggaacggguggagaggcagaggcggggcucccagugggguuggaaaaauccuccuuuuuaggugucugcaucgacagcggcaaaggcagcugggacaugggaagacgcaugugaaucuuggaguaaacgccuggagcccccggcuccgacuccuuuugcaggggauugagagacaggggcagguaccuccaggaaugcacgggaaauuuucaagugacagccacccgcaugguggcgaugacaccucccaggccuugcaggagagcgcagagucaucuagggugaggucugugugaagucauugggggugggcgugggggccgauuuucuccuucaagccccaggaccuguaggcguuugaagagcuuccccgguggauuuauucuccuuuggagauagacguggcuguuccaagucccuguucuucccuaaccauccuggccugagucagaacagauuugccaccugcuguagcuagcaggggcugaaauggguguggggagucuaaggcggggaggaggguggcaggcaccucgggcuuuuucuuugucugagaacacggggcucuggaccccagugauugugcaccaucacuccccacguuuugaaacaccacccaucucccuucccuucuuuacugauuuucccuuccgaaguggaucucagcauugucucccgccaccauucagggcuuuccucccaaagccagugucugugccucucagcccccaagucauuccgugaaggccucuccacagcuguuccugacugcgggguguuugcgcugcaccuugagguggcauguuaaauauuuagaagauuucugcuggcagagccgacaugaauaauacaggaaaguggcugacacgccuugcccagccucaugccugaccaacacugucuugccuucagggugguguuuccucucugggaucgauauugccaguggcuucugggaagcccucaggguggggcuggagaguugagcuggccuggcuggugggcucucuguagguccugcugggcugggagugagggcaucugauccugggucaugugacuaucauuaguuuuauuagcacugggucaugugacuaucauuaguuuuauuagcaccucccucaccccugcccuuuuuuuuuuuuuuuuuuugagaccgagucucgcucugucgcccaggcuggagagugcaguggcacagucucggcucacugaagccuccgccuccuggguucaagcgauucuccugccucagccucccgaguagcugggauuacaagcgccugccaccacgcccagcuaauuuuuguauuuuuaguagagacgggguuucaccauguuggccagccuggucuugaacuccugaccuagugauccgcccgcuucggccucccaaaguucugggauuacaggcgugagcuaccacgcccggcuccucccccuuuuuuacaaugagcaacugauggggguggagaggagaggcauauauuugggaggugucucagggaugugcuguugcuuucuaaaacaaccacacucccuagaaccgagacuucagagaauuuaaaugaacagcauuauguggcccaaggagaguugaugggauuugggauuguuacuuccacuaucaaguccaaaaggucagggauaccacuuaucccccagucccuaauucccuguagaaaccuagcauaagcauauugauuaugaguuaugaacaucauuuuuaauaagcaauaccuguuucaugaagacaauauuuguuaauuacaggaaaauuagaaaagauaaacugaaaaucauccacauuuccaccacacagagauaacuaauaauaaugauggagggcauauucuucaagaaauuuuccuguauugcauauauguacauauauuuguaauucaaggauauuauugauucagcccaauauucuacacuccacauaccuugaggaacuucuuaucaaggggaggaauacuguguuuggagucagaacgcccaugguucaaaucccaguuuugccucuugccagaagaucccaguucacaacucagaucagagcagaugcuaguccacagcuaguuaaccucauguugcuguugcaaagauuuccaugacacuugauauauaaauugccaagcaccacggagagcacuaaaucaaugaugagucccuccuucuguccuccccgggaacccuaugagaggggcucucagacuuaauuuacuccugugguuuucaaacuggguucccugagggccacccagccugagcagaugggcucugggcuccucaucccugauucaacccaagcaguucccuuuuuguuugucuuauauauugggguucuagauaaaauacaauucagaaaaauauauguguuuuacugcuaauaaaaacaacugaucuaguccucccccucaucuguaaaacugcagaggaaauaugccuugcucagggacacaagaugagcuggugaagaaaacaggcucuggauuuuuaguccaguccagugcuuuuuccaccuucacuccccacugagaaaaacaucucuuucaagcucccuagaccucugguaugggagcauccuaugguuuuauccgcgagucacguuuuguauaaguaaucuuuucaugguuuuguaagccucugucacaucaaagaacauguaaggaagaccuaucacuguguugugaggauagagagggagugucuuccugucuuuguguggucccaaccauccgaccagagguaucacaacaagcugauggccuccagggacagccagccagugcucgugguugucucugcugcuacuggccgugagcauuuugaagaaagcaauuguggcuuguuucccuuuacaaccgcuuuaucccugccaugggucuuucacaaaguaucuggcaccugaaugcacugagugaagguugguuguguugaaggaaauccuaggcccuggggacaagcagaguggcuggcuacugcuguccccuggggacggaggucagcaggcaucaagacaggcuugugcccacgggcaaggcucuuagagugaggaccaguuugagaugcuuauuucuugccagcucucuuucuccuaacuuccuuggcucagccuguaaagaauuaaggaagagauacucagugcaauagcacucagaaccagguugauaccuucaugggacacaggggcuuauuuaggacuugccugcuugccuccuuucauuuucuuuacauacaacucaaggccuaggcaugaaugaauuucaaacuggggagagcauguuuuugugcacccuuuuggaggggggauaccaacguugcucugugacuucuuggaagaauaugccauuuugaagcauuauucuaaggagcagguauugccucauugucuuggccaaggcccagaauguuggcugaacggaucaagagcuucucaccccuuaugggauuaguagacuaaaaccccagcucacuacaugggggaaagagaguucuaaguccacagaauuuucugaauaacuaauggcugugcagaaaacauuuuauuuccacauugcacauuuuaaaaaauacuaguuuuuagaaaauacagugugaugaucaagacagagucuuaguuugauggcugaagaucuggcuaaguuccaggacugggauuuggagcaugaagucuguccugggucagggaugugcaaauggauggagcugggaggaauguggauuguccucaagauguuccccaacuguugcaaaacaaauggaaaaaaaagaaaauaucguaaauccuuaaauauaagcuagcuuuucuuuggggccugcuuuuaaaauguggcaugcaggaaacugauucaguuaauggaggguuccaguugguugaggauugauuuccuggcacugugcuguaguacacugugggagcuggguaaauguuucgguugaauugugaaaggaaagauguuaggcuaguaggcagcagacauggguucuagucccagugcuggucugacucacuaucacaguccuaagggcaacucccacccaccugggccagcucccugucuaagagacagguuuuuggccacagucaccuugcagguccuaagagcuccaagagucaguguuccucuaggucccuuccuuccccagcuggccuguaugcaucacauuuauuuauaaacaggaggaguauccucaaggaagugaaaaauacuagcuuagauuucuccgcuguugagcugcccuguuucuuuguuugcuaauccugccugucugcugagaaguagcuuucaugcacuucuucccacugugucuuauuugagguuagcugacaagugagggucucaccuaguuauuacugggucagucuccccacuuccuucugaagcccgcuaucuuuuuuggaggguguauuaugucgggggaggaggagcccuggggagaaugagggaagggggacucagguccucuuuggccauuuagugaggcugcuguuuuguguacguaugaguguaugugagugaacguguguguguguguguguguguguguguguguguguguuuccaggaaaguuagggaggcuagggaaaggagagauauggcagugcagcagccauagcacguggcaccuuuagaauuucacugccagggaugagccacacacaugcccagcugguuaccagaauucuuagucugggggaguuuuuccaacccccgaaaagaaguaaggagaggggggugcacuugggcacuaaggauguucuccucucgauucugggccuugggaagggaauugggauucuugaggaacuggaaguuggaucauuauauucagaguauuuauucugaauuuucagaucucaucugucuuuauacagaagcacauuauuuucacuuugggauuuuuaagucacacuggggcuucccugggaauacagggaaaaaggaaauauagaucaaggaccaacuauugggcacacaguagggauuucagaaggaaucuugaaagguaauuugguauaggccuucaagcaugcguggguacccagaccaggauggcaagugaggcugccuaggacacugucuugaggagcaagaagcugaguuaggcucaguggggaaggagucccaagagugcuuuaugcagggaagauggcaauggggcacauggguugguucaguauuugcucuuccacacuuagcucauuccugaucagaaaaggucugccccauugucagauuuacuagauuaguaaacagagagcaucuguuauuugaguuaacaucuccuccugacauccuaucucucccucuccccguggccuugucagucaccuggcaguucuaggacaaaggugccuccuguucccacucuagguagcuguccagccuagaggcugucuugcccugcuucucuuuccucuuaggacuauccugcguaucuauacuacauuccccgcccccccaccuuuuuuuuuuccuuucacugaucacagcucaaagucugccuuaggcauucuccugcauacuuagguguguauauccuuucccccucuuuguaggggacucuggauaguacuuugggcugcaaaacuaguuuuccauucccuucugguagcaugcugcauccugccucccuucacucagccacagaagucagcaugugacccaggccuagauaugcauuucccugggcacagacauugguccagaggugggcaggugacccaaacugagauccuuccccaggguuucuugauuuggagcugagggagaauagccuugccuauggguuccagaguugggaagauaugaaguuagggcugaggcaucuaaagccccuggcauacguggagaaaguccauaaguaaaagugaagaauacaacaaagcaaaaauaaauggagaugagacuugggugagagaaagaggcuggcacaagagaaucuugguucugguugcucgggccccaguuccugcagcugcuuuuuugaugccaugaacuguccgauauccuagaaugaaaacuuuaaaugcugcuuauaauccauuaaauauuuguuguucggauggacugggguaugcugcaggaacaacucccaaaucccaguggcucaagaaaacaaagguuuauuucuugcuuucugcugccuguuacuguggguuggcagggguacucugcucaucgcauucacugagagucccaggcugacuggauuuccuuugucuuaucguuauaagacaucaggauucuggcugggcacgguggcugaccguguaaucccagcacuuugggaggcagagguggacagaucacuugagcccaggaauuugagaccagccugggcaacauggcaaaaccccaucucuacaaaaaaaauacaaaaauuagcugggcaugguggugugcaccuguggucccagcuacuuggaggaugaggugggaggaucacuugagccugggagcuggagguugcagugagccgagaucaugccacugcacugagccugagcaacagagugagacccugucuuaacacacacacacacacacacacacacacacacacacacacacacacaccaggauucacugugguagggagagucacauacuagcucauaaguaccugcaccuggagaugauaacaugccauuucugcucacaugucauuggccaaaccugaauucaagugguuacacuccucacuaaagaacagcccuaaugaccagcauauauguugaaugaaugacuccuaaccagcuuugcaaaccuagaaauguccuuggcauaauaugguauugugcaacugggagaauccugacauacuccuucaaucucuacacuagaaauaucuuucucacuucccuuuuagucccuuuauucuguucgugagucaagaaaggaggucuuaagucugaggagaaauuagcaauuacaaagaaccgaugccauuccauagcuaaagccuuggaaggugcccucuggcuuucacuacacucuccauacaugucucuaccuuucuccaugaagccucuccuagguccccuaaccaagaaagauuucuguccucugggucuccagaguggcauugucacuuuguuccuggugcuauaguggucugugcguugauauccccuuacagaccacaucugcuucgucucccuuauaguuucucauaugcaguaggugcccagcgagugcguguuggguggugaaugagucaggaccucacuccucagaguguggucugugcaccagcagcauuggcauuacuggaauaguuaggaaugcagagucccaggccuggugaaucugcauuuuaacaagauccccauaaagccugagaagggcugagucaggagacagggugccaucauguccccugugaauugaaaagagauggacuugccugagguuuucauuauugucuguggaccuuggaccugggauucaauugcaagccaccauuugugcuagacugucauucaugcuuucugguucugagagguucugaccccaaguuuuuaugaugaguucuaaauagcauaucuagacucugucaacccagugcccagccaagaaccuuuugauauggacaggaggcagggaaacacuggauagaagagggcaguucccuggcaaaggccccacccucaagccuggaaacugcggcccuaaaugagaacaguuaucccuguuuuccugcccaaauauugcuuuuuccaaaaccacucuggcucgccacaccccgcauccuguauccauaaaaaccccaaacuccacuggcagagaagcagaguggcauggcagaggagagaagagaagcaucugaacguugagaggaguuuggccagggauggccgcacuccaggggaagauuaucuucccacuguauccccuuuccagcuccccaucucacugagaaccaccuccaucacucaauaaaaucucugcauucaccauccuucaagucugugugaccugauucuuccaggaugccggguucuuccuggaacccggguaccaagagggcaggguauaaaagacugucacccugacucuccacugagcugguuaacagccaucugcagacggcaacugcuaaaacagcauuaauuguaacacaccccuagacgcugccacgggaccagagcccaaaagugcucaccccagcccuggcaccugcucaccugcaugcuuccccuccugcaagggguuugagcacugcaggccgaguaagcaagccacaccccugucacaagucccacagaggggucaaggcagcccuccugucucacuuucuuuuuuuucuuuuuuaagauggauucuuacucugucgccaggcuggagugcaguggcaccaucuuggcucacugcagucuccaccuccuggguucaagcaauuccccugccucagccucccgaguagccgggacuacaggugcccgccaccacgcccagcuaauuuuuuguauuuuaguagagacgggguuucaccauguuggccaggauggucucgaucuccugaccucgugauuccucaccuuggccucccaaagugcuggaauuacaggcaugagccacugggccuggccuccuuucuuacuuucacagauuggcugccuaauugugaucaguguaaaauuuagucuugucacaacuagggcuuagacugccaaagcuaugccugugagacagaauauugggcugagugggucacgcugcucagaggagagggaauacaacccaccuugagaaagaggcuagugagccuggccagcugaugcuggagauucacguuggauuuccaagaacaugcaaggacuuuuucucaugagcaccugaagcugagaaccacgaguccacacgugccccuccugagggaguugcaggauccagcaggaucugugcacacuucaggcugcguguuguggaauccaggcucucagcaaguucuccuagcucugccuucaaaauacucgccugucuacccaugacucccaccuccaccacugccacccugcuccaaccaaauacuguugcucuccuggaccauugaaaacccuccugacuguuuucucugcuucuauuccugucccuccggugaucucauuaaaauguaagauagggccaggcacgguggcucaugccuguaaucccagcacuuugggaggccgaggcgggcagaucaugagaucaggagauccagaccauccuggcuaacacggugaaaucccgucugcacuaaaaauacaaaaaauuagccggauguggaggcgggugccuguagucccagcuacucaggaggcugaggcaggagaauggcgugaaccugggaggcagagcuugcagugagccgagaucacgccacuguacuccagccugggcggcagagcgaggccccaucuccaaaaaaaaaaaaaaaaguaagauagaccaucuuuccccugcuguuuaaaaacugcuccaucucacuaagaguaaaacucaaaguccuuaccauugucaacaacacucaccaaggucuggcuccugcccacgcucugaccuuaccuugcaguggccuccccucucucacucagcugcagccuccucacuauucuuagaagguggcaagcuugucccauccagcacccuuugcacauacauauauuaauaauauauauuauuucuauaauagagcuaccaguuagagaccuuagaauaagucuuuuuuaaaaugaaaaaacaaauaaagcaaagaagugaaaauauaagaaaacagcauauccugggggagggaaauaagcccauguggaaaagaagcacuucuggaaguaaaaaauaaaguguugacauuaaaaauccaaugacuagguuaaaacagugaaggauugaaugccaagaagguaguguuuuucacacugcaucuuagagcuagaaggagucuuggugaugucaugcccuuguucgacagacaaggaagauggggacccacagagauaggugaucugucaaaaucacuagcccgauuggcuaggccaagaguuaaggccagguguccauguucugaaaauguuuuaaugugggaaagagaguaagcuuguuuuauauggguagagaauuggacuagaaccuguggguggcuagaagauaaaucuuuggcuugcuggaaggaaaagguuuccaguaguuggcacugacagcacugggcugccuugugaggcagggagcuccuggcuuccaacccuaaaacuguccaacccuaaaacuuuaugauuuuuuauuuuuuauuuuuuuuuugagauggaguuuuacucuugucgcccaggcuggagugcaauggcaugaucuuggcucacugcaaccuccgccucccggguucaggcgauucuccucccucagccuccuaaguagcugggauuacaggcaugcaccaccaugccuggcuaauuuuguauuuuuaguagagacgggguuucaccauuuuggucaggcuggucuugaacuccugacaucaggugaucugcccgccuuggcaccccaaagugcugggauuacaggcgugagccaccaugccugaccaaaacuuuaugauuuuaaucuuuuuccuuauacugguuaaggaagagagagagaagaaccacuaaaaauauuuccuuuuucagugauuggacuucuguccuugcucaagacugauugauugauucauagcuuggucaauuuauucauugauguacugcucauuuuuuugaccauuugaugcaugccagccaccagggauauaaagaugaauaaguucugauuccaucuuugagaaguuuaugaggucacauaaccagucacugggaaacugggacuugaauucaagugucccucugccugcccagugcuguuuccauuggguggauauuuugugggugugugugaaugacuugucuggcuuugguuggaaauuguagggauaaguccuuucagcaggggaagugguacaucucacauaugaaggaauuaaaccacugcuuugucuuccuaccggggggacacuguagcauccaauguuggagagaagagaaggcagaggacagggugugcuaagugggaaacaaucugagacgaagaggugggugaagucaagcauccuuucccacuguuuuagucuaugauugcugcuguaacagguaaccaugaauuuagugguuuaaaacaacagagguuucuucucuugcaguucuggaagucagaagucugaaaugacucuuuuggggcuaaaaucaagauguuggcaaggcugguuccuuguggaaguuccaggggacacuccauuccuugcuucuuccagcuucugguggcugccggcauuccucguggcugcauuacuguagucucugcuucugugaucacacugucuucuguucugcccuuacaucuuccucuuaggacacuugugauuacauuuaaucacauuuaaucacaaaucaaauagggcccacuugaauaauccaggauaaucuccccaucucaaaauccuuaauuuaauucuaccugcaaagucccuuuuaccuuauaagguaacauucacggguuuuaggaauuaggaccuggauaucuuugcaggccauuacucagcugaccacacccaagaucacaggccuuacugccuccaggcugaggggaguucaucuaagaacaaccuaaagaaaggggaaacacacaagggaacacuuugauguucuaacgucuuuaucuuuuuuaaaauuuuuuuuaaaagacaggaucucacucuauugcccagauuggaguacaguggugagaucacagcucacuucagccuugaauuccugucuuccagcaauccucuuaccucagccucccaaguugcugggauuauaggugugagccacugcaccuggcuucuaacaucuuauuuugucuccguuuuugggcucuccuugauuugcaaaaaguaauuaaugaggcaauagaaaagacuauuuauaaagaaaugguggugaggggauaauggauaauaguacagugaacccucauuuacucaucgccaguuuaagaacuagaacacuaccuuuauuguaugaauauaccauaauguacuuaucaagcaaacuguugaugaauguuuagguuguucuagauuuuucuuuugcacucucucagaaagagcgcugcagugagcauucuuguguguuuccugguauaccuuugcacagguuuuguuaggguuagucuggcugaggcagaggacaguugcaucuucuacuugauaacauaaauuaaguuuccauagaaaagggggccuauccuggggcuuuuuauccugugucauugaucacuuugacugacccugcaccaacaccacacuguuguaauuacguggcgugaugaaaauucuugauguccggcuuggcaagugcuccaccauuuguucuucauaaacuguucuccaaacccguuuucuuucagcagugggugcgauuccauuugcacagugucuuuaccaucacuugauacucucacacuuagaauuuuugccauucugauggguaccaaguguaaucucuuuauggauuuaauuugcauuuucugaacacucaugagacugagcaucuuuucauauguuuauuggccauucauguucucucuucugugaagcgccugcucaagucuugccaguuuuucucuuguccuuaucuuauugauuuguaggaguucuuuaacucuucuggaugcuaaacuucugucauuuauguguuacaaaugucuucucccagucugugauuuauuuuaucauuuuuuauagucuacauugauaaucagaaguucuuaauauuaaugcaauagacagcauuuuuuuuuucguuuauaguuuuugcuuuuuguguccuaggaaaauaaaauugugaaauuauucuuccauauugcuccuagcaguuuucuaguuuuucuguucacauuuaauuucuuacucuaccuugaguugauuuuuauauaugaugugaagcagcagucuaauuuuuuuucuuuuuuucuuuuuucuucacaugaaaagccaguuuuccuggcucuauuuauucaaaaguuuaugcuuucucuucagaccugcagugcccugcccugucauaaagugaguuucuauaaugugcaggccuguuucugggcccuucauucuguaccauugaauaguucgucugccugccacagugccacgcuguguuaguaccagaacuuuaugaaaagucuugaugucuggcguggcaaguuccccaccuuguucuccuuaaagagugccuuagugcagugguccccagccuuuuuggcaccaaggacuaguuucauagaagacaguuuuuccauggauggggguuggggggcaguuuuaggaugaaacuguuccaccucagaucaucaggcauucguuaaauucucauaaggagcugugcaaccuaagucucucacaugcgcaauucacaauaggauucgugcucccaugagaaucuaaugccgcugcugaucugacaggaggcggaguucaggugguaaugcugcugcucaccuccugcugugcagccagguuccuaacagaccacagaccagucuccguccuugucugcagcccagggguugggggcccugccuuagugcuuucuucucccauaauacauguuuagaauuagcuuagaguuauguguuacagcacauacacaaacacacaaaucuguugucauuuuuauuggacuagcauuuaauguacgaaacaauagaauauugauguucuuuauuuauuuuuaauuuuuggagacagagucuggcucuguugccaaggcuggagugcaguggcacaaucauggcacacugcagucuugaccuccugggugcaagagguucuccugcccuggcucagccucccaaguagcugggaccacagguguacgccacugugcuuggcuaauuuuugaauuuuguguagagacauugucucacuguguucucacuauuuugcccaugcuagucuugaacuccugaccuuaagcaauucucccaccucugccuggccucccaggugugaggccuuuuauuuuuuuagagacaacaucucacucuguugcccaggcugaagugcaguggggaaguguacugcagccucagacuccugagcuuaagggauccuucuggucucagccucucgaguaguuaggacuauaggugugcaccaccacgcccagauaauuaaaaaaaaaauugggggccaggugcagugacuaaugccuguaauccuagcacuucgggaggcugaggcagguggauuccuugagcccagaaguuugagaccagccuggacaacaugcugaaaaccugucucuaccaaaauaaauacaaaaauuagccaggcaugguggcacacaccuguggucccaguuacuugggaggcugagccagggcaggagaaucucuugcacccaggaggucaagaguagcuguggucccagcuacucaggaggcugagguugaaagaugcuuaaacucaggaagucaaggcugcagugagcugugauggugccacugcauuccagccugggugacagagcaagacucugucaaaaaaacaaucuuuuauuuuuagagauagguucuaucucuuuugcccaggcuggucuugaacuccuggccucaagcaauccccccaccucggccucccaaagugcugggguuaccaacaugagccaccaugccuggcugauauugauguucuuaauauguuuguugcacuccauguauaugguaucuaccuuuauuuauuugggucuucuuuaaugacuuucaauaaaauuuuauaauuuugcuauaaaugucauacacaucauuuguuagauuuauucccagguauuugauauuuguugaugccaguguauuuaguaucuuaauaaaauuucaucuuccaacuguuggaagaauacaaccuugcuuaccuguagauucuuuuugguuuuccagauaaauagucaugucauuugagaacaguguggcguugugccuuucuggucauuauucuuuuuuauuuccccauuuuacccugguuaggauucccagugcaugaugacuaaaauuggugaggcagacacucuugucuuguuccugacuuaaaaagggaugcuucaacauuuucccauaaaguaucaugcuugcuguaggguuuucagaaauauauuuugucacucucaagugauaguuugcuaagaguuuucauaaugaaugauauuauauuuuaucuaacacuuucauugagacaaugugauuucuuuuuggucuuuagucuaagugguaaauugcauuaauuaauuuuaccauuaaaccaaacuugccuuccuggauaaacccaauuuggucaugaaguuguuuuuucuuuuuucuaguuaaaaugauccuggaggcgauuugcuaauauuuaggauuuuuuuuaagcuauguuugugagugguauuggcuauguuauuuuuguaugguuuugguaucaagauugugcuagccucauaaacuaagcugggggugucucaucuuuuucuguacucugagauaguguguguaauauuggaugucuuucuuaaaugguuaguagaauuugccaguaaacugcucagagccaggggcuuuuucaacaggaagauuuuaaacuacugauucaauguauuuaauaguuauagguuuauuugaucuuuucagaucaauauuauuuuaggacuuaauucauuucuguaauuuuucaaauuuauuuaguuaacaauauugcuucugcacccuauuccuucuccccucuucuucuagcacucucauuagacauguguuagauguuccuacucugucuuucaagucucuucauuuuggccgggugcggugucucacaccuguaaucccagcacuucuuugggaggccaaggugggcagaucaccugaggucaggaguucaagaccagccuggucaacauggcaaaaccccaucucuacaaaauagaaaaauuagccagacuugguggcgggcaccuguaaucccagcuacucaggaggcugaggcaggagaaucgcuugaacccaggaggcggagguugccgugagccgagaucgugccauugcacuccagccugggcaacaagagugaaacuuucucaaaaagucucuucauuucuuauuucugauuuauuuuucugucacugcugcauuaugaauaauugugugcacaucugucuccucagccaugucuaaucagcugcuaaacauauccguugauuuacaauuuuuuaauuauuagauucuagaaauucuauuuaguucuguuucaaaacuggccauauuuuaugaugucuguuccuucuacauauuuuaaauuccuuuuuauuccuuuaaacauauuaaacauauuuauguuauguucggagucugauaauucuagcaucuaaacuauuuuucaggggcaauuuagaucucuuuuuuucugguggcucccaaucaaggugcguuaugugucuuguaauuuuuucuuuucuuucacugugagcuuguauuccuuggaauuucaucuguaggaguucuuuaggccugggucaaaggugaauuccuccagggaagauuugcauuugcuucgguuaggugucuagggacacuaccaauauuggacuacugaaaaguaauuucuugagauuuuaaaauuuugaccacguugguaguguaaauuugggcugcaaacuuaugugaggaugagguuagugguuacaaguuuucaggggaaauacgguuuccucuucaccugcugcuaugacuagagaauggguguuuuuacuuuaaccuuuagugauugcagcaggcuucucucucuucacccuuuuacugauguuguagugcuuuggggucugaauuaguuuccuagugcugcuggcacacagugccacaaacugaguggcuuaaacugacaaaaauuuauucucucacaguucugcagacuagaagucugaaaucaggguguacuaugcuuucucugaaagcuguagagaagaaucuguucccugccuuucucuuaucuucuggagguugucagcaagccucgcccuucuuuggcuuguaaaugcgucacuuuaaucucugccuccauugucacaugcuguucuccugugucugucuuuuuuccucuuuuauaaggacacuagucauauuggauuaggggccacccuaaccuaaugaccucaccuuagcuugguuauaucugcaaagacccuuuucuuuuucuuuucuucuuuuuuuuucguucuuuucuucuuuggcagagucucacucugucgcccaggcuggagugcaguggcagaaccuuggcucacugcaaccauugccuccuagguucaagugauucucaugccucagccucccaaguagcugaaaccagaggugcacaccaccaugcccagcuaauuuuuguauuuuuaguagagacgggguuuugccauguuggccaggcuggucucgaauuccuggccucaagugcuggggguacaggcgugagugagccacucugccccgccaagacccuauuuuuaaguaagaucacauucacaguuauugggguuuaggacuucaacauaucuuuuugagcaacaauuuaaugcauaccaugguccaagcuuuauagaaggaugcccugggucaguuuuacucaaaauguggucuggggaccaucccauuaccucaccuaggaguuuaauagaacuguaaauucucagccucgcccccuccagaccuacugaaugagaauaccugagguuagggcccaggaaucuguguguuaauacacucuccaggcuaucuuaugcaggcugaaguuuaagaagcauugcccucaacuaugucuccugugcgugacacucugucaagcccuguaaugugaaauucagugcuucaguuagcaagcgcccuuaauuuaccuuucuggggcuccgcuuuuacuuugcuuuuggccucuaaagcauuuuacacugauaucgaauaucaauguuuacaaauauuauuuauauugauuacacuuuugauuuuguuuggaaaccuguauaaaaguugaaagaacaguacgaaaaauacuuccauuauucuuaccuuggcacauccgcuccaucuuuuuuuauauaaauacaaacauuucccucuugucuaaccaucugaaaggaggcugcagacaucaugcuaccucaccccaaauacuaaaguauggcgcucaaggacaagauuacucuccuauaccagugguucucaaacuuguuggucucggccgggugcaguggcucacgccuguaaucccagcacuuuggaacgccaaggcaaguggaucaccugaggucaggagaucgagaccagccuggcuaacauggugaaaccccgucucuacuaaaaauacaaaaauuagccgggauugguggcauggaccuguagucccagcuacucgggaggcugaggcagagaauugcuugaacccgggaggcggagguugcagugggccgagaucauaccacugcacuccagccugggugacagagcaagacucuaucucaaaaaaaaaaaaaaaagaaaagaaaagaaaagaaaacuacuuuuuccagaaaaaaagcaaaauaaugucaagaagagaguacuguacauuuuuguaagucuuuuuuguaucaagguuaauuucaauguggaaucugaaaccuuauuaguggugguuggucugucuuacaguuugaguggaucuuuucuguaugauuuuuaacauuaugcauuggucauuuggaaacuugguucaccaaauagaugcagaucuucaaauguugacacauuuuauuguauaauauccaaaauccauaugcauuaauaucacuguugauuucaucagaaacgccuucaaguauugggauacuguuaaguuaaugguaggauaaaaauguccaaaauucuaauuuuugcuuaaaauaucaaaucucaucauugguaacaaauacuauuuguuuuuucugaugagaucaaucauuuuucuagaaaaggauuacaagauacccaggucugaauaaccggaguucaucagucauucaaguaacugguguuccaugaaaaaaagcggauaauucagcacacaacucagugacacaagugcuuuuccucuagacaaucauuauacuuuaguaugcagcagaaacacuguaugagugcuacuuauuucaucacagaaugauaagaacauccauacucaagggucuggauuuaaugaaagugaugauuuuuacuauaucaucuaugacauucuuaaauggaacaggauuuuguuuucccuauuguauuguggugaagaacacaguggugacagguggaguuuggugcuacugccaugauucaugcaaaguacuagcggcaguuuuaccuuucauugguuuugcaccaucagugcaaauucaacacagcgaaaaggcaaaugucuugguaauauuguugaaauuguuuugaccucauggacccucugaagggguuuuagggauccccugaaagguucuugagauccccuaggagucuguagaugauacagagaaucacucacuguucuguacaguaaaaaaccauuaccacccuaagaaauucaacucuaauuccacaccuuuauccagcaugagguccauacucagauuaacccaaauuugucaaaaaaaauccuuuauugguguuuuuuuuuccuguuucuauuuggaugcaauuagaguucacacacugaauuuggcuguuaugucuuuugaccaaccuagaacaguugccccgauuuauugaagaguccgggucggcuguguggagaguguucugcaugugucggacucauccuaaugauuagacccaggucugacaauuguggcaacaccaccacauugaugaggaggugcacccucgaccgccuccugucaggaggucagagugucagacugucucacaauuggugauggcaaacucaaccacuugguaaaagauuuacaauuucuuugaauccagaauuuuuuacuguuuucagugggacaguaagucaggguaucuugucugauacugcccgaaaccauggucuccuuuugauuauuauuauuauuuuuuugagauggaguuucacucuugucccccaggcuggagugcgauggcacgaucucggcccacugcaaccucugccuccuggguucaagugauucuccugcuucagccuccugaguaacuggaauuacaggcaugcaccaccacgcccagcuaguuuuuauauuuuuaguagagauaggguuucaccauguuggccaggcuggucucgaacuccugaccucaggugaucugcccaccucggccucccaaagugcugggauuacaggcaugagccaccacgccuggcccuuuugauuuuuuuuuuuuuuuuuuuuugagacagaguuucguucuuguugccugggcuggagugcaauggcacgaucucggcucacugcaaccucugccugccagguucaagugauucuccuaccucagccucccaaauagcugauauuacaggcacccaccaccacacccggcuaauuuuuuuuuguuuuguauuuuuaguagagaugagguuucaucauguuggcuaggcuggucuugaacuucugaccucaggugauccgucugccucagccucccaaagugcuaggauuacaggcgugaaccaccgcaccuggccccuuuagauuauuuuuuagguuugcagguauaucaguuaaaauucuuuugguuuuagaaaaaguaauacaacugaggcuggcucacacaucuuaaaagucuagaauggugcugauuucaagugaggcuugaucuggcagcucaagauugucaccagagcaucagguuuucuggugucucgucuguacucuuugguuggugccuguuucagauuaagccuggcuccccuggcugcuggcggcuucuaggagccuugaagcccucuuguguguccagcagaaagaaggcaucucucccagagagagagcaucuccuaugggagacaaggaagcuuuuccucugaagucccuagcaagccuuuagcucuccugauuuuggucacauacuugucauugagccacucccuauggcaugggcaugggauguguuugacugaaaccagccaggacccacccuggaucugggaauaagaucaguuguccaagcacauggcacugggauggugacccagagagcaucuggguccucuuaccaauacuaaagccaacuggaccugugggcuauccaaaaccaccaacauccaccaaagaguuuugguauccaugaggguauaaaacacuuuacugaguacccccugugcagcagcuguugugccaugccguucuuuauucacucagcaggugcacucuaucaucuggucuugagugagcuggcacugugagccagaugugggucaccacugagggaaacaacuggaguuuugccucacagcauuucucauguaaggcucuaauaauuuaauuaaugcagcagucguacagguggacauuacuugucucuuccccagaugauaaaauuguaagcuggagcuaggcaggcugugcagguuacccagcaagccaggggcuggagccagacaaacgagagcaccauagugccagcaacacuaucuggccccggacuggaugugacuugggggugucacucagcccuugcugagcugagugaccuuggcuacgggacugugcuucccaggguccuuggagcagggaggggcucacccuccuggcaggcagcuucccugauuguucauaccaucccaucuucuacgucucuaagagucccggcuacucugagcuagauacacccucuuagacccuccagggucucaagggcccugcagggucuuugauguuuauggugaagagcucaugaggacaggagaccaaggaggaaagaggccagagccuuaagaacugccuccaggucgggcacaguggcucaugccuauaauccuagcacuucgggagacggaggugaguggauagcuugaguucaggaguuugagaccaggcugggcaacacagugagaccucaucucuagaaaaaauagaaaaauuagcuggguaugguggcgcaugccuguagucccagcuacucagcaggcugaggugggaagauugauugagcaucugcuuguugggcucaaucaauccucccaccucagccuccugagccaagaucgcgccacugcacuccggccugggcaacagagcaagauccuguuucaaaaaaaaaagaaaaaacugccuccccaaaagcacacuggggaagaagaggaggugaggagugcagaauuggcugguccguuccuguggcuucuaccugcccagaccuaagagaguaccuuuaaggaguggcuggagaggcucuuuuccaucuucuuuuguaacagucuagcccugucgcuaggccuccuguccuagcuggcucaccccagccagccugcucaccccaccugggccugccuuagcucaagagaggcugggauccaaacucugaggucagucugagccagcccagcccugcagugccuuccagggugagacugaggcucagcauguuccuggaggcaacucauccaguuuaaugagacuccagguggggaggugguuucccuauagggcaugggcaaauuucucagcugacagccaggcauccaagcugcugccacugggcuggcagcaggaugagaucagcugugguuguggccuuccuggcaggagguaaggcacuguggggcuuggugaagucacucaggugggagcacugcucccgggagaauuugcagaagcuuccuggguagauagaucauuccagucacugugggucagccuuuucuucccauuagucugcuacuuggcaguuugcaaauggcuucacaucugugguuggauacaaagucacaaacgugguggcuccuggcugaaaucagccugcauguugcuuguuuagcuugugguguuuuaaauuugaaucuacuuaaauagagagauguggcaccaaaauucaaauuuugggcuucucuugaagagucagaagaucuggcacugcaggaugauuccaucagggcagcaucagccaagcugagggguggcugcucccagggccugugcucccugaucugccuagccccaccuggcccaguuacugcaggcugugguggugaccaugucucaucucacaccuggucuuuuccaucacuggccuggcccuugauucuguauuuucaaagcaaacuggggaggugggcauuaguaucucuguuuugccagagaggaaaccgaggcucaaacugguuucaauaugucauguaggaaaguagucauggcccgauucaaucauggcucugccauuuaacagcucugugacacugggugagucacuugcccugucugggucccagccuuuccauucauaaaacaaagagguugagggcuagcuagguagcaaacuucucaguauaagaaacagauggaauccagagaagcugggagaggagaaggaaacaaaggagaggugauggcccaacaacuuagcagaaagacauuuuaaaaggaucucuagccuuaguaacauagcaagaccuugucucuacacaccaaaaaaaaaaaaaagaaaagaaaagaaaaaccagccaggcauggugguacaugccuguagucccagcuacucaggguguagggagccugaggcgggaggaucacuugagcccaggugguugaggcugcagugagcugugauugugccacugcacuccagccugggugacggagcaagacucugucucagaauaaaagaaaauaaaauaauuucugauauucuuuuaauccauuugcuuuucugugauauaaacuugcucugugucccagaauuuuaagcaaaauuggcuguucacacuaaaaaagaaaaaaaaagcagaagaagaaggaugguagcuaaaugcucucugggguucccgucugaacugaugucugucacucugaguagucauuggcagugugcugcuaggugccagaggaacacaggaucugugccuugauucccagaccuaaaggcaaaacuuagauccauuuaccauaauaaaaauaaguauguuuguugacacauaauuuacaaguaugcuuuaugucagauguugcauugaaagucugcauacauuauuucucuuaacccugacuguagccccaugggguagguacuauuauuuccauuuuacagauaagcaaucagagguuuagaaaggguaaggaauuugcccagcucuuuuuucuuuuuuuggagacagggucucacuuugucauccaggcuggagugcaguggcaugaucagcacucacugcagccucaaacuccuguuguucaguucuuaaacauuacauauuagagccgugaagcaaauucaaaucugucugauuuuacagcucuuguguugucuuugccuaaguguugcugcagccccaucuccaugaauggaucauuuauagugcagggcaaugagauuaggguccagugcuucugcaagcaggaagaaucguugaaacgcagaagugcugugggcuggacuggcugguccagggagggugcauggaaggggaguaaauggucuuccaaacacaguuuggauucccuucugcagccaguaugaaguuaugugugauggugagauugugccacuugaaggaccagacuggccugaaaauuagugucaucuuaggaguucaggugguaaagguagauguugaggucaaaauacagaacuuugcuuucaggcaggggugagcuggugaggguuugucaggaggagugaugugaaagcagugugucugugucaaguuggaagcaacaagggcugaacccgagucuuggcggugagaaugaaaagagagggcugcauuggcaaaucaguagaaugggaacaaucggcaggacuugaaccacacaugugcaaaucagaaggaauuuuagaagucaucuaguuccgucuugucccagcacagggacuccuccauuggugaccucugugauagcugugcaucaagucacugccagugcaggaugguagaacgggaucuuacauggcagguagcuucuaaggccagcacauaggggugacagauacucagugucuacauuggguugaauaaugucucuccaaaauucauguccaccuggaaccuuagaaugugaccuuauuuggaaauagagucuuugcaaauguaaucaaguugggaugaguucauacuggauuaggguuagucccaauccagugauugguauccuuauaaaaagaaaaucuggacacagauugagacaugcagaauacugugugacaauugagccagauuggagugaugcccguccaggccgaggaacuccagggauugacagcagcugugagaaccuaggaaaaggcaaggaaaauccuccccuagauccuccagagggaacguggcccucaugauacuuugauuuuagacuucuagacugcagaaugaugagagaaacaauuucuguuguuuuaagcuaggaaauuuaugguacuuuguuacugcagcccuaggaaacuaaugcaguguccacuaccuuuaaaaacccaucggccccugcuggccccccuguugcaggaggaaauaagggcagccuggcaccaugcgggcagaaccuggcaggacuggugcaggcucccgguauuuuucucuuuccuuucuagugcucacaauuauuuuaauaauuccaucuagaaguuugcauugguguucagucaccccauaauuuaguccuaggggaacuucaguuccuaugacuauuccugauuuccgugaauuggcuugaaucaucacuacccucuccagagugccaucucuccucccucccuuagcuguaucuaucuacuuuuucuucccuagacccuucuagacugaaguagauucuuuguucugccaccucaaagcacacacugcuagcaccaauuauuggacaaugaccuacauagcuguccagagguaucauguguguuuuuguauuucuuaacucauagauuuguuucuuuuaacuucaccaguguuuaugucuugccucuuaaguuuauaucauaguccuuugaaggcacacagccugucuuuugcuuccuuuuauccucuauacaccguacauuguuauuacuacacauacacacacacacauacacagagagagagagagagagagaaaggggaggagagagaaguaaugauggaggauaauuuuccucaucuaggaaagauuagaaagguugaagguugacuugaaggagaaucuugaucuuuaggguggaaagcaugcucuggccccuagaaggugaugauaugucuauauacaguuaugcauugcuuaauaauagggguauguucugagaacugugucacuagaugauuuuuucauugugugaacaucauagaguguacuuacacaaaccuaggugguaccgccugcuacccaucuaggcuacaugguauggccuauugcuccuaggcugcaaaccugcacagcaugcuacuauacugaauacuguaggcaguuguaacacagugguauuuguguaucuaaacauagaagacauacaguaaaaaugcaguauuauaauuauggggccacuguuguaugugccguccauuguugaaacaucauuaugcucugagcaaguccagccucauuugucuguaaaaggacaacagagccauugagcaucaugcaugugcccaguucugugauggaccauggggaggcgaugcugaauaagacagacaugacccuuauccagugcuuaguuuuguggggaaaacgggaaguaacuacuucuugaccugauucccuguggcuuuucauuaugguggcaagguacagacaugcuuggugaucaugguaggcccccggcagccuuguuugugcugcacgaccugcccucuccacuuggcuauggcugguuggaucacacauggacaccugacccaagcugagccaauuauauuuucccccuccuggaaacacagacguuagauucagaggcagccaauugcccccccaaauucguauuuugaaguucugauucccaaugugaugguauuuggagaugcggccuuugggagauaguuaaguuuagaugggaucaugaggguagggcuuuuaugaugggauuaguauccuuagaggaagagacacuagagagcuuuccugccucucuuuucccaccaugugaggacacagccaaaagcuggcugucugcaagcuaggaagagagcccucaccagaaccugaccaugcuggcacccgaucacagaccuccagcuuccagugcugugggaaaauggauuucuguuguuuaagccaucccgucuguaguguuuuuuguuauggcagccugagcugacgaauucaagaggcaggagcuguaaagaguaagagucaagaggugugaaggccguguuuggccguguggauugaagagcaguuuacaugaagagcacguguguugugauuucuuucaaaguuggucuucaggucucuccugagaguggcuguaagccaagauagccuugaccagggggaaguuagguuugggucugccagucaggugaaauacagugaggaggugaaaccaaaaugugugaaagagaagacauuuauuacuuacagguccagagagguuaggggugcugacgggaggccgaggggaaguuuggaaguggcagggagcucacccagggagugacaggagcgggcuggagagagagaaauguaauucccccacagcgagggguauuuuuaacuaggccaaaggugacagagugcuacuguguuucagauaacucaugucaggccuaaagguggaugccaaggcagcaccuauauuaaacaaauucaugacagugugggaggugggucagcagaggaggaggagugauggagacacuggagaaugccgagguggcagacacauggccuggccuuccaggacucuccagucccuaguucuagacuguuacaaggcccagcugccuugggguuuguaugcuaaacccucccugcacccguguccuccccacaaauucucuuuacugcuuaugccaguuugaguccauuucuguuacuuauaaccaaaagaaccucuaccaagacacuucccacuuuacaagugaggaacagaagagcagagaggcugagugacugcccaggguccacuggugagugacagcgcucaagccucacuccagcucuucagaccaguucccugcuguacaugcccuuccaguugucacggcaagcuccuuagggaagcagacccagggcgguucugaaaccacaaggagaaauccuaguuguuacuccucuaccacucccucuguugcccaggcuggagugcaguggugcaaccucagcucacugcaaccuucgccugccaugcucaagcgaucgucccaccucagccuccugaauagcugagacugcugggacuacaggcgugcacuaccacgcccagcuaauuuuuuuuuguauuuuuaguagaaauggaguuucaccauguugccuagucugggcaucaaccuuuuaaaacauggucuguguucugucauauuaaaagugccauucacacaucaaauaugcuugcccccuuuuuucuguaaugcugucaaauggaauagcucagccuuuaccacuugcauuauugccuuuggaucuugcaucuaagagauucuuagcagugugcacuggcugauggccaggaucuucccaugccuccgugaguucuuugcauuuaucuuccuuuuguucuagugaucugacccauauuuauaucucaaggacaggugauuuucucugagcuguaugauagggaaugccugacaaccccuguuuaguuucuauauuuauuuuaagacauguuuuuuaaaugagccaauuaauuggaaaauauuuauauggaaaggaaauguuaucacucuuuccaucauccuaccacaacugccaauaacauuguagagaaucuuucuucuaguuuucuauuugucaacuuaauuuguaaaaauauauuauuguaauuauacauauuaagaauuuuguauuucacuucucuugguaacguaauagaaagucuucuguuucaaacauuuuguaaauagcauuuuuuucuuuucuugucuuuuuuuuuuugagacggagucuugcucuguagcccagaccuggagugcaguggcgccaucacggcucauggcagccucaaccuccugcaaagcugggacuacagacaugugccaccacgcccagcugauuuuuacauuuuuuguagagacagggucucacucuugcccaggcgggucucaaacguuugggcucaagugauccuccugucuuggccucccaaaguauugggauuagaggcaugagccacugcacccagcccuaaauaucauucuuaauggcuguauccauucuaguaaguugaacacaauuuacuuaaguguaucauaaauccuuuugggcacaaauggacaauaaauaaauaaaggaaauguaagagccaugccucuauuuguuagacauuuagguuguuucugauuuugugugugugacuauagguaaugguauggucuacucauuuguuuuuuggggucuuuuccuuaugcuagauuccauaaaguagaacauggauaaauaggugugacuuuuuuuuuuuuuuuugacacaguauugcuguguugcccaggcuggaguacaauggcgugaucucggcucacugcaaccuccaccucccagguucaagcgauucuccugccucagcacccgaguagcugggacuacaggcggucaccaccaugcccggcuaauuuuuauauuuuuaguaaagaugggguuucaccauguugaccaggcuggucucgaacuccugaucucaggugauccgcccaccucagccucccaaagugcugggauuccaggcaugagccacugugccuggccagguguggcuuuucaaaaggguuuuuuuuuuuuucuuuuggcucccaacaggaaacuaucaaaggacuuuugguacaugccaucauguugcuuuucacacagaguacugauuuauucccccuaccauggggaccagcagugugaggccuguaagaaucucugcccuggccucugaauaaguaauguguaagaguaaauacauguguucuauuagggucuuugagaucuguuaggagaacuacuaccaaacaccaauuuguagaucagauaacgcucaucagaggacagggaaaugcauuuuguucuuucauuugauaagguuacaguaacugcuuguccccagccucuggaaaaauguugcuuauugcaguacuguagauaguuuuacauaaaauccuuccauugucuuuguguuuuuuucugauggaugaguaaagacuagguaacaguuugagcaaacugggaguauuuuauuauuaucauacuuuuucaagaaaagggugggauggagagcuagauuaucuugacucaaauauuuuuguguauucuguguuuugggaagaggagccuuuguguuuuuaggcuagggugguggagaaggucucacagaagagagaccugauuugggauuucagaaggguuaagagagaaugaggacacagcaugaacauacugaagacuggguuagaauuuaugugguauguugguuuuggcuggaucagcagguaugggcuggauugcaagauguuggaaagucaagccccggaaucuggaaaaaauuuaauaguccauauggugucauucaaaggugauggggagggagggaaugaaaugguacagccacuuaaaaaaaaguuuggcaguuuuaaaauuagguuaaauauauacuuauccucuuucauagcaaaaugaaaacauauguccacauaagacuuuacuccaauauucuuagcagccuuuuucguaauagccaaagguuacgagcaggcgaguggcccgaggagaacuguaccucaggcagaggaaucuggcagugaggcgcuaggugagccaaaaugggaggaaagcugguuagaaguuucucgaguccuccgggcaugcaaugaggagggcuggaguugugagaguaauaaggaagggcugaggagaaaaguuccuacagaggaaaaguccaaagccuggagccugcuggcugcaggugccaagggagggaaggaagaggcaaaucugaguggcagauggugguacagagggcaggggucuucagugggggaccaggggcacuugguagaagggcagauguucaggccccaccucagaccugcugaaucagacauuuugggggugggccuggcaaucuguguuuuaacaagcccaccuggugauuuucaugccucucaaguuugagagcuccuggaauagggaaauuggcuuaaggcaaggauaugugauccaagaggaaaucucccacaggcuguuagagacaggagagcagcugggcugauguggaugcugagcuugcucagcuggugcagaccagagugcaggggcuugcccugagggaggaaacggguacacagaaaggcagagggcuggggccaaacuuggggaugucucagggagauuccuuuggaugcaaguaacagaagccugcuucacaccagcuugagcaagcgaggacauuuaugggaaggauacuggcccagcuccuggacuguuaagacuagagggaccaucugggccucaugagggcgcagaacccacacagcuucugugucugucugucucucucuccuuucccccuuuuaauucauuuaaccaauaucuguauaucuguugaacaucuaacaagguaccucgucuagguaccaaugguaagcuuaaaaaaaaaaaaugaagacuugacuuugcccauagagccugucugccugucugucuuagcaugaagugucucugcuucugucuguuucaaucuucucucuggagacauccgucucucuucuggugagcauuuggccagauguggccaccccauagcugcuuaaguuuacagucuuuguuuuaaguaaccugcagacaucucagccaugauucuauauuccuggggaaaaaaaucugagagcauuuugggcccaacuuuggucacaucaccucuagcuggagacagaguccuguggugggugcccaggggugggggugaagguggguggucuuuauaacagagggauugggcagcauagcuaugccaaacagguuguguuucaggggcauuguuuucauccuugauguaagcuggagcagggagauggucuuuguuugcuuaacuucuuaacaagcacuccagcaaugauagcggcuuugggaggggaaugcggguuugugucugcuaaaugaaaauuagaagggaggagcuuguggaugcaaaggauugaagcauugcuuuuuucuuuuaggggguagguagauaagcuuuaaagucccccucccacccugagagucugcgauuggaaauaaaacaacagaguucgggcagcugaaccugaaggaagggaauugugguggcauccguagucuuuccccuuauccagaguagacucaucuuuuaucuaguuacugcugugacaaauuuggauacauucaucuuucuucacugugaaaucgagggcuugguugcuaaugguuuuacagaaauuguuccuuuguuuugcuggaauauugaugaguccugggagaccauaagagcaccugugcgaauggcucuucacccaccuuccuuagaggggaucuucaacucucugguucccuucacagccuggguuguaaacugcuuuuguaaccucugugcuguaccuucaccacucguacauucauucaaucauuccuauuuacuacauaucuaccaagugucgcacccugugcuaguaggucggcuucauauuuucagucaccagccuagccaccuuccucuucaguuuuuccuccucuucucacccuuuggauggaugcugucagaugugcucugggggugauuccuccccucagccuagcuucugccugacccagcugcacugagccauuuguagcugcaaacccaccaugcucucucauguuucugggguuuauucaugcuguucuccccuccugaaaugccuccccuacccuaccuucuuccagaaccuaccaaaucccugcucaccuuucaagaucugcuggaacaucuccugcccuuagaaguugcugauuuggaaguccagccuuaggccugguguggggcucacaccuguaacacuagcacuuugggaggccaaggcaggaggaucacuuuagcccaggaguuugagaccagccugggaaacauagcaagaccccaucucuauacaauuuuuuuuuuuaauuagccaggcagccaggcgugguggcucaugucuguaaucacaaaacuuugggaggcugaauugggaggaucacuugaggccaggaauuugagaccagcuuggccaacauggugaaacccugucucuacuaaaaauacaaaaaaaauuagccaggcuggugaugcaggccuguagucugagcugcuuaggagccugaggcacgagaaucacuugaaccugggaggcggagcuugcagugagccgagaucaugccacugcacuccagccugggcaacagagcgagacucuguccaaaaaaaaaaaaaaaaaaaaaaacaauuagccgggcaucgugguguacuccuguaguccuagcuacucaggaggcugaggucagaggaucacgugagccuaggaauucgaagguacagugagcuaagaaggugccacugcacugcagccugggugacagagcaagaccccauuucuaaaaaauaaaaauauuuuuuuaaaaagcaauucagcuucagccuucagagcauucauuaugggugugaugaucugcucgaguggaccguagcuacacuugaacucagugagaugcaggacugucccacucaucuuuguaucaugacaguacaaaggaucugucauggaugaagggucaaaugcuacuguggucaauaggauggggaagaaaaggaaaggauaaagaagaaaauaaaaauuacucauaauuccauuaccuggagauacauuuuggagggguccuuaagacuuuuugaauacaaaaaguuuaugauugaaguuacuguguaucuugcauuuccacuuaacauuaauauauuaauacuuuauugcccacaagaguccuaagauaagauuuuagugaccuuuuaauguuuuauagccaauucuuucuuuauuguuggauguuuauaucauuuucagcuuuggacauaagaacaccauggaacauauuuauguguuaaucuuuguuugccucugaugauuucuuuuggauagauucccagaagugcaauuacuggaucagaggauagcaacacuguuaagguuugagaaauaaugccaaauugucuccccagacugugccagucucuacucucauccucaguuuuugauggauggguuugugaauucuuuaaagagauagaagcaaaaaaccgaagcaccaauggcuucauuggcuguuguuuccauuuggaggaaacggcagcuuuucuugugauaggagccagguuguagagaaaaaccugucccauugcagcccuagaggcugggagguuggcccucagugacaagggcccguguucucagccucccuguccuuuuccaggcuggagucugggacccgggagccuccugaagagacugcacagcuuucuggaauaggggagggaaggaagcugcuuggugaccuuugggcacaagcugcaggcagcacuccauuagcugcacauccauuaaugaggaagucaagcuucaggaagcugggcuggcuuuauaaagccuauggggaauuaaaggaaaagggaguguggaugaagcauuuguugcugucaugguggggggaggucaugacugggcauucaucugcauggggccuccuggccaguuaaucccagcagcaaauguggguuuuaagagguuagucaucugccuacagggaauuggaccugccugggaaccaaacuugcagccucuuggacaggugcaucuguugaaguguuaaguauacucucgcuuauuuuugcugacuucgacauuuauggaauugaugcaacuuagaggacacuuugaaaaauaaagugagcccuaaucaaguuguuauuuuccaacugaucauauguggugaggaugcucucucauaaaugauauuuuaaaauugacauuacauugucauuuaguaaauuuugaaaaugaaugaaagaguuuaauauaaacaugacgagagauaggaaacuaguauuucugguauugucacgcuggucucuugaaaacucuuguuucauuuaauccucaaaauaggaauuguuguuaguuauuuuuauagaugaggggacugaaucuuagagaaguucaguaacuuaaucaaagucauaaagcuaauacgugguagaaaugagaugagaaucuaugucugacugcaaagcccaugcccugcccgguaugcagggaguuguuuugccccugacccuggcaggaacuggaaggaagaccuugcaagcuggcugccauuaucugcuccuagggaagugggggcuguaugcccauggaaaagccugcugugguuuccgcuggugcugugaucagcucugagaagcacuuagagcccgcuccaaggagcuucaaagagaaugcggaugaaggaguuggacagcucccagcuucucuggucucacaucuucacugugggugcuuguauuuaguuggugugaugugacuuuuuacgcaaacauacacguuugguggucaccucauucacaucuggauacugcuuaauuggauucuuggcucugacagcuucugaauuggauccucaccuuuuggugccagcgcaaccuggguuugucagugguacccagaggcgugaagggcuuuguacacagagaugcaugauuuuucaucagaggggacuuggccagccccaguggaugcaaguucaagauggagagaaggcuaaggggacccaaguuuuagggcauccauugucagagguuuugagggcuguaucugagucaaguccucuuuaagcuuuuuugguuuugguuacaugaaccaagauagauaaaaccaacuggccuuagcaugagccaaaacaacaacucuuuauuguaaagaggcagggaguugcagcugagucaugcggcccugggaccuggaaggcaguugggaagccuucccugggcccuggucucacuuaucuguuucuuuggccacaucugcucgacucucucugugugucugguacucucucugacucucucucacccuagacuucuacuuuucauguguauauggccaagcacggccaugcacaguugcaguccccacucuugaguuuauauuccuuuaguucaaguauccagcaggaauuacucaaguuucucaguaccaaugccaauuccugugagacagaaccugacuguugagggccuggaagcguugugugguaugaaacuggcuucuggggcccauccuaguggaugagaggcacaguucucagcgcagaggaaggagggcaggaccugucgaugggaaauagagagaguggaccgauuuggcuaaagaggcagaauuuggacuggaccaaggagugaaaucccagguaacaaauuuuaagucaguaaaacaaagagcuccuuaggguggcccaagcuggaccagccugcgugggaugauagcaaguuccuguaugugcagagguucaaacaguccagaacagcauucuaaagcagauccaagcaucugcugggguggacaagauggcucucaugguccccccuggccaugucagucuggcccugggcugcugccucugcugcagauauuuuccuuggauucuccacucacagaaggaagauuggaggguauuuuacugguguacuuguauuagagggccauauucagucuaccaguauuuuaacuacuguuguugcuggguguuggauuguggaugauuuugauuuuuguuuuauuuuuuacauauuuuaaaauuuuucuacaaucaacauagaugaguugugcuuauguuaacaguaagaaguuaaaccauaguuuauuaguagccaauaacuacuuuauuaguagccaauaaauaguagccaauauuaauugcuacucuagaugguguuguggcuuguauaagaugaacgcaguauuguccuugcucuuaaggaacuuguagccuaaugaggaagguaugauauaaccacauaaugcaagcuggaagaaggcuaguuaagugcuaauagaacauuaccaaguguguagaaggcacacauauaacccuuguucuaaggagcucaggaaaagguuuuauaaaaagaauagcccuggaucuaggcauagaacagugguucucaagcaggggcuguuuugcucugagaggacauucgguggugucuggagauguuuuugguugccacacuuggaguggggucaucuaauaguuaaagcccagggauaaugcugaggacagccccucacaacaaagaauugucuggccccaaaugucaguagugccaaggcuucuaguccaaugcauuagaagaaugcauaggauuuuggcagacagaguugggggcagagcacugcaggccaagagaaugaugacugagcacaguggcagaaaugcaugaguagacaggaauuagcagagggcccaaggagcuggugggacaccugcagcuagguggcagaggcccuugauaucaacauaagcagcuuggacguuuuucuuugggcaguagggaacaaugguaucuuuugagcucuaucaagaauagagucaguucuuaacaucccagcuuugcuucauugauugcucaucugcacagccacaaagaugaaaacacacccguuuuccuguuuuucuccccagccuauccacucuuuguuuuccaccauccagaggaaagcucggucagcacucugccuugcugacccaggauucccaucugcuggugacaaagggauacagcaaaaagcgauccccuuuugaccauucuccuuccugcugcaauuuccaggaauguaccauggcaagggugacuguccaugacuauucugcuggccccauaacagcuuugcucugcgcaccguuguuugaguguuuacuaacauccucacacuaucucuggaugcaggguggaggguagagggcccaguucaugcucaaagcguccacacgguagaaacagcccagcagaggccagggcuggaccuggguccgacugcaggcauggggauaaacaaugcuugagcuguggaggggagggcaccccagaacucgacacggugcucucuucauguguucacuccugccucaccagcaauagaacaguguuacacacccauacugguaggcacuaggugaauguuuucugaaugaaagaaugaagagacagauccagggagcgggugugauggccuaagauuacccagccuguugggaucagagcugaaccuggaaccaggauuccugacccccaguugggagcccaucccugugccacaucugcccuuccaugcccagggaccuggugcuaucauccuggguccuggccaggcaccuuuagccagcacccuguucuccaaacuucucccauuccuugaauuccaccauuccccaaaccaaccaauccaucaacccagggaaacagccuagcaugcccuucccuaccugcugccaguggccacagagcuguuaaacuacucuacacuaaaauguuggagacugcuaguuaguuacugugguuauccacuucccccaggaugucucugacgaugccucaacucaggcauuucuuaauggaccaguuggggugggaaguggggcaugcgacccuauauggugcugaaguuuuugccaaauuauacuauuuauaguaaggccuucuuggcucaaacacaucuagggaaagggaacagugugaacuugucaguuguuuucucuuuuuauuuugagagggacccaggcuggaccuuaggcauccucugagaucccccagagucuucugggaagaggcauuucccucacacccagaaccagugaaugaggagguagguugcuuuuaugauuccacugagacagugacgcuccuccccauggcuucagaaaacauccaccuuggaaaaguaaguguucucuuccucccuccaacccccggggagaaucucucuugcagguaguggcuguucuuggucucccagcuagguggcaucccugcaucuuuuagguaccagggcuuguaccaacuccaccccaggacuggguaaaugacucccaugauggcuccuaugucagcccuuccaguggugggacaccauaguccaugguccucuggucagagcuucccuuguaggaaaagcauuuuugcaagucugugcagcauuuccauuuucaaguaucauaacguauauuaucccauuugacaccacauuuugcagaggagauaaaacaagugaggcuucugggcucuuguccaugaacccaugucuaguaagugguauagcaaagaccagcaccaagguccccaagcuccaagcucuccuggguggucccuccuuccauggugcagcuuggaguggcuucacagccaggcagaacaggggccacacccucgucacaagugcuggccagcucucugggcaggggaagccucuggauguugaguauggaaggagaccaugugggugguugguagcacagugccugccuggaguaggcccucagcaaggggcucugggucugcaugccugacgugcacaacguggcacauguucuggugggagaugcugagggaggggguagauccacgacauggagggagcaacacggucccucgcuguuuugauuguuuucagcagaacccaaguuguguuacaauuugcaugaggcuuguuaaaugaacugauguauuagacaaucuaauuuuuuuucuuuuuugagacggaguuucacucuuguugcacaggcuggagugcaguggcgugaucucaucucacugcaaccuccaccuccccaguucaagcaauucucuugccucagccuccugaguagcugggauuacaggugccugccaucacuccuggcuaauuuuuguauuuuuaguaaagacaggguuuugccacauuggccaggcugguuucaaacuccugaccucaggugauccgccugccucagccucccaaagugcugggauuacaggcaugagccacuaugcccggccuuagacaauccaauuuuaaaccaguccucaugaugacuuaaaaguauuuccucagcaaagccaaggacuugugguaauacaaauacaugugaucaaaauauuuuacuaauuuugugcgaucaaagaaguuggagcauccaugguuuaguaccuaagcuuugaaaucucacauucuaguucuggcucugcuacaaacuuggugugugaccuuaguccaacuauuuaacuucucugauccacauuuccagucugugaaacggaaauuauaaucaugucuacuucguagaguuuuuguaugugcaaauggauauaaacugcuaaaagcuguguacagagcgugcauuguauuguaaccagugcuaauuacugaggagugcuauacugguaacuuuuuuuccccaaagugugaagcuuuccuuuuuagucuugauuccuggauaauaggacauucuucacuuggacuuucccuuauggucaccuaugauuguggccauuugaggcucauaaauggaaagaauguauauuguuuucauucugaagcaaauaaaacuucuuacauuuccaugcucagagcuaccucuuucuguuauugucuuggaauuuuuuucuccuuagugaccuaguuuuaucuauucucuucagaucugcaaaagcaaauggcacaguuguuaaagaggaauucucauucugugguaguugagagaaauaucuuuauuuucuaaacaaagcagcugugggcugggcgcgguggcucacgccuguaauccuagcaccuugggaggccaaggcgggcggaucacgaggucaggagaucgagaccauccuggcuaacacggugaaaccccgucucuacuaaaaacacaaaaaauuagcugggcgugguggugggcgccuguagucccagcuacucgggaggcugaggcaggugaauugcuugaauccgggaggcggagcuugcagaggcggagcuugcagugaguggagaucacaccgaagcacuccagccugggugacagagcaagacuccgucucaaaacaaaaacaaaacacaaagcagcuguuuguuauauuuuaacuuuuuaacuauugugcaguauuccaccauacuuuuuagagcauuaccgaggauugcccuucaaagcaucaaacauaaaaaauuguuauccaaaggaggaccucaccuuccuuacacagggucuguauugcacaugguggccagggcccuuggagcugugcagccagcaguggcucuccuaagucaucugcagggcaggugugcgagagguacauacgguggguucccgccccagucucucugcuuccuucuuccccagguuggccaacucgggagcaagguccagaacuuccagccagaagcgcacuuuagcagcugcgagcugcauuuguucccugauuguccugacucacucauaauuaagacacgugcugaaaauucucucagaauuuaaauuuugcucauugaaguaaagcugcuguuuuccagcuugcuuuuuuucuuuucuuuucuuuuuuuuuaaaauagguuuuguguucuaaucagggugccaugcuggaccugagccaaacauccuuuguuucacacaauccuuguucuucugugggcaggugggacauagucccacccuccccuucuagugagguaacaaccgugcuuuuguuagcaguucugagcccuucugcugccagacaaacccaguggccuggaaucaugguaauuucuuaugagccacacaauuauuuauaaccaagccaucucagauccuuucuggaacaaguuagaaaccuaucuaucuaucuaucuaucuaucuaucuaucuaucuaucuaucuaaaauauaaaucucagaaacauuuuaauaguguaacuucuuaauagaacauaauauacagcaauguuuuuuccucuacaaccagaaccaguaaaaaauauauuuacuugcauuacuuguuaauuuucacucaucuuaaaugucauuacaauggauugaauaaauugagauguuugaaaauuuuaguaaauuuuacaaaauagcauugucgcaucaaacagauauaaauugaaagauuauauauucuguuuucuuauaacuuuuuuagaaguaaucuuuuauggauuaaaugaacuaaugaccuauacuaaguaaauucuguuuuuauaaaauuuuuaacuauggaugauuuugaacaaauauucaugcagauauuuuuuugguuccuaaaugucaugaauuuauuuuauuuuaauugugauaaaagcacaugacauaaaauuuaccaucuuaaccauuuuuaaauguacagucaguaguguauauuuauugcacauuguuguacaaccaaucuccagaagcuuccaucuugcaaaacugaaaauuauaacuccacacccauuaucaacucccuauauccccccagccuguggcaaccaccauucuacuuucuauuuuuaugaguuuuacuuaucuaguuaaggaguugaguuaucuagaguaguccacuuauaaauguaaucacucaguauuugccuuuuugugauuggcccauuuaacuuagcauaauauacucauaguucauccaucuuagcaagugucagcguuuucuuccuuugaaaggaugaauaauauucauuauuuauucaucuguugauggucacuuggauugcuuccaucuuuuggcuauugugaguaaugcugccaugaacauggguaugcaaauaucuuuuugagacauaaccauucuacucuguuaacuuggcugauuuuaacagauggggaaaucaguaacuaaacguauaagaccagccucacuuggcaguguuuguucacauggugucauaggacuauaaacagaagcgaugcagccucaguacagcugagugagggggcuggaaaaaccugaacuuuccuguauaauuugaauucaaaucuugauuuuccugauuaaauuuucuguauaaauuccuaauaauuugcacacagugaaauucacccuuuuuacuguauaguuuugugagcuuugacaagugcauacagucauguaaucacaaccacaguguaaauauagaacagguucauugccuccaaaacuuccuccaugccccuuuguagucaucaucuucuucuaccccacugccagccucuggcagcucaucuguuuucuaucuccguaguuuugcccaucaucauuugucuuuccuuccauacuuagcacacgcagcuuugccugccaccuuucuuguucugauacaccuggcaccccggccauguugugacuucccugaagauaaaaccucugacuuugagguaucaaguuggauuagaagagcagaguuugaagccagauagagcauuugaauccagcucauucaguuagcagcucugugaccuuguguuggccucagaaucugacacagaguagggacugaauaaaugucuguuggaugaacgaacaaacaaaugaaugaaugaaugaaugaaugaaugaauuuaaccucuuaaugucccaggucccuccuguguaagagggaauggauaguaguugccucaccugacuucuguggggaucagugccuuguacagugccuggugggcauuaguaaagguuuguccuguucccauggccuuccccagggcuuuugauacccucugccagaccgacacaugcacucaaaguuggcugggcccuggcagaggacaucaguaccugcugugugagagcgaggagggcaccagcugagcagacaaguccccagaaaaccccacagauacccgcugaccaccugccagucaaucucaaagagcuccucacucuuuccccccaccccuuuuucauggugcacauaggaaggcccagcaguccuuuucucagccuaaauauauaccauguagggggcuuuagaugaagcccaccagaaggagaaaaccauaacccuucagcacagaacccucuggcugggggucaggucucuggcucugaggucuggggaggggagcauaagcugggaaauaggcaaccacaggacagucauuguaagugaaucuucucucuucuucaaaacagacucagcaggacucaucacaauuauugugaugacaauaaccaguuauuuguauaauuaucugcuugcugccugccuuuccuaucagauggcccagggcacacaguaggugcucagcacauauuuaaugauugaaugaaaaacauuuugugguuaaaagaauuggcauuugcaguuacuguuucuguagaagggaggggaacugauauuugucauucaucuagagugucucugguaaguuaaauuuguaccuacagucuccucauuuaaucugcauaguggcuguugaaaguagguguuuuuggucucuguacucaaggaaacugguucagaguaguuaagaagcaugcuugccacuccacagcuagucaggguuggagcuggauucaaacucaggucugaagucaaagcccagccucuuucuaccacacacaauaaagcuggguugcuuaagaauaggaaucucuacaauuaagacuuaaaaacaaacaaaaacaacagauuuaggcagacauuugugguugagggauuuguguggauuggauuguggaguggaacaguaucaauuggaaauuuacagaauguuuguuccugcuugcaucagacuuuucuguuuugugcuuuccuaaguuggguuugggagcauaaaaauccaacuuaaaaugggauuuuugcagcacacauuacagacagcuuuaaauaaguaaugcaacugccucuucaugcuaagaaaggcaguauggaacggggaauggccagggacguggagacaggaggccuggguuugcgucuuguuggauaggagaagggcuuuggaauaucccucaacuacucugaggcucaguuuuuuuuauuuguaaacugggaaaguaaucccauugucucggagggguacagugcagaucagaugaggaaauaagcaaaugagauguuugugagguggguuacccaaggaagaguuguguauguguucacucucucaaaucugcagagaggagcagggucugaagccaacugggaaaggaaagacuacagagaggcuggcagaaucacaugccaaggugaaaaagaagaacaugucucguuucuguuuucccaagaucagcucaggucgggagagaaccucguuuaugugaacaguuuaugugcuugaaacccuaaaauuauacugucaccuguugucaguaaaucuauaauucagggccagaguggaauuucauuaggcaacgaagcaggcagcagucuuccucccacucuccuacuccucauucauucauucagagaccagcugcagacucucagccauguacugcagagucaggaaggcagugugucauagcagugaggagaugggcaguggaguuagacauguguuugacuuuggccuccuccccuaauugugagacucaauuauuuauuuucacuaaaccuguuuucucauuauuaugaggaaaaugauaauaccugucucacaugaagguuaaaagugagcacucaaaaauaaauggcuuauaagucacaauaauacagucuuuagggaaccaaaaugcauagugggccaguucugcuguuuuccuauuuucucccuccagccuguuagaaagucacugugaguaagcagaagcccagggguugggacccauggcaaccaaagcccaagugguuugcugugcuaugggaaccugagcugugugcucagacggaggaucucuuuucccagauuaagcuucuagagaaccaucgugagugacgauguucccuggggcaguaugguaaaggucagaguuucucaagcacuuagaucccaggcccacagcguaucugagacaguccuuucagggcuagaggaucagugggucuuggagauggauuaugguuuugggaaggcuuguuuugccacacauggaccuucugacaucaggaagguacugauugucucagagcuuggaggcugaugcucaggucaacuugauccacuuuuggagagccacgacacaccucacuugugagugugaauuccucugaaugcuuugguuuuuuuaaaggucagguguauaguggugaaauugguaaaauucacucuuuuuaguguggguuuuaauucugaguuugggcaaacuuauacaguuguguaaacagcacuacagucagguaugcagcagcuccaucccuccccaaaauuccuucacauucuuggagucaaccucccaccuccccaucuaacccuggcaacgacuuaucugguuuuucucccuguaaacuucccuuuuucagaagaguguauaccagccuggccaacauagugaauccccgucuccacuaaaaauacaaaaaucagcugggcgugguggugcacgccuguaaucccagcuacucaggagacugaggcaggaaaauagcuugaacccaggagauggagguugcagugagcugagauugugccgcugcacuccagccugggugacagagugagacuccaucucaaaaaacaaaaaaagaaagaaagagcauauaaauggagucauuaacacaugucacccuuugaguuugcugcuuucacucaccauaaugcauuugagacuccaaaugcuuuugaccacagaaagguuagugguucugagagcagccuggaaagucaguagcauuccuauauaccaugaauaaccacucgaaaaucuaauuuuaaaaauccacaaugccaccaaaaaaacccccaaaaccuaaagugccuagcaguaagacaaaacauguacaagaucuuuauggagaaauuuacaacauauaauaaaaagacauuaaagaagacaugaggaaauggaggccaccauguucacaaagaggaaacuugaaaccauaaagauggugauucuucuaguaaauuuuaugaauacagugaaauuccaaucaaaaucuaaauaagguuuuaugugggacuugacaaacuaucaugaaauuuauauagaaaaacaaagggucaagaauagccaagauucuacauugaaauuucuaauaaaaaaaaagaauggccaagacaauuuuaagaauaucaggauucauuauaaagucaugguuguuaauauuaugguuauuauaaagacaccgugguauaggugcaugguuagacaguagaucagucaaauagagagcugaaaauaauaccuaugccuauuggaaacuuuauguaugacggguagcacugcaaaucagugggaugggacaauugggauccauauagaaaagaauaaaauugaauuccuaacucacaucauacauaaagaucaauuccaaaugaaugaaaaucuaguauugaaaaagcaaaaguuuaaaacucuuguaagaaaauauacgugaccaggauuuucucaacaagauagaaaaaaucuggaaaagacugauauauuugucuauauaaaauuuaaagcuagaaagcaagaaaaugcaccacaaaccaaguuaagagagcuuauauugaggaaaaacauuuguaaugcauauguccgagaaaggauuuauacccaaaauucacaaagaauuccuaaaaaucacuaagaacaagauaaacuaauggagggauauaaacaggguaguuaagcagcccaaauggccaaaaggcauaaaaaguugcuugacuucaccugccacugaggaaaugcaaauugaaacaaacaugggauaccauuuuacacccauacccaucacaguggcaaaaaucuaacagucugacuauauaaguuuggcaagaauggggaguauuaaaaucuuagacacuugcaggaaggaguauaaauugguacagucauucuggcaagugguuuugcauuaucugguggaagaugcuguaaauucugacccagcaguuccacacuauguagauacccuagagaaggucucaaaugugcccaaggagacauguauaauaauguucaucacagcccuguuuguaaaggggaaaaauaaggaaccuaaguaugcaucaacagaauaaacuauaauauguucauauaguaaagugguacacaguaguuaaaaagaaucuaaaaaaacuggaugcagguggcacauaccuguaaucccagcuacuuggaagguugaggugggaaaucagugaauccaggaguucgggaccagccugggcaauguagcgagacccugugucaauacaaauaaauaauuuuaggcugggugcuguggcucacgccuguaauccuagcauuugggaggccgaggcagguggaucaccugaggucaggaguucaagaccagcuuggccagcauggugaaacuccaucuuuacuaaaaauacaaauauuagccaggcaugguggcucacgccuguaaucccagcuacucaggagguugaggaaggagaaucccuugaaccugggagguggagguuguagugagcugagauugugccacugcacuccagccugcacaaugggagcgagacuccaucucaaaaaaauaauaaaaauaaaauaaauaauuuuaaaaaaugaucuagaaagacaagugucaacauggauugaauuucaaaaacauaaguuugaaugaaaaaacauaucacaguggaauacaucuagugugauuccauuuguagaagauguaaacagguauaaacacuuuuuuucuguuuaugcauggcucauguaguuaauaaaaacauagugagaaugauaaacaccaaauucaggauaguggugaguuuuggggaggaggaaaaggauuguaucaggaaaguacauauaggggauuucaaauauaucugcuguguguuacaguuuucuccagauuaagaauuauagcauauuuauuggaaugccaaaaggagcugaagaaccaaggagcauucuucuguuagacagcgaaaacagucuuggagauuaaugcucauaaaaagugauaaaaauggauuuauauguuuuuagaaaguaucuucagaaaacauaauucaaaauuauauuuuuauuaagaacacaaagcacaaaacauaguguaaauuuuaauacauuuuaaugcucagaugaaacacugugccuucaugaauuggaagacugugcaaauuuauuuucuuggguacuguacaucauuuuuaaaaauuaugaaauaaggcugggugcaguggcucaugucuuuaauuccagcacuuugagaagcugaggcggguggaucacuugaggccagguguucaagaccagccucgacaauguggagaaacccuggcucuacuaaaaauacaaaaauuagccagauguggugaugcacaccuguaaucccagcuacucaggaggccgagcaggagaaucacuugaaccugggaggcagagguugcagugagcagagaucaugcuacugcacccuagccugggugacagagugagacuuugucucaaaaaaaaauuaugaaauaagauguguacaguuuuauauauauuugucauuauaaagcaagugcucaggucaagaaacacagcauuccagaagcccuugugugacauacaauuucuucagugugauuuguuuuuuaaugguauaaagagcuguauaaauacacuuguuauuccucuuacauuuuaaaaaauuaaucuuagaaaaauauauugccagcauugauuuuuaaauuuuuagcacaauuugggauugggacauguuggugcaacucuaggaugccugagaagacuguggaaaauacuaguuuguuucaugguuugcagaggacuuggcuacggucagcaacagcagugccacagcuuguaguuaugcccuaggucagcaaucucucucuucuggccagagcuccaggaaguugauaagcaacuucagagcuguguuuucgcugacauuggccagcaggcuacguauguggucuuuaccauuuggggccaucccccacuaucagagcauuuacaguuuuucuugggacacuggacauuuuuugagcucuugggguucaaaaaaaugaaccuugggguucaaaaaaugacccuugauggucuagugaagaguccauggcccaaagaccaggaaacagcacacuagucuagaaacuaggguuucucagcaguggcacaauugacauuuuggaauggaugauucuuuguugagaggggcuguccugugcaugauaggauguuucgcagcaucccuggccucuacucacuggcugccaguagcacccucucagacaaccagagugucucuagacauugcccagauuacccugggaaacgagaucaccccaguggggaaccacugcaucagaguguaguauucacacgaggcucaugcucccuucucgaugccacagcuguggaggagguggguggggaggcaaccugaaugaagaccccuaacuuggagcaagaggaggagugaagggcaaagauaagggaaaugcugcaggcagauccauggagccuuuacacagagucggggcuucaggguaacaguuaaugacaguggggggaagagagggugggcgcagagcugugaggugcaagcuccguucagagauaaccgagagaaguguguuagugcagagccuggucucucuggaggauggcacuccagccuuccaucuucccucugcuugagcccagcuugagcauuaaaggagcuuuagacccucuuaucuuaccacauuuuuucugacuuccuagaaaguuacgugagucuagcaagugggcugaguuccuuggagacagauugaaauugcuuguuacucaacagacauuucaagcacccacuuaaagggggaggugcugugccaggcacgagggacccuccugauugcccaggacuauaugaucugacuagggagacagacucagccagcacaggcagccccgggagaaggcaggcucuguugucaggcugccuggguucagaucccagcucugcaccuggcugaugugucuccuuggguaaguaaugaugcuaagccucggugucccagucuguaaaaugggguaguaagaauucuuuuucccuauguauuugagaggauuaauugaaagagugaguacagcuuguagaacagugccuggcauuagugaacacucaaugauauaauaauauuauuuuaaauguuuuauuauugcugcuacuacauaaggccugucacaggcuuaaauaguaucaagaaaacugagggggcaguaaccaaaggcuucacagaagaaguggcauuucugagaugggucuuaaaggauuaguggcgcuuuaucaggaaaaacaaaagaguugugggauugggaaagauccugugcuaacauucagacagaagaaagagcagccagaaagucacagauugcaagugaauguggcuuaaucaggggacagcugcuggcucugugaacccaaggcugagggaggggugggaagcaaggccagugaggccgguggagaagggccguguagggguacuuggucugaaggagcagaaguaccaagcccuuuuggcuugagccugcuuccuucauuauuccuuauuuccaaaauagguuaagaagaacugaccauuuucaucccauuuccccuuccccagggcagugagaugcuaaguguuacugagcuuuuagaaaccgaaaagcaaacuuguguguagggaccuugugcuauaacacaggagccaggcggaggaugcuggcaaccagcucacuccagaagaguccagcugaccuagcacaggccuuccugucuugccuucccugcucugugaccauucagagggugucacgacccacggguucacggggaucccaucaaucagcuccuggguagcgcuguacuucccaccugucucuccucugcugcucacaugcugucccagggcaggggcuggaaaccauccuggcagacauggguaauaaccauggcaccugugccugaggagugguguauuuauuuccccccaguccauggcguugugcccgaggcuuugcugaaucagccuggugcugucuggcguccaccucgcuaccgagaccucagucccaaggucacgagcguucccuggauggugcuggcuuuggcuuccccauucugauacuucacacagugaacacguacuuacugagcccuuccugcugugcagggcacagggguguguuaugaaugagggacaccaucucuggcuuuguggaacacagucuugugggagagacgcacccugagcugaccaaguggauacaguggacaagagcuaagaaaggggcagguacaggagcuaaaaacggagaggagcccaaucgucagggggggugaccaggucaggaaaggccuccccgaggaagugaggcuccuggauaccugagaaugcuuaggagggggcaggcaaggaggcaguguggaggaguguggggaccuuccucaccaagggggcgaugaccaaacccagcaggcuuccccagccaccucccccuuggccugccugcugucuuuggcacuacccucucuuaaauguuucccccucacccccaggccuacuuuuuccccuuccuuccacuacucucucauccccccaguggcucauccugcucuucacacaggucauuucagccuuccuggagggugggcugcuccccaagguagugcacagugaucgcaagaagccaggcuuggaggaggcuggccuggcugggcuccagcaccugccuuacccuucacuggucaugaggccuuagacaaguaagugacuggcugcuccgugcauuggaguccugucuguaaaagggguucccuuggacaaggcagucuaagugggauaaagcucuaaagcacuucgcacaagguaugugugagucaagaguuaacagcccucucccuuucagugccagaaacggacuugguucaguuaacuuuguuuucccuggaaaccugaugauuguggaaugucaggguguucccuggcaacagugcucaugguaaagcugaccccugcuugguaaauugcuucuggacuaggaguucucucaauacccagugaacuacagcuuuggguuucuucaguguggugucuucuguaacuaggcuggcucuuugcagggacucugaaagcuccgucugugggguugucacaggagaugucagcucauauaguaccugggccaggcccacuccugcaccuagucagcuuggccuuaaguuggcaccuggggugaccucaucugucaggugaaaagauuaaaccuccagcucgauucauuuauuuaaaaauaccuguugagggccuacuaugggguagguucugggaacacaguguugagcaaaacagauccauuaucugcccucaaggcacuuacagugcuguggaaagagggcugucaaucaaaacauuacacaaacaacaauaaaagaacacccugauaauagguacacugugcuaugaguguaguggggagguuugagcuaguuagggaggccagggaagaagucauauuggagcugggauaugauggaugaacaggcauuaaccagauaaagaagggggaaggaagacuccagaaggagagaacagcacaggcaaaggcuuucugggugggggauagugcaugguggagagaaugagggcagguggaacucugccguucagguccugagaggcagggcugagcacaagaucauuuagugacccaacgcagcccugagcauagaucagugagagcugcugcccaaacagugucacauugcugguauuuuugcuucuucaucuuaagagcaaugagaaacaggcuaaugcaagaugggauguauuggugggaggagggcuuggccugauuggauuuacaauaugaaaugugaagaguuuauucuagcugcaggaugcugagaucaaguccaaggggagugaaauuugaggggaaagguuuugauggagaaagaagccugagguguuugcaggcuuaacagagcuucagagggggguuagcagcaggagaggaaaggcagccuuuaauuucaggggucuuggugccuucacauccccauuuuuggcuuccaugacccccaaccacccuuccauguugccagaccacagguugaagggaggugggugugggcuuuaacagaagauagaggugcccaaggaugccccagccacgagcagaacaccuucagggcauucauaaaaauaaaucaagccccacagcagcacuuucuguagcuuagagaguugcucuuggcauugaagacagacauuuuccauuaaauaagauaaaugaaaaaucguauuuauuuuugucucucuucccuccaggcuuauauuuggcacccuuuacccugcguauuauuccuacaaggcugugaaaucaaaggacauuaaggaauauguaaguagcacuguguauuuucgagcggguuggcuggagucaggucaggugugaaauguugggagaaggggaugcccuccgugcuaugggcacuggaagcagggaaaaggaguuccuucaucacaguucucaugagacaucucaggaguccucuuuucugucuagaccuuccccugccuagaccuagagcguugaggugagaaaagcagggagauacggcaagaggcuguggcaucuggaauuggagguuucucagcugugccacaagccacaggugacuucaccucucucagccuugauuuauuugucuggaaaacacucuguagaccuuaaagcaccgugauggagaaaaaguccagcaucgcaggcaggagcacagguuuuagagucuggcagaccuggguuugguuccugguucugcagcucugcccccauuccauuucuuucauuccaaauccacaauucaggcuguguugcucuauaaccuucugaaggcagaggauuuuuaucauccuauaucuguuuucauaguuuuguuuuuugagccggagucucacucuguugccugggcuggagagcaguggcacaaccucggcucacugcaaccuccgccucccggguucaagagauucuccagccucagccucccaaguagcuuggauuacaggugugugccaccacgcccagcuaauuuuuguguuuuuaguagggacaggguuucgucauguuggccaggcuggucucgaacuccugaccucgugaucugccugccucggccucccaaaaagcggggauuauaggcgugccacagugcccggccccuauaucuguuuccuguagcacauugcagaaggugagcacauaggaaggggaucugggaggacuuacuggucagaggauaaucucaauuacuguuggaugaucugggugcccuagucaccaguucugaauguguugggcaccuucaggcaggagaaccauuagaccaccgcugacugagaaagaccugcuggguggguggugagggaaggguguccuuccccacacaggacacaaacucaaaaugcaaaagguguggauuuuggcaucagaagaccgagguuggucaaguccuggcucugacauuugaaugaugcagugcuggucuaaguagcuuaaacuuccgagagccuaaguguccucaucugaacagugggguggguaauagccaugccuuugccucuuuuacucagaugucucuuggcagguuuggcgaagguaaagaaacaauucaaggugggcuuagaaagucaguauuuuuuuucucagauuucccaagaagucuuuaugaugaaaccaaccaucucuagaucaacugcaaccagaacucaccccccaccccaccccgcaaucucccacuuucccagaacaacuugccugggcuugcaccuugcuguucguaagcagggaguuccagaggggagcgauuuuucuucuggagacugggucugugguauaugugagggaaucucagaaugcacgcuauaaauagcuguuaaauugcaagcacagaaccuccugauucucaauugacuuggcacagggcaaagcauuaagcagcuucuccuagcccucccucucccaacccuuucccgccugcaaucugugccagagaaggaggccuuaccaggaucacugugguauaaggucuaauccuucacuuugcaggggcgaaaacaacucugucagcucuucugagagagaucaaacccugguaaauuguuuugcucugacuaaacucacagaagccugguuuaugacuagaauggcaauucauuaauuuagagugaaaaccauaauugaugagcagagcagcuguuuguguuggcugcugagcacaugcuuuucccaguagggaacgugcaagaguuuagauuagguuucuugguaaaaaaggaaucugaagaaacaagccgaguaguaucaggagggaacugccuuucucugcacucacacuccuguguuuccuuccugcaguccuuucgacuaaugcgcccauuuuguucaagagagaaaccugcgaguuuccuuaacacacccacacccacgccccacccaguuggugaccaugucccuucaucccugucgccugaauaaucuuccaaaccaggucugucguccuucucugcugccacucucagaaaugagauucucacuauuuucccuagaagguuacaguagccuccuauauuaguuuuuuauugucaccauuacaaauuaccgugaacuuaguggcuuaaaacaccuguguacuauuuuauaauucugaaggucagaaguccaaugagucccacuugguuaaaaucaagcagggcugugcuccguuuaguggcuccaggggagaggcuguguccuugccuuuuccaguuccuagaggccauuccuggauucuuaggcuugugccccuuucucuuccuccuucagagccagcaacauugcaucucucuggcuguucuuccauaaccauaucucccucaggcucacugggaaagguucuccacuuuaaggauucaugugauuacauggggcccaccugggucauccaggauacucuucccaucugaagguccuuaauuuaauaaugcuacacagucccauuugccauauggggauuaggacauggacaucuuuggggagccauuguugugccuaucacaccuccuaacugguucuccugccuccugucccugcuuucccacucuguugccacaugacauccagugccauuuaaaaaugaaagucuauuuauuucacuccccugggucauuuaauggcugcuuaucaccugcaagaucaagcacaaacuucauuacagcauuuaacacccuucucaaucuugcucuucccuacuucccagucgcuucucuacacgucuucagcgcuguaaucucaacacccaaggugugguugguggccagcauuaucugcaucaccugggaacuugcuugaauugaagacucaggcuugucuuucuguggaaggcacagaaacgguuaucaugaaggaguuuuugacacacauuccccuagaaguaggaggcauggcaugccauguagggccacacaggggaaccaccagggcuggucaggaagcagagggagcucuccuaaauaaaaaugggcauuuuucacaggaucuccaauuuagaaacauugcucaagacauuuauagcugcuuaugucuuuccaaccaaacuuacuguaccuggauucaagguuuugggaugaaaacuuaaacagaaaggaauuuacgggaauuuauagaauuaacuagguagcaggagaaagauacccaggaacuggggaggauccaaggaggcuggguggugcugacggcccagcucacaccauaggaaagugugugauuaggaagccucugccaaagucacaucuugggcacuggcugcuugugcuuuugaggcauccccugacagugcacaguccuggauaggggcccaaauaacaggacuuuccucccacaaagaugcucauguugggagaugucucccaauuuuagaaggcuuuggaugcugaguagucauggaaaaaaaauaaccaauacagcugccucuuaggcuaccccaaacuacauccacauccauuccuuuacccacauuucggcuuaaaaacaagcuuccaacaagaauucuauacaacucacucacuugucaaauccagauuccguaaguugcugaguccagcuccaggcccaguaucccugggcaaagucuucuccuccucugguucugacaagacccaaccuuaauauucagcauuccgaacacugaauuguuaagugaacggucaccaaugcagcucacauacuauuuuaguggggagagaaagaauuaaaauauaauuacuuaaaauauuaaaaucuauacuuagaaaggaggaaaauauggauagaagauacaguccauauucaugcaacuggucaugaguucauagcuguauuugugucuuuuguuaaaagaaaaaaguuuuuagaggguggaaucaugacucuuguaugaauauaaaaugaacacauguugaagauuuugcuuaacuuaugaacuaaugagggaaccaguaagguguucaaaggagaccccaaauaacagacauauguaggcaaucagaaauguugaaauggauuuguuaauaaauauuaaacugauuacuuggagggugggauggggagaucaguuguaucucugcuggacaaaauuuauuugcaccucugugggugaaacuauaugcauugcaaucaguuuuaacuuauaaaguuguaaaauagcucaaagacauugaaaagcaggacaccugcagaaucaagauaauucagaaggacaugcuggacaccuagcauuccacaggauacccauucugaagucuuucucagguuuuccugaggcuuuccucuuccgccauccaauucaugcucccguugcuuucagcuagagcuuuagugggauuuguuccucauccugugauggggcccaaaucuuuauuccugaggaaucugaggucuuggcaguuuugccucuguagggcuguaguaaugacccauugacuuuuuuuuuuuuuuuuugauacagagucucgcucuaucacccaggcuggagugcaguggcacgaucucggcucacugcaaccucugccuccuggguucaagugauucuccugccucagccuccccaguagcaggaauuacaggcaugcagcaccaugccuggcuaauuuuugcauuuuuguagagauggggguuucaccauguuggccaggcuggucuugaacuccugaccucaggcaauccacacaccuuggccugcuaaagugcugggauuacaggugugagccaccacgccaagcaacccauugacuuuuaccccugaacaagacaguacuaggaggcccccccaaggcuguuugacuuccaucugcucuucuuucugccucauuguguagcagcaguccugguuccccuugauaauuaggaucaguuagcaccucaaagcccauaagccccuuuaucaucuauuuccuacuggcgugaguaucgugaagccaccaggagacaauauaagucucugcuuccacuucauugaaaccauuuuguauccccuguuggaagcauccaucccucaaguaccaaagucauuaagaagcagagaucagaggucugaggaugagaagcaaaaauguugugagugcguuagagcagugauucucaaacuuuaacaugcauaugaaugaacaggggaucuccuuaaaagcagauuaugauccaguaggucugggauggggucugagauucugcauuucuaacaggcucccagaugaugccaacagugcugguccacggaccucacuuugauugcaaggagcuggcaucaggcuuaaucauagauuaaggaacccucauuuccuugguuccugcaccuuuagauucuggcuaagaagcaccaccauauguuggucacugguucagaggagaaacugcacccuccaggacugcacaccaaucucauaaaaugcugacucccaccuugguugcuuucggaacccuccaaugccagguagcacuguauaaggccagccaccgcagggcauugggugcauaagaucaaugacuccccaaagcaucagccuauugccuuauuucuuuugcuauaaaggaggguccuugaugagaagcaguauugugugggaugcaucaaaaggaaaaggguaaucccugaguccacagcuugcuguguggcugccagaagcagagcaguaggaaaagcaaguccacaugcagaaaaaaugaauauuccagaaaagacccuaugccgcccacuccaugagggaaggggccugguggaaugaaccugcuuccagaaggcuggcuggugccuugugauaugguaucagccuggagaugcuuggucauugcugcuggcaacauggucucugagcagugguuguggccaggucagccuuggugagagggauuccacauugcugagccuguaugcuaccucugucacuuccacuuggcuguuugguacaugagcccauugaacaugcacuaucaagccugaggaaggaggcuggccgacauccacagaccuggccaucucaugcacuuggucacuaggagccuccucugcugugggaccuguuggugagcauaagcguugggccaacaauguauucauucucugggcccauucaccucauucccagaccaccucaacaggagucucucagccucacuucuuccaagaaccucauccucuagacagagcuuuagcugguguuugaaaaugugcccgggauuuguuuuacucagggauggaaagucacaaagacguggaaaugacugucaugaaggaagaagucuagaaguaggagagucacaugcuuuguagggccacauggggaagcaccaggccagucaggaggcugacggagagugggaaacgugggcaguggccuucauugugguuucugugagaaagguaaggcaagacaggguaaacagauuucagauuggcuagguggaaucauuucagcaggcuccaaggugugggcgcugccucuaguugucugggaccuggcucuggggugguuaugguuggggaauauugcccaaccugugggagcuccauaaaggaaguaauuuagaguauagacucuggauugguuaguuugcauaugaaaggugugcuggggcaaggcuagcccuggaagggcagucccucuguaaucauugaggccccagaugccagagcaucaagaauauagaaaauaagaaaauggaguucauauacccggugacagugcgugaacauuaacuuagggcauuucucccuccaggcuaagugcccugcucaaaguccugccugcaggggaauuucacuuucccgcucuccuagggucaccccugacuauauagccauccacggugagcagauggugcagagucaucuguaaagcaggcuugaauuuuuucuuucugucauauggcacagggaauucccugugaggcugaagcgcagggcccagaugcaagagggugugaaaggcuugagaaauugaaugugccugguuagagcagaguccaaaggugaggugaggcuaaagaaguagcuaagccugcuccucugcagcccauagggaggccuuuggcaggcugccagaagcucuggcagugggguagaauggaccagggaauuucagccagcugcuguggcucauggaaagucuccaggccgcuuccuacccugagcucuggagcuucuugcuguggcugagggucacagcaucuuucccaucucuucacuccuagauccugcuccugaccaguuuagagagacuccccagucauacugucaacguuccauuuguccaggagaguuacuccugaauauuaccucucaaauuggccauagcucccucucucuauucugacugaaggcccacccaggcuccucaucccuaucuugcagggagguuuggauagaaucuuucaaacauggaaaauuauauuucaaaccuuggggaaaauaacugucauuugauuuccacgaggaaugauggggaagaccauuuccuaguaauuuuagauggcuaugguuuccaucucugagucaccaguguuccguugaccuuguuagccucaaugagucauucucagauccuucuuucugcaugaaaguauuucaaaggagugcaucaugggaacuucuucaggagaaugcauuaaguccccucucugccauggcugcagcaucucuguccauagccucaaccuccuuccugagcuuuggucuugcuuuucuaggaauccguugggcaaucuucuuggcugcccugagccacauaaagcucaaacucuucugccuaaauuggcucuuucuuuacuuucuuguuggugcaaguggccccauaauuaucagucucugauguccugacuucaacaggugccuuucuuccuauguuuaugcagucaucaacucaguaggcacucauagggagcaucuguugccucacaaguugucuaauucugucuuuucuucucaaaaagccaucuagacaguauuucucaaaguauacucuuucuuaaccuuuugaaaccauucuuucugucccauucacagugccagcauucuaauccggucauuugaaacauacucauucaguaccuauuauaugucaggaauuguuuuggguacuagagauauaaagauguauaaggagaacuggucuccacccucagggagcuuacaauguauuaggaaaagcaggggaauaaacagguacuuucaaagcagugugauaaauguuaugacagggaaugugugugguacuguaaagaaagacaaggagaggguauuuacccaaacuucggguauguccuagaggaggucacguuuuugcugagaucugagggcugaaaucagacgcaaaaaaagaugcuuuguugagaacugaaagacucauaugguuggaguggaaaaugugagaggguagggguguggaugagcuuuugaugaaaauaauuaggggccaguuugcgggugugguggaucaagccuguaaucccagcacuuugggagacugaggcagguggauugcuugagcucaagaguucaaggccagccugggcaacauggugagacccugucucuacaaaaaauacaaaaaaacuggccagccuugguggcaugcaccuauagucccagcuacucaagacgcugagugggagaaucacuugagcccagcaggucgagacugcagugagcuguguuugcaccacagcacuucagcuuggaugacaagcgagacccugucccccucaaaaaaaaaaaaaaaaagguaggggccaguucaugcuaggccucauaagccaauguaaggaauuugggcuuuaucuuaacaacaguaaggaacuauugaaggcuauaaacuaggaaagaaagucacccgcuuuagguuuaagaauuuuuuuuuuuuuuugagacagggucuuguucuguugccaaggcuggaguacagugguauaaucacagagcugugauuauacacagcacugcagccuugaccuccccagguucaggugauccuucugccuuagccacccugguagcugugacuacaggugugcaucaccaugcccagcuaauuuuuguguuuuuuuauagagacgggguuucaccgcauuucccaggcuggucucaaacuccugggcucaagugauccaccugccucagccucccaaagugcggggauuacuggcaugagccaccaugacuggccuuaagaaaaucauuuuggcuggaauuuggaggauggauugugaaggggacagagguguaaagaccagcauaaaguuguaacuauucuaaacaggagauggugguguucugaaguaaggaaauggcagaggagaauggagaaaauaagacagguucaagaaaaauacaagaggguggaagugacagaacuuggggauugguuaccuguguuaggugaggaauguacaguuuucccuagggacagugucuagucuagaguuagaagcagaugucuagaacagagcucuagggaggaaaugaagacacugagaagaaguggcaagaaaagcaauugggaaaccaggacaauuguaguguugggagagcuuuucaguaugugauuguuucacuacuagccaaaaagucaagcaagccaaguaaaaacugaaaagagguuucuuacacuuccuugaaguauguuacaaaguggaggccccagugagagcaauuuugauguaauggaugcacugcagugagcaagugaggaaugagaaaguagaucuugcaaguauagaugacucacuggagaaguuuguagcuaaggguugcaucaaggaaagggauuuuuaaaaaauuuucugagauggaguuucacucuuguugcccaggcuggagugcaguggcgugcucuuggcucacuguaaccuccacuucccggauucaagcaauucuccugccucagccuccugaguagcuaggauuacaagugcguacaccacaccuggcuauuuuuuguauuuuuagcagagacgggguuucaccauguuggucaggcuagucucaaacuccugaccucaggugaucugcccgccccagccucccaaagugcuggcguuacaggcgugacccaccacgccuggccaaggagagggauuuuuaaaauuguuaucauuguccuuuugcucuaauugaagacccaaaacaugaauugacuacuaaaaagaaaaaaccuauaaagaaggaauucaggcuccugacaaugugucuggauacugauguugagaauucccagauccugagccccagcaggcuauagacuuuaccacuggacaaaaccucauuugcccccugcuaaggagucagugcugcuacagacaaccuggcagugugcagugucucagacaguaguuauuugauggacuaaaccuaccuuguuuuucugauagagaagaucuguaaguaauccauugagaaacauguuuuagagucacaaagacaacauggauucaccagaacagcuuucauuuuuugaaagauauuuuugcuggguauagaauucuagguugacauuuuuuuuccuuuuagcacuuuaaagauguuauuccauuuucucugauagucauuuuuuccaaugaaaagucagcuaucauucuuauucucauucucuuguguguaauguaucuuugcauccucucugcuuuuaagauuuucuguaugguaaugauuuuucuuuuuuucucuucuuuucuuucuuuuuuuuuuuuuaagcaguuuuacuaugacuugccuagguaugguuuucuuuuucuuuguauuuaucuugcuugggauucacugagcuuccugguucuuuggguuuguugguuuguuuauuuguuuauuuuuuuguuugagacagaaucuugcucuguugcccaggcuggagugcaguggcaugaucucagcucacuguaaccuuugccucccggguucaagcaauucuugugccucagccucccaaguaacugggacuacaggcacucaccaccaugcccagcuaauuauuauauuuuuaguagagacaggguauugccaaguugcccaggcuggucuagaacuccuggccucaagcgauccaccugccucagccucccaaaguguucccaucacaccugaucaggguuuguuauuuuuuuuuuaaucaaauuuuagaacuuuguagccaguauucuucaaguguuuuuuuuuguucuccauucucauguuucuuuccuucuggaauuccuauuacauguauguuagacugccugaugcaguccaacacauauugagccucucaguguuguuuuccaaucuaggcuuuagucugcauggcuuuagucuggauuugucuucaaauacacagaucuuuucuuuuguuguauccaauaugcuguuaauucugucauacuguuucauuucagauauugugcuuuugaauucuaggauaucauuuguuucuuuuuuaagaguuuccuucuuucucuugaaaucccccaucucuccacucauuguauucacauuuucuuuuagauucuuuaacauauuuauacuuuuuaaagaaaaauauggcugggcacgguggcucacaccuguaaucccagcacuuuggaaggccaaguggguggaucaccugaggucagcaguuugagaccagccugaccaacauggagaaacccugucucuacuaaaaauacaaaauuagccaggcgugguggcgcaugccuguagucccagcuacucgggaggcugaggcaggagaaucacuugagccugggaggaggagguuacggagaacugagaucgugccauugcacuccagccugggcaacaagagcaaaacuccaucucaacaaacaaacaaacaaacaaacaaacaaacaaacaaacaaaagaaaaaugauacugaacgcauccuuuuccuccuaggauaaguaucuuguuauguggugacaaaacaaaaguuuaguuuucauaauaaaaguuuuguuaauaaguugcuguauaucuguauaucuucuuuguggagugucuguucagaucuuuugcccauuuuuuaauuggguuguuuguuuucuuauuguugaguuuuaagaguucuuuguauauguugaauacaaguccuguaucagauauauaucuugcaaaauauuuucucccaaucugugggagaaaauugaguuguuuguuuucuuauuguugaguuuuaagaguuuuuuuuuuauauuuuaaauauaagugcuuuaucagauauguguuuuauaaauauuuucucccagucuccuuguucucuaaauguuaccugugcagagcggaaguuuuuaauuuuauuauuauuuuuuccugaccaccuauuaccaucauguccugcacuaguguuucagguuuauuuuuaaauguccuuugcugggaggaaggggccauucaguugguugggagcuuagaauuuuauuuuuggcuuauaauccaguauguagaugguuugcugguagccuaagaaucaaaagagcaaugcaaaauugauacuuuggcuuaguuagaauuccucacccacagggacuucagaccucacuggacaaauuguaauuugucaaaccgaaguaaaauauuuaggacauuugucacugaaugccauaaaguguuauaaucuaggaguuagcuaauuuugcagaugaaauggcaacaacaaauauaacuuagacaauuugggggacuaguaggauauuuuccacaguggaguucagggucaaaggcaaaauuacaacaaauuuaguuuaaauaccucaguugacuuuauuaugagccuagaauugggcaacacuucauucuauaaaauagaacaaguguucuaacaagcugagcugaagggauuggcuuuauagacagaagggaugaagaaaaaagguuuugaauuuuaaugaaguccaacuuaacgauuuuuuucuuucauagaucauaccauugauguuguauccaaaaacucagugccaaagcccgaggucuuuagauuuucuuauauguugucuucuagaaguuuuuuagucuugugcuuugcauuuagaccuaugauccauuuugaguuaaucuuugugaaagauguaaggucagugccuagauccauuuuucauuguuguuauugcaugugaauguccaguuuucccagcaucauuuguuaaaaagaccaucuuuucucuacugaauugcuuuugcuccuuugucaaggaucaaaucacuauacuugcgugggucuauuucugggaucuguguucuguuccauuuaucuauuuguuuauuuuuuuaccaguugcacauggucuugauuauuuuagcuuuacauuaaguuuugaaaucugauagcuuuagucuuucaauguuguucuucuuuuguauuauauuaauuguucuggucuuuuaccuuuccauauaaacuuuauaaucgguuuguugauauccauaagaaacuugcugggauugugauugggguugcauugaaucuauagaucaaguugggaagagcugacaucuugacaauauugaguucuccuauauaugaacaugaaauauuucuccauuuauuuagaucuuugauuucuaucauuuguauaguuuccuuuauauagacuuuuuacauauccuguuugauacauuucuaaguuauucauuuuuagaugguacuaacauaaguagcauuuguguuuuaauuucaaguuccaguuauuauguaggaaagcaauggacuuuuauacauuaaccuuguauccugcaaccuugcucuaaucauuuauuaaucccaggaggauuuuuuuggugaguuccuugggauuuucuacguagacaguuacaccaucuaugaggaaaaaugguuuuaucucuuucuucccagucuguauauguuuucuguuucuugucuuauugcauuaucuaggacuuccauuaugauauaggagugauggaagagaauaacuuugcccuuuuucugaucuuaggaggaaaucaucuauuuucucaccaguaagucuaauguuagcuguaggguuuuaaaaaaaauauguucuuuaucaaguugaggagcuucccuucuauuucuacuuugcuaagguuuuuuuuuuuuaagucacaaaugaguguuggauuuuuuucauuacugauucaguuucuuaaauagacuaugggcccuuugcacguuuuuaacuggguuauguacccuuuuauuguugaguuauaagaguuuuuuauauauuuagauauaaguaccuuaucagaugaaugaugugcaaauauuuucuaccauuuuguggguuguguuuuuacuuucucgaugguguccuuugaagcaaaacaguuuuuaauuuugaugaagucuaauuugucuucuuuuugagguaggaucuugcucuguugcccuggcugaagggcagugacaugaucauagcuuacugcagccuugaacuccugggcucaagccauccuccugccucagccucccaaauagcuagcuaggacuacaggugugugacaccaugccuggcuacuuuuugaguuuuuuaguggagacaguguguauuagucuguuuucacacugcuauaaagaacuucccugagacuggguaauuuauaaaugagguuuaauugacucacaguucugcauggcuagggaggccucagggaacuuacaaucaugguggaacgugaaggggaagcaggcaccuucuucacaagguggcaggacagagagagacagcaaaggaaacuaccuguuauaaaaccaucagaucuugugagaacucacucaccaucaugagaaccacaugggggaaaccgcccccaugaaccaaucaccucccaccaagucccuccucugacauguggggauuaaaauuggauuacaauuugagaagagauuuaaguggggacacaaccacacauccaaaccauaucaugggcucucacuauguugcccuggcugaucucaaauuccuggccucaagcaauucucucaucuuggccucccaguaaauuuuuuaguuugguuguuuuuuuuuguuuuuuuuuuccccugagacagagucuugcucugucacccaggcuggagugcaguagcccaaucucagcucacugcaaccucuucccccuggguucaugccauucuccuaccucagccuccugaguagcugggacuacaggugcccaccaccaugcccggcuaauuuuuugcauuuuuaguggagacgggguuucaucguguuagccaggauggucucgaucuccugaccucgugauccacccaccucggccucccaaagugcugggauuacaggcgugagccaccacgccuggccuuuuaguuuguuuuuuugugugugugcuuuugguaguauaucuuuauuuauuuauuuauuuauuuuauuuuuuuuauuuuuauuuuuauuuuuauuuuuugagauggagucucgcucugucgcccaggccggacugcggacugcaguggcgcaaucucggcucacugcaagcuccgcuucccggguucacgccauucuccugccucagccucccgaguagcugggacuacaggcgccggccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggcccuuuugguaguacaucuaagaaagcauugccugauccaaggucagaaauauuuaauuauauguuuuucuuguaaguguuuuauaguuuuaacucuuacauuuaggacucugauccauuugaaguuaauuuuuguauaugguaugaaguuguucaacuuuauuauuuuacauguggauaucuaguuaacucaaaacguauugauaccuuuuaaagcccuugucugcuaauucuaauaucgaagucaucuguggaucuguuucuauugaccaauuuuucuccuaaccauggauuauauuuuccuauucccucacguguaguauuuuauuguauacagaaccuugugugugauucauuguggaaaccacagauauuuuauacauuuuucuuauuuuuuuguguuuauagcuuuaggggguacaagugcagguuuguuacguggauauauuacauagugaugaagucugggcuuuuaguguaaccaucacccaaguagucuaaauuguacccauucgguaguuucucaucccucauccccuccuaccuucccaccuuuucaagucuccaaagucuauuauuccacucucuauguccauguguacacauuauuuagcuccuauuuauaagugagaacaugcaguauuuggcuuucuguuucugaguuauucuacuuaugauaauggacuccaguuccaucuauauugcugcaaaagacaugauuuuuuauuaugguuggguaguauuccauugugcauauauauauauguauguauauacaccccauuuucuuuauucagucauccauugauagacuuagguuguagauuuuuuuuugccuucuugugaagaauguugaguguuguucuagcaggcaguuaaauucaggcagaucaccuugacccuguggcagcuagauacguuuuguuugggcagguauauuuaaauuuugcucuuagucauagaguuaaucucuuaguguuaggauguaauuuuuauugcuaagauguggucuuccagguguuucacuggaaauuccaaaugcuuaccaaaccccucuaacuuugcaugacuugaauuccaaacuuuguuuccccaacagugggcagaagcuaaaucucugcucaacucugagcuuuucagcuuuccagcuguuuauaucuacauuuauaucuauauguauuuauaucuauauuauuauacagacuucuucgcuuggagucuuaccugcuucugugcauuucagggaccugccaaguuuuugaagagaauuuauauguagauuuuuggggugccccuuuauggcuucccuaauucugagauuuuucucuguccacuuccagcaucucuggcagucucaaacugcauucuccuuuucuuuggacaaauaagacucuggauuugagauugaguucucucugccccaugaugugcagagugaggacuguccucagccgcacugacuuguacuaacccagugugguucccgugcuccaaagcuugaaccccuuccagucucugucugcuuuuuauauugcucuccagggccuucaaacaguuguuuugaaauauuuuguuugguguuuauuaucauuauuaguaggagccuuaguucaauauaagcuaccucacuuuugccagaagccagaaggaguagacuaaggaaucuggacuugauucugcaggcugggauauuuuaaauggggugauagucugaugaguuuauacuuuugggagaauaguacagggguggcuugguauuaggauggguugcugaggggaaagucaggaaacaagggaaguaggaguaguucaagagagaggggacaaaggccuuaggggagaaaggcaguagaaauugaaaaggauggucacaugggagagauaaaaggaagaucagaauuccuagauuacuaccaugccaucccagagaguguggcccaguuacacuucauuccaggguguguuuguguagaggccuagagcauuuucuccccugauguucugaaaaaugaccugauugaauccugggucacucuugguccgcaggucuccccggcucacuuuagggccauaugaccuucagccugagucaguuguggaacagcccauuugcuuccagcuucaagaucuggagcagaacuggacauaagcuggggaaggauagggagaaggcuacaaaugcaggcugcaccaccuggacgugccuccguaucugccgccggggccuguucuuccugguguugggcaguguuuuuccuggaccuuuucuaccagcuguguugcuuucuguuucaacaggucaaauggaugauguacuggauuauauuugcacuuuucaccacagcagagacauucacagacaucuuccuuuguugguaaguacuccaggaguugggauguuucuaaggacaauuuugcuuagugucacucagggggaggugggaaagggcugaacccagccucaaaccucaccucaggccagagacgcaagagcagggauguuaacuggagcauuuuuaauagauuaguccacaaaguuguucuucaaguaaauauuuauugaaugaccuuauaaagagcaguuauuauucuaagcccuggggauauagucauggacaggacagauacacauccucaauuaauggaguugguaaagaagcauucguacguuaaaaaaguaaaggaacaaaagaaacaaugcacaaaaaugcacaggaaaaacugaguuuccuucucacucaauucauggucaacauaaucacuacucacaguuguguauccucuuaaaaaacuaauauauggccuaggugugguggcucaugccuguaaucccagcacuuugggaggccgagguggguggaucaccugaggucaggauuuugagaccagccuggcuaacauggcgaaaccccaucucugcuaaaaaaaaauacaaaaaaauaauuagccgggcaugguggugcacaccuguagucccagcuacuugggaggcugaggcaggagaaucacuugaacccaggagguggagguugcaguaagccaagaucgcaucauugcacuccagccugggugacagagcaagacugugucucaaaacaaacaaacaaacaaacaaaaacuaauauauguguguguguauacacacauuuuacacacacuucuuuuuuuuaaaagcaguauuauaguauacaugagaguucucacuuugcuuauuaaauuuauuuuggaaauacuuuuauaugagcauaaauacaucuaccuaauuuuuaauggcuacauaauauuucauggcauagauggagcauaauuuauuugucauccccuuuugaugggcauuuaaguugauacccauauuuuucucuuaucagcaaugcagcuauuuccagcaaugaagcaauuaaaaaacaagcuagaucuuuguauugcuguauugugccuucuuaggcgaaagaagcuguaaauaauauaucgauuucuguuuguauuuaaagaguugagugugugcacaugugaauguguauuaaaaguaguguggaaaauauaguuaacgaggguuauuucuacgacuugggaucaugggguugguuuugcauuugcuguguuguacgaauguuuuaaccauggugaagugugaucagagaaaguaaucaagauauuuccacuuuggagaaaacagguucuuacccaaaaaggaucaguaugaaauuacccucugggacguccuaggccaaggaauagaccugaauagcacucucugaauccuguuuugagucaauggccuuaauuaucuuagcauguacuuuuccccacaacauagcuuucaccuccacugagagaaguagaugucccagccauuguagccucaagcuguagugaaggaguauggauuuccuaauucaauaugcuugugccuucgcacccugcacugugcacagguagugcagcagacucuggaugaagcugagucuccuuaagugggacagagcucucugcugagccaucccuugucuccccgagaccuugaggcuggcccuggaagucaggccauuuuguacagagcugcaucaggaaaugaagggguggguugccucuccacaccuguggguguuucucguuagguggaacgagagacuuggaaaagaaaaagacacagagacaaaguauagagaaaaaaauagggggacccagggaaccagcguucggcauauggaggaucccgccagcuucugaguucccuuaguauuuauugaucauucguggguguuucuccgagagggggaugugucagggucgcaagacaauaguggggagagggucagcagacaaacacgugaacaaaggucuuugcaucauagacaagguagagaaucaagugcugugcuuuuagauaugcauacacauaaacaucucaaugcuuuacaaagcaguauugcugcccgcaugucccaccuccagcccuaaggcgguuuuucccuaucucaguagauggaacguacaaucggguuuuauaccgagacauuccauugcccagggaugggcgggagacagaugccuuccucuugucucaacugcaaaaggcaugccuuccucuuauacuaauccuccucagcacagacccuuuacaggugucgggcugggggacggucaggucuuucccuucccaugaggccauauuucagacuaucacauggggagaaaccuuggacaauaccuggcuuuccuaggcagaggucccugcgggcuuccacaguuuuugugucccuggguacuugagauuagggaguggugaugacucuuaaagagcgugcugccuucaagcaucuguuuaacaaagcagaucuugcacagcccuuaauccauuuaacccugaguuugacacagcacauguuucagagagcacgggguuggggguaagguuauagauuaacagaaucucaaggcagaagaauuucucuuaguacagaacaaaauggagucuccuaugucuacuucuuucuacacagacacaguaacaaucugaucucucuugcuuuuccccacaaggaaacuccugucugauucacaaagaugagaguagaggccggcccagucaagacuguguagucaauuaaauagcaccuccugccauccagccuuuccuccuuaaccaggccuucuguguggugcuaggggccucuucuguccucccguguuagucucaugagcccauuccuggggauaucagcauuucagccucacugcuuuuugcuggguggaaauccuaucuaaugauggcuguguuccuccuggguagcuggaauaugcccuuaccuguggcccuggaauuuuagaguuucauaucuaguaagugcucaacaacuauuucuggaauugauuucauuuugauuuugggaggcauauuaguuuucuauugcugccauaacaaauuaccacaaauuuaacagcuuaaaacaguacaaaugugugauuccacagcuucuguaagucggaaguacagguggaaucauccucugcuuagaaucucacaagaccagaaucaaggugugggccagccuggucuuuuaucugaaggcucuggagaagauuccccuuccaggcccauucagguuguuggcagaauucaguuccuuaugauuguaggacugaggucuccguuuucuugacacaugccaccaccuucaucuucaagccaaugauggccugucgaguccugcccaugcuuugacucugugucugcuucugccaccaguuagggaggaucucugcuuuuguuuuaagggcucuugugauuagauuaggccuaccccaauaaucccauauaaucucccugucuuaaagucgucugaucaguaaccuucauuacaucuuggccaaaacucugccuaccacagggggauguuugaugccugguguguuuggagcauguaugcagguauggguagaaucccccucucuuccugacccauguggaggccucuucugcucccuuauuuggucucuuagcuggggguguccaggcaguuugugggugggaagugaggguccuuugcucuucuccugguggccugaguucugcuucugcagggaagaggcuccuuaggaaccuuucugccugcuuuaucccacagccugaucauguccucacccugcuuucucuuuuucucccaaccuccaggugucauagauccuagucuucuucugggaggguccucucucuccuuccuuccucucacccugagaacaggcacaggaugggcccaucagggaauguaggaauuuugcuucacuuccaagcacaugggcaccaucuccgcagcucugagcauucuuuacuauucaaaaagguuagggggagaguuucuguccuaaaauaugucuuuugucuuccuagaagcaccuuuaacuuuuguucucuuccagaauuggagccacuuguauggaccuucuuuuccucacucuucgcucacccccauuccccucuucccacuucuccccuagggcggaucccuuuucaugguuaacuuuguaaaacuuuccaucuugaugaaaacaacaauuauuuauggucccagaauagauaagaugguggcuuguuucacagguuguagaggugauuucauuuaguuuuuuuuuuuaguuauaaaauaauacaggcugggcgugguggcucaugccuguaaucccagcacuuugggaggccgaggcgagcagaucacuugaggccaggaguucgagaccaaccuggcaaacauggugaaaccccguuucuacuaaaaaauacaaaaauuagcugggugugguggugcagcaccuguugucccagcuauucaggaggcugaggcaggagaaucacuugaacccgggaggcggagguugcagugagcuaagaucgcaccacugcacuccagccuggcgacagagugaaacucugucucaaaaaaauaaaaauaaaaauaaaaauaaaauaauacauacauaaggaaaaaugaaauagaaacaauacacugaagaguaagugucucucuucucccagacccacagucucccucccuagaaguaccacuguuuuuuuuuuuagacagagugcaguggugcgaucuuggcucacugcaaucucugccuccgagguucaagugcuucuccugccucagccuccugaguagcugggacuacaggcacgugccaccaugccuggcuaauuuuuuguauuuucaccauguuagccaggauggucucgaucuccugaacuugugauccgcccaccucggccucccaaagugcugggauuacaggcaugagccaccgugccuggccuggcuaguaacacuguuaaaaguuacuuguguuuucuuuucuuccagaaaugcucuauacacauuuauugcauguauuuuggacaguuucaucccaugucuaacccucuuagaacacaucugucccucuagagugucuggguguuauauggggagaguggggagaggacaacugcccugugcuccagugcuguacauaugccuuggaaaagauggaggaaauguggugggugccucuggccuuuucaaauacaucucagaggucagggcucuucaaggaguucucauuacaaaaugaguagggccuuucucugucucucgagguaggcuggaagaagacuuggcggggauuguguugguagagccaagggaccccaaggccucuaggagacacagggucugaguggaucagccuggauuaucuugugaugccuggcaaggaccugguuuuguaugugaugauuccagaggcagcaggacuguuccccuccaucccacgccccuacacuucagugacagagauuuuaaggcuuuauguggggagggccuggcuuuaaauccggagucagcauacuuuuuuuuguaaagggccagauaguaaauguuuugagcuuucaggccauaugaucuuuauugcaacuacucaacucugccauuagcaugaaaggaaccauagacaauuaauaaaucauugugcauaacaguguucuaauaaaacuuuauuuauaaaaacagaugacaagcuggauuuggcccaugggccaggguuauugggaccccuggauccauucuagcaagcaacagagaccccucugacagacucaaggaaaagaaaacaaugacgcucuguugguagaugcugaaguaauucacagaauaaaaggaaaagcugaaacacuaagacucuggaaagggaggagccagagugccucaggaacccuagcacugaagcgcugauaguuacuccccucagcaccguucacaaagagguucccuuguagcucggcugaaguagguaaagaucauaaccaucguaaauauccauucaugggggccugagccggugcucauacacucguaugcagccauuaagaugagugagauaggccgggcgcgguggcucaugcuuguaaucccaggcgggcggaucaccugaggucaggaguucaagaccagccuggccaacauggugaaacccccgucucuacuaaaaauacaaaaauuagcugggcauuguggugcacgccuguaaucccagcuacuugggaggccaaggcaggagaauugcuugaacccagaagguggagguugcagugagcugagaccgugccacugcauuugcagccugcgcagcagagugaaacucugucucaaaaaaaaaaaaaaaaaagaugagugagguagcuaucccuguggugguaugagauaguccccaaggcauacuguugauuguauguaugugcugggagaagcaagauguaguaacggguguauagaaugcuucuguguguugggggcaacucagggagucauauauaccugcaugauguaucccucgcccuagucuaccucuggaaggauaugcaaguaacugauaauguuuuugcuuuuagaaaagggacuagggguuaggcgggggaaggagacucuucguuguauacuccuuuggacuuuuagaauuuuuuuuaacuauaugcaugcaugaccuauuuuuuuuaaaagacaucuuuuauguaauaaauaaaagagcugcagugcgacagauuauuuaugugucuuguguuggugucugagcuugcuggauucauuuccuuuccccuuggggcuggugaauacuuguuuucaaaacagaaguuccuccguuauuaaucaccagaguauucaaauaugggagaaucacaccucuguucuucagccucucucuuuucuggcugugaaacauuaaacaaucuugccaugaaagugcccacuaauugcugaggaaauauucaggaagcacccaccagaggcagaaggcagggggccaggagaccuuggugaggaaaggaggcguggguaaggcuacugacugggggauaggggugucugugugagaguuaagggcccuccagugacuugcuguuuuugauuuucugaucguuuaucuggggaggaugccuggaaaggacuuucugaucucuaagacuaggacaggugacugucucaucucauagcaucagguuuuaaggauaccugggauuuguuuuaagcgaguguggguaagacauagacauggaaauaauugucacgaagggagaaguuucuuugcucacagauuccuagaaacagaggcacagcacaccaugcagagccauguugggggccacucaggguccgucaggagaagagggagaaacuggggugagggccuuuaacauguuccacauuaaaggaaggaaagggcaaagcagggugggcaggcuugggcuuggcugguuugaauaaucucaguaggcucugggguauauggggcuaucucugguugucuagcccuggcccugggaugauuggggcagguggaugguggccuggaaugugagaguccaucagaggcaguggcuggagccugggcccauggauugguugguuugcauaugaaagguguguugcaggugaaguucuuuuuuuuuuuuuuuuuuugagauggaaucuugcucugucgcccaggcuagagugcaguggcgcgaucucggcucacugcaaccuccaacuccuggguucgagcaauucuccugccucagcccccugaguagcugggauuacaggugcccgccaccaugcccagcuaauuuuuguauuuuuuaguagagacggaguuucaccauauuggucaggcuggucucgaaccccugaccuugugauccacccaccucuuccucccaaagugcugggauuacaggcaugagccaccgcgcccggccagugaguucuuuacuaucucuagcaauuggcucaccuugugggaggggcaguuccuccagaguaagcaaggccccaaaguacaucagaauacagaaaaucaaaaauaaaccauaaacacaugguuacuacaccucuggacugccaaauaugguugcucggguuguucacagcacaagauaucuggccaagcaggugaauggggcugaaauucagaccaagcucugugguauguggccacagaacugcuuccaguugaagaggccaguuuucuucuaauacauucaaaggcaccacgugggcuagcacuauggcacuugucucagguuucuguucuauauuauuugugauuauuuuauaaaucucuguuucccugacuggacccuuaguuccaaggaugccagaaucuugucuguguucccaguggaccagaagcuccaugagggcaggaaucaggucuucuuugcucaccguugccucccuguaccuccuuauaccuggugcucaguacaagcuggcacguacagggacugggugccugccuguggggggacaaauaaaugaacaggcuugaggguaugcaggacugcaaacuccagaauuaugugcuaucugcaccguggacucuucuguuucuuggcacuaagaagaucaaaaucuguuugccugccauugacuugaguagggugaguagcauucuccuuccugccaagagcugggcucuugucccugccucuguuugggccaagaaggcagccaagaaagagaggcuuucauucucagucuagagauuuuuuugucaacucuucccugcuguaauucccccugguguuugucccuucuuggaugugagugaagagugagugacuggguguacagcguagaagagauccucugagccuguaggcuguggccagaacccuagcuccaaucuaaaugagcacagcccagcaggaagcuccagccugugccaggcagggccacgggggugauugcuggagagaaccuguguuccugguuugcuuuggcaacaaaagaaaacacgaacugguuuucaaagagaggcguugggguuguacugugugugugcaagugugugcccucaccuucauagguggaggacagaggaaucugggaaacuugcagccacaugcaagcaggagaggcguccuugccacccaccgggucucauccuucaaaagggcaguguugcugagaaccuaacagaacuuguguuuucaucucucucuccagguuuccauucuauuaugaacuaaaaauagcauuuguagccuggcugcugucucccuacacaaaaggcuccagccuccuguacaggaaguuuguacaucccacgcuaucuucaaaagaaaagguaauauaugcugccaugucuuucauucuuucuagcaagugagaaaauaaguaauaaauaaaaagggaugaucuuauugcaggagacuucucauuuggcucucauuugccuccagcaagucauuccuccuaaucguuuuuuuuaaguguauuucugagacguguuuagaaauaguggugaaguucucuaaaagauguuauuugucauuauuuacuggaaaacauuuccauaaauugaaacaaaagaaagaaaaaauucacucaauuuaaccacgcaaagugaauuuccuuccuuuugucaugcuuagccccuguccuuuuauagacaugauuuuuacauagacuauuuuaaaucuuaccuggaagccaggugugguggugcaugccuguaauuccagcuacucagggguauaaggugggagaaucacuugagcccagaaguucaaagccagccugggcaaccuagagaguccccaucucuuaaaaaaagaaagaaagauuaaaauuuuauguagaauuuuuuuaaaaaaaugauuuaaaaacuuaaauaaaauguuuguauccugagauuuuaaauguguuugcacacaaauccauuucuacuuggucuucguaauacccaugaugauguucccuuacugcuagauauuuagauuaucucuaccuuuuccugauauagauaguucugcagugagcacuaccauuccuggaguuuaguugcuuccuuuaauugucuuagaauuaauucccaagagcaggauuauuaagucaaacgauuccaacauuguaucauucguuaacuguauuacuuacuaagcugauuguguagugggguuucuuaacuaaaauaggagcauuauagguggcuugacagauuaaugucuauuguuucugaaaguugaauuccuuggacuagaaaggggaaggcuuugggaaacauauccguuggaugagcaggcuacuguacaaguuucggaaaaucucuuuaggaacucggaccgcagcacuuccugucucagaaggguggauuuugaggaacggaucccugucuugaccugguuaucaaaucccuacucgucuuacuucccuuuccccaaaugcugggcuuccccugaagcugccaauguaacuuccauugaagugaaggugacugacucuuaagaguugccaagaaucacuuccaaaggggugguggugggggacaggcaggucacaguuagagggccugcugcuaugacuuccuggggaagccuuccacagggaauccagcaggagguugcugacccacuugcacaccucaaagcaauggaaauacacuaaugcacagaacuugacuaaggccaaaugucauugucuuaccgaacucugaaaugagcagcugucaugaaaaacagccuuuuuuugggggguggggggcgcggaaucuugcucuguugcccaggcuggagugcaguggcacgaucucggcucacugcaaccucugccuccugggcuccagcaauucuccugccucagccucccagguagcugggacuauaggcacgugccaccaugccugacucauuuuguauuuuuagaggagaugggguuuuaccauguuggccaggcuggucucgaacucuugaccucaggugauacgcccaccuuggccucccaaagugcugggauuacaggcgugagccacugcacccggccgacaaacagccauuuucuuaaaacaaugacaacaacaaaacacucccaaacaaacaaaaauaauacaccaaaguuaauccaaauuugaacuaaaccaauauuguacuuggcuuuggucccugaagaagaccucaauccuguuuuccaucucaccuuuaccuuguugcaugacacuggaugacuucuaauuucugauuuuauuugaauauguguaaaacaaucucccuuauccaguaauacucauuucuuucagcuuuguaaucccucccaucgauauacaaauggggugauauuugauuuuagaauuaaauaacuauagaauaacagaauuuuagaacugcaagggcucaacccugucaagauaaggaagaugacaugguuaucauuuauugaaacuagccacuguguuagauguuuuacuggaauuaccucauuuaauccucaccaugcuccgcaaguuggguauuaucauuauccucguuuuucagaagacuaaaacuguguguagagaggcuugccaaggucuggcagucaguugguggcaggucugaggcuagaagcucgguucugggcacucucuccacccugggugcuuucagugucuggugaguggcuguguguagaauggcaggcaaggcuguccauauccagaaccuccuggagccuccuggaaggucagagggcuuuagaaacaaucucagggcaucgcuggauccguaaguugcaguguuuucagaguucccuuuucuacucuccuguaucucugcucuccccucugcacgcacaccuucaaagugccuacagcuuuucaggcccagcaagaacaaggauugggcaagcugccaagcccaaugcucagaggaaaggaaagaaaacagagauguguuugaaccuuccagcucagugugccucuguuuuuccuuugacaggaaaucgaugauugucugguccaagcaaaagaccgaaguuacgaugcccuugugcacuucgggaagcggggcuugaacguggccgccacagcggcugugauggcugcuuccaagguacugugcuggaaguaccacaacuacaugagucucagucccucuagugugcccugcucaucaccugugcgaccacacagaacaggcuaaggaccaaucagugguuuuucaucuuuuagggguccuuuugaaaaucugauggaaaaaaaugcugaaucuugccccagaaaauucucaccccccaacacacaugcccacauacuugcaauaucaagagguucccagagccccugaagcucaucugugcgucccagguuaagaauuucuaacuuauccaaccccacuggaaacaagaaaauaauagaauuucuaacuuacuuggcacuuaggccugggagaaacagaagagggcaggggagagagggagagagugcuucucugcaguuuccuagggugcacugggagagucgccuaaaugcaguggacagguggagagacuaccugagcaagcggguggacucacucacgaucauguggcccagcagauccaggggaaggaacccagguccuagaauaaguugagugguccagacauggaggucaguaaugugccaagccauaacaacugaaguggaggagguuugaaauaaacaccagucugugggauguuguggugugagcauuacuucuuucucuauucucuccagcccuuuucaaaacuguguuucuuccuagcaucuucucauaucacccucuuguugucgucaauuugucauuauuuacguagaucugaaaaguuaaauuggucagauauuuccucucaugugaaaucagcagaucauccuaguguuccccagggacaagcccuuccccaacaaccauguguggaguagggaccuacauucggcuggugguggagggaaggcaguuaugcugaugauuggaaagacacagugguugggaggugaguuguauuagcauaaggaaguuugucccuuguggugaugugaggguuuuggggaaggaggcgauggggcuuaaaagguuugcaagaagaugauuaguacagaucuuggugcucuaugaacauugugcggauggcaggauggagggugcugagagccaguuucaagagacugagcuggguuuuccuugcccugaaccaaagagaagcacauuaggaucauuucuggaagagacucagcacacugggccggguaguugcuugaaaaguaccuuucaggaagccaaggaauucugcagacaaagccuggacaagagggaaggggaaccaaaaaugaaugauuccucuuucagacaagaccagcuccaucuauaacacagaauuguagcuagguaucccgccacuccauguggcagaucucgggguuggggguccagggggucucugccccuuuacuauaauagcugcuggcaaaaugagggaucccagugaguaucuuuggaagggaaauucugcuuugguuucccaagaucaaucaggauuuaugaacagcaauaaauuccaagaaccuucuauuugagaugcaaccauuuuaugcuuuaaucuuuaagcugaaacaaaagagaacucagaauugcuaaauucugaauucaucaggccaaccuggcaacguaaagcuacggaaacccugucucagccucucucuaccccaucuguucugccucugaagccugaggaaaacaggcugcugcucuuuccuccauucauuccuggaguauaaacgugcuauaucugucagggugguucagugugcgucaccugguggcacagcugcgugcauguagauuucauucugacaauaacuucugcaggccauccuuuucugggucugccucaagauggagccuccagagucuuccuaucauccuggccagucacugccuguccccuaaccacccgggaagcccgugagcccgucuucuccauccaggcaccuuauagcagcugaaaccuaaaagaagcgccagacagucugaaaguugccucaggaaauaacugcucauuaguucuuuccagcuggacuaacguagugagggacaucugcuuucuguugaauuugguuucagaugagaaaauuuucugccuuguggggcuuugcuuuuucucucuaaauauaaauaucuggagagagaaaacacauauucucuucuaaaaauaaugcccucuauuuuugaaacagauguguacuuaaaaaaaaaauaaaagaagaaguaaaauccaaaaauccaaucuagcugagguguacaucagugguuuccauagcaacaguggaucacuucaggccuuggucaaaggaugaugacucaccaguggguccaaaucuggcuugcaugcccaagccaccuggagagcuuugcuuuuuauuuuuuuuuuaauagauucucagaugugcugaaucagaaucucaggcagugggcccaugaaucucuauuuuuaacaaguuccccagaugauuuuuaaacagccagcucuguacaagucacugccugagaccccauacagaaccauagggggcacaggugaugaggguuaaagcaguuaauuucaguaacauuccuggaaugcagauucaccuccuuggaagccuuaaccuugagaaugaggaaagcaguggcgugugugugggaaccgggcagcggggagggggaggccgguguuuauuucuccaaaauuuacugccaguugagaaauacuaugaugggacuacaaauucucccacuuuuuuuuuuuuugagauguagucuugcucugucgccuaggcuggaguauagugguacaaucucagcucacugcaaccucugccucccggguucaagcaauucucccugccucagccuccugaguagcugggauuauaggcgccugccaccaugccugucuaauuuuuauauuuuuaguagagacuggguuuugccauguuggccaggcuagucuugaacuccugaccucaggugauccgcccgccucagccucccaaagugcugggauuacaggcaucccaccucuuuuguagugcucccaagagccuagcacagugccucgcaccuggcugagcccuuaucaaucuuguugauuacccaaggggaauaauuagagcaacugucugaaaaaaagacacgcugcaaagucacccauagcuggggugacuauauaauuuauuguucaaaccaggacacauuugagaauguaaagcaugcuuauaauaauuacucugaaacaacaggucuaaacuaggccuguuuggccagucaugguggcucacaccuauaaucccagcacuuugggaggccgaggugggagaacugcuugagcucaggaguuagagaccagcuuggguaacauagugagacccugucucuacaaaaaauuaaaaauuagccaggcaugguggcaugugccuauagucccagcuaccugggaggcagaggcaggaggaucaucgcuugagcccgggagguagaaacugcagugaaccaugaucacgccacugcacucuagccuaggugacagagcaagaccuugucucaauaaauaaauaaauaaguaaaauaaaauaaauaaauaaauaaauaaaauaaacuaggccugucccaaggaaaccaggauuuaugaucaggugacuccuggcuucauuuuaaauuucuuggaccugccugucuucuccucccacaaaacacccucaacuuacaaaucaguucucacucucaguaucuacugcauuuagugaaagggaugcaagagagaguguugcauggugagaauacucuuccuuaggaucauuccuggaagagacucagcacacugggcuggaauuacaggccaggauacagauuaguucugacagauuaaauggaggcugggauaaaacgaugggaugaaagaguaauuccuccuucugucuucuuuuuuccauacuucagugacuuucuaggaggaaacuauggagcuuaaacugaagaaugaaaaaucuuuugacuacacuuuuaguuaauccuuucaaaaauaauguugagcccuguguccuuucucuaauaaaauuaauguuugcaggaguguuuuuuguaucaucaugaauuguggaaaaaauuuguaaaccacauuauuauauaaauagaaguccuggccaggcaugguggcucauuccuauaaucccaacacuuugagaggucgaggcaggcagaucacuugaagccaggaguucgagacuagccugggcaacaugaugaaaccccgucucuccuaaaaauacaaaaauuagccuggugugguggcaugcaccuguaaucccagcuacucggaaggcugaggcaggagaaucacuugaacccgggagguggagguugcagugagccacugcacuccagccugggcggcagagugagugagacucugucuaaacaaacaaacaaaaaacaacaacaacaacaacaacaaaaggaaguucuuauuaauuuuuguuuauauaaggucuuucuauguugcuuaggcugaccuuguauuccuugguucaagugauccuccuaccucagcauuccaaguagcugggauuauaggugugcaccaccaugcccagcuuauuaauguuaauauuacuguuuugucuuagaacuggaagagcuaaaacaaacaaaaaacaucaggcaugagaaauuucuuccagggaauuuaaccccuaucccacccucaauuuccuacaaggcuaaccccuauccccgggaaguguugaugcaucuuucuuugagugaaaacugcugugcguccuuccugaggaaacacuucucaagaacccucugucucagcauuccuagucucugcuggcucugcuccuacaugguaccugucuccuaacugguaauuccauccagagggaaaacugaaccccagaucuuuuuaagacuagaaaugaaaagucucucucuuaaaaaaaaaaauaaugcucuagaaauuuauuuguuaagcaaaacauauucucacaugaaaaauaaaccauaggcuggccgugguggcucacgccuguaaucccagcacuuugggaggccaagacgggcagaucaccugagguuggguguuugaaaccagccugaccaacauggagaaacccugucuccacugaaaauacaaaauuagccgggcgugguggugcaugccuguaauccuagcuacucggaaggcugagacaggagaaucucuugaacucaggagguggaggucgcgguaagccgagaucacaccauugcacuucagccugggcaacaagagugaaacucugucaaaaaaaaaaaagaaaaaagaaaaaaaaagaaagagagaaagaaaaagaaaccauagugagacgaaccacugaacaaaaauuuuaaaaccauggggucuccaggcuaccuuacuucccuugcaguuugaaccacauacuagguuucuucugccugcugaauucucagaccugguaaaccaacauucauuuuucacuugucucauaacucgaaaaauaauguuuuaguucccccggagaucuugucuccagaacauuuccaguaguaccaauacuauuacuauaguccaccuauugaagaaagcugcucuaaguaaaaccagcauucugugaauuagggauucuucucuugcaguuuguuuucagaguuguguuuguguguauauggcuccauccucccccauccccaaaucugguauuguaagcuucuugagaugaggggcucuggcuucuuuuccuuuguuucuugcuuagaaaauaaacaaaaacagaacaaugcuuuguuauuuagugcuuugcacucauagcuauucauuaaaccuuguugauugauuugaaguauauaccuuuuugauuccucuaacccugcccugucuaauaugguauccacuugccacauguagcuguuuaaauuuaaauuaauuaaaauugaguauaccggcugggcacaauggcucaugccuguaaucccagcacuuugggaggccaaggcgggcggaucacgaggucaggagaucgagaccauccuggcuaacauggugaaaccccgucucuacuaaaaauacaaaaaauuagccgggcgugguggcgggcgccuguagucccagcuacucgggaggcugaggcaggagaauggcgugaaccagggaggcggagcuugcagugagccaagauagcaccacugcacuccagccugggagacggagugagacucugucucaaaaaaaaaaaaaaaaaauugaguauauguuggggaccagccucaacaccacccauaggguagcugaaguccgguggcgacaaaggaaugagaagagacagguuaagaguuccuaaaggugggagccagggggccaguugcaaaauggaggcugcaaaaggcccagaguucuggucuccacacuauuuauugaguacaaucacuuagaucuaagaagcagauguucagggcaaaacagugaaaaggaggcagugcgucauaggugcaaucuauagcaguagugguuuaaaugaaucuccuuugugcucaaacagcauaucuuuaacuuaucggagaguagcuagugggagcgggcuuaaccaggagccugcacgucuguccacauuccaguguuucaaaggaguguccuucuccuugaacacaguguuuacagauaagagagcaggucucgcucugagcaugggaacaugauggcaguuaggaggcuuuccuccuuagaggccucuuguggcuuuccacaacuuauugucccauauuuuuguggccaguuuauacaggcaccccacaagcccuuuucccaacaguauaccuaaaauugaauuccucaguuguacuagccccccacccccuuuguuuuugagacggugucucacucuugcccaggcuggagugcaguggcacaaucucagcucacugcaaccucugccucccagguucaagcaauucucccugccucagccucccgaguagcugggauuacaggugccugcccccacgccuggcuaguuuuuguauuguuuaguagagacaggguuucgccauguuggccaggcuggucuugaacuccugaccucaggugaucugcaggccucagccucccaaagugcugggauaacaggcaugagccaccgcaccuggcuguacuagccccauuucaaguccucauuugccaguauggcugauagcacauuuccauuauugaagaaaguucuuuuggacagcacugccccaagcccuuuguuaacccuccaggguucuccuuugccuguuuuucaccccuuugcccacaguugcucuggcuucaaaaggacacccaccccuccuuaccuacucagcuccuuggggccucuguauauaagguucaccaggagcuggaaacucagccuauagcagcacccaugcuguagcucuuauuucuucuuccucuuuacuggucuggcccgcuuucacaccaugaccucugcuuuccugacuugcucucuaaaacucaggcacuuggccugcaauuauagucagcggccaacaggcgauagccaagcguugguuauagcccuuagcaucugaacagccaggcacaauccacugagaguuauauuauuuuguuuuucuacuuaaaaaaaauuuucccacucuuuccuuaaaaagaaaaagaagaucuacaaaacagucagcacaauagaaaaaaaaaagcccucucccacauauccuuaucuuuuauccaucagugcucuaucuaaaugucuggcuugaauaaaauacugcuuuuaaaucaccaugaaacuauuuuuggaaucaaaagcucauuugaggaaguucauaagcccagugauuugggguuucugaccugacuggagucaguugccuugccuuuguuuugcuuucuagcaaaaaaaacuaccuguuaacaauuagucagagggcaggcauugauuuucuuuuuauaaaaccucccugugucagcucauacuuaggagauauuuccaaggacggagaagagaugacugcuguccccuaaccagaucuguauguuucaccucucuggcuuuagucucuaccaucuauugaaucaaagaggguaaggauuccagaaagcccuauguuugucucuucaucccucagaggagcauuuccuggccacugugcuagcucacaucaaguuagccuucuuucuucauuuuuuagccaaggacuaugugacaugaaguuaauauuuagaauucaccacggcaaccauuuuuaaacaccaagauuaucuaaacuguauggacaaacugcugaaaaaguuuggaaguauucccuacccuccagucucccaaauauuagucaacucguacccaaguuucacucucaaaaugugucgaagcagaaccaagcaagacuuuuuaccagugugcuggauuccggcucucccaguguuucuaccuggaguguuaccucaccucacacugcuccaugcauagugaaguggauucaaaugaaugaaacacccacaucacacucagcugaagaggaagggccaggaauucacacggaguuggcgguccgacauuacuuaccugcucuguucuguggcuaccuguggagauugugcagccugaugccucaaggguccaagaggaaagagggaagccugccugccugaccucacagggccugguggaaccuagaggucugaggaaauauuugaggaucaugcgugagugggaagggcugucucuuggcuguggugacauggcaccuccucguucuccucuucucucugauuccccucucauguuugccuccucccuccuuuccucacgccucaguguuagaugaauuucucugggccccaccuuucucuccucucucuccuagcaccaucucauccugucccucaccuuccgcugucaccugaugaccugguucccagaugggcuucucugcccagggcucaauccaaguguuccugguucucugcugaauaucucccuuguuuccuucauacuuuaguugacaguccuguaacuccaaaucugcccuuccgugugucccaccauucugaugauaaugaaauuaccaucuugucaggcacccaagcuccaaaucucugucaccuuugaugccccaccuuccucccacuuacucuucaagcccuaaccauuugacaucccuucucugcauuugggccuuccuccacacccuuccuucuagcuuggacucuugcaguagcuacccaaauggucgacugcucucucccuuccuguuuaaguccuguacaguccgacccugauccuagccuuucagucuugucucuccuuaccucucuggcucuugugauaacugcauucacagaacugccuucuguacuguucuggaaauagcaacucugagcgcuguuuccagaauuuucucuuucuugccucugccuuugcucauguuggugcuucaucugccucuguuucuaccucuuugaaauccuccccacucuuccagguuaaugccaucuccuccagguuaaugccgucuccuccaugaagccuccucugaucccagguagaacuggccucucacuccuggguccucugcacuaaugucaucauguauaugugucuuaccugcaucuccauaggugcucaguaaauguuaaaggaaugaaagacuguugugcauauuuuuagcugccaugaccaacagagcaauacuuagaaucaaggauauccaaaguugggcuuuggagauaagcagaccagguuuaaaagucccagcucccugcuuacugcugcaccucugugaaccucgcuucuucaccugcaaacagggaugaucauaguaccugccacaggaguuaugaggcaguguaaagacuucacagaaugcagaguuuauaauaaauguuuaauaaagguugccuguuauuugcucauaugucaguuugaucucaggcugauuaugaucuucucuuuccucacuguugaacagaauaaaaaaaaaaaagucaggcccuggcauugggacguuauuuacaaggcaggcucuucugcacaggaggcugacuugccugccuuguccuggcccaccucgcaugugcugugucuuccugcgcaagccacgcuccccugggcucaggguuccccacuguucugggccugacuuuucauaggggugcuucuucuuccucuuccacccugagguguagcuuaugacacaugagcaccugccaccugccaagacaggaggaaggucaaacgugggcugcuggagcagcuggaacccucacuucagggaggaaaccaagcagggguuugagugacuugcccaaggucaugcagcuguuaguuguugagcugugaucggcaccagggucucuaguuccuccaguguccuugcaucacuccaagcacuccccaccccaacacauacacccuaaacugacacuuccuggcuguuuugugcuuggauuacacuaccaggcccugguggcugaguaccuggacugucccucacugaggauuuuagagucucucacaccccaggguacugcucuucugaugaucgaucagcucucucuuggccuuguggugaggcugggaaacacuuaaugcagggugaaagaaugaggaucacaaguaccugucaccguaagucacaguuucuguaaagcucgaucacgugcgauagcgugggcauguuugcacaccaguauaauuagagcucacuuugcaccagcggcugggcagauuuguccugugggucccccuucccacccuuaguccuuccugccuucucauugucccuuuccagcagggccuuugccucugaaggaggaaguauagaugaggcaaagcuuccagcugagacuuccacaggcaaggccaggggcagcugcuguauguggagggucccuccugguggcccugacuccccaucaccgggcaagggccuggcucagauggccgggcuuggucuggcuacagagacccaacucaccugagcacugucauuggucagcacaggccugucuaaccucccaggcuuccacuccucaccucccauccagccugcucugaaccagaagcaccaagcccaccucccucaccaguuaaugcuuguucuugccugcugucucuccuuaagggcacuucccagaaaggagacuagaaaauaccgucuguauuccagauaaccacgugccugcugcaaagugagagaaauggggagaacagauacugggugcaaguucuugguaugugccacguggcauaucuaggauguucucaucauucaacauccugccuccuucacacugcucaccucucaaaaaccuucaguggagugcucaguuuauugucaaaaaccaaguuuaggcagcugaagcccaguucucccaggcuggucuccuuuuacucacuggcaccaaagccucuucuccccagguggguucacucaccguuucccaggugcaccuuggguuuucguccacucucacgcccuggcccaaagcacuuccccgccagcacgugccuucccccgcccgcuucagaggaugcagcccucaccucacuccucacucggguucgaccccuugugugagaggaugaggccucugcacgugcucagccacggugacggugccauccccugcccuguacucuggcaugauguuggucaucuuugucacuuguggccuggcaugcacuuuugugucuugaugccccaacuagacugugagcuccaugggagcagggaccguaccauccucgucuuuguuccucugcggugcuucacgcagagcuucgugaacacuccagcagcaucuguugcaagugagugaauaaaugggugagcgagcgagggagugaugggaggaaagaggugaggacauggcucccuucaacuccauuuuauugccuuggugcccauggcuuuuuucuccuuuuccccuuuaucagguggcucgacucuuucauuuuaucuucucuuuggaccugagagaagggcagguaacccuguugagaggugugacuaacuccaaacugauccaguugggcagcgaggccaggccaccggcucugcucaccagcacguggucuggaucagaggcagguguccccccugccucggcaccugcgugugcauguguguuaauccauguggggcacacggagccaggccccacuucaucgucuuuccagagacucuuauggugugaauuugguagcaucuaacaugugauuaacuuacuuggguuuuuucuuuucuuuguuuaaugccuggagaauggauugaauuugaugauggaugcuauugcaguagaaauucuccuucucuguuugguuuguuaaucccauuuugugucacagacaagggccugguccucaugcagcaugucauugggagccugcuuggcuuggauguggcgcauguauggcuguggaggcucacuccaccagugaggcgggcaccccaugggguuuggaaggaaguacuaacuccuucugaauuacuggugggaaaugcgguugugcugguggcuuuguuaucaauuuccugacucacuaaaacccuuugucuuuauuguuguuguccucaguagcaggcauuagauauugugucaagugagaugggcuaaacuucgugcuuugcuggagccuuccccugugacuuggugugucccucuggaaaagaggaccucauuaagggcucaacacucauucgguuucuggagauaccaugugcuccuucuuaguucuguguugcuguuauugcuguuuuaauuacuccuaugucuuuuuuuuuuuuuuuuuuuuuuuuuggucuagauggcauuggucagcaucaugcacacuguauauucacaaaaugagguccucagggugaccuugagugagugcuguggguguuacugaaaauuaaauuguacugauuuuuuaaagguaaugcauguucuuggugcagaauuauaaaaggacaaaagagaguguccagugaagaguaagucuuacucuuaccccugccuucuacuggcaugguuguuuacgaagaaaccacguagccuuucugcaggcauuuccgcuauucagauacaucccuggccaugaacaagguauaaguggacccccauccccuuagcacacaaaacuacaaagaccucacuugggguggauugaaguggccgcucucaguggugacaaauacuaacacacauuccuucuuuuucuaccugguuucuaucuucaccuacccaaguccuccacccacccaaguucaagcgcagucuccucugggaugccuugccucucugaugugugccuucugcccugugcacccacagcccucugacacuucuuauacgcuccuugcagacacaucucaaggcuuguucagcaggauccucuuucaggucugggacccuggcugaugcaucaggcugagguggggauuucccacugucacgcuucacccaggcggcagcuccauaaauggucauacguucauucaugcaacuccuuaaccccaaauauguaucaaguagaguggcagaugccaaggcugcaauagugaauaaaacagacaauagcaauauuuaaauaucauuguguggaguacaagagagaaguacagcucaaaggcuguagugacagcauuuacagggaacugggaugaguagagaaagcugcucugagaagugcaaccauauuucauugaaucuaaaaagcugugguuucugagacacaucauuaucuuauguuccacuaagaaagauaauauugccaauuaaauuaggacacaauguuuuuucacuuagaauguuuauuuauuuauuuauuauuacuauuuuugagacagaguuuugcucuuguuguccaggcuggagugcaauggcacgaucucggcucaccucaaccucugccucccggguucaagcgauucuccugccucagccuccagaguagcugggauuauaggcaugcaccaccaugccuggcuaauuuuguauuuuuaguagagauggaguuucuccauguuggacaggcuggucucaaacucccgaccucaggugauccacucaccuuggccuuccaaagugcugggauuacaggcaugagccacugcgcccagccagaauguuuauuucuucuuaucaaaaagacucuuagacaucuuuuuuuugucacuuuuauaaauacauuaaaaggaacacagcugggcacgguggcucacaccuguuccagcacuuugggagaccaagguggguggaucaccugaggucaggaguucgagaccagccugaccaauaaggugaaaccccgucucuacuaaaaauacaaaaauuagccgggcguggugguggccaccugugaucccagcuacucaggagucugagacagaagaaucuuuugaaccugggaggcagagguugcagugagccaagauugugccauugcacuccagccuggcugacaagagugaaacuccaucucaaacaaacaacaacaacaacagaaaaaacaaaaagagagaaagaaaauaaaaaggaacgcauuagcacaauaagugguuaagaucucucuaaccucacuuuuucacuuucagagucucccgaaucacuuuucagcucggcgugucaguauccacuuaugaccaugccauaucauucucuguuccuucuaguguguugggugaugucgagcuguuguuucugggauuuucauucaugccaguuuugaugcugccacuuucuugaucauaccagaaagugucagugagauauguguuagacaacugagauucauauuccuuucucaaacaguucuuaaaugguuuguuaauuaaacacucaggggcuucaguuguccaguuaugccagggagaauaacaaccaaguauaucuauguguaggcguugacaaugaugucagggcggcagcaauuguaagacccaccccaauuucagagaugaaaaauacgucuuaaaauugaugaaaaucugcugggcgcgguggcucacgccuguaaucccagcacuuugggaggccaaggcgggcggauuacgaggucaggagaucgagaccauccuggcuaacacggugaaaccccgucucuacuaaaaauacaaaaaauuagccaggcgugguggcgggcaccuguugucccagcuacucuggagguugaggcaagagaaugcgugaacgcgggaggcggaguugcagugagccgagauugcaccacugcacuccagccugggcgacagagugagacuccaucucgaaaaaaaaaaaaaaauugaugaaaaucauuuucaagaagucuaggaguagguggguguugucauuauuauucuggugacuuagcgaugucuuuuuaaauuuuaaaaauagaaacgggaucuaccuauguugcccgggcuggucuugaacuccugggcuccagaaauccuccccccucauccuccaaagugcugggauugcaggcaugcaccaccagaugggccuucucagagcuuuuaguaugauaauguggcucauggaauuauggggaauaugguauuaaugcuuuccaaauuuagagaauccaaauuuauuuccccaaaguagggaaaccaauuuugcagaauaccaaugaacaacucgugguucuucccagaagacaauggucuagaauaacaaagauucugcagagcggagcugaacagacaguguggaaugggguuuguggaaagugaauaggaaugagauuuuguguagagacugagaagggcugaaagguuuacaaaagagagaggcauguugauuuuuuuuuuuuuugagaugaaguuuuugcucuuguugcccaggcuggagugcaauggcaugaucuuggcucacugcaaccuccaccucccggguucaaaagauucuccugccucagccucccaaguagcugagauuacaggcgugcaccaccacgccuggcuaauuuuauauuuuuaguagagaugggguuucaccauguuggucagccuggucucaaacuccugaccucaagugauccaccugccucggccucccaaagugcugggauuacaggcgugaaccaccgcgcccggucaggcauacugauuuuaaccaucucagaguguuuugaugggcaagggcuaauuuguuuucaggagucuuguaucuaugccacuauaauuuccucugacacaggccuagguugauacugagcuauuauuaucucccucucuuuccuaaccucugccacugccagugugauauuggagcuagacuggcuggcuucugggaguugaauggagcacuuugcuaaaaugaacguguacgaugccugcuguugcuuucucucacauauguugcugagcgacaaugagcaagaacuggcaaacuguguugagggaauucgucccuggccguuuauuugggcuuggggucaugaagcuuaggaagugaccuuuuccaccucugcuuucaauagcaaccuuugugucuuaggcagcuuucaauagcuuucaauagcaaccuuuguaucuuaggcaguagccacagcaucaacaucauuaucaucauaguugacauuuuugaagacuaaauaugcaaugggcuaugugauggguaucuuaaggauguaaucucauugaauccgcacgagcagccggccauuuggauccucuucugcaaaugaaggucuugagguggagagagguuaagaucacucagcuguugaaugacagggcuggaauuugaaucaaggccugacucaagaacugcuguucucaaucuucacuuucuguagcuucugcuaggauacuucuguguuguaucuguacauuugucguucuccgcuuucucagaaaucaaacuguauuuuugguguuucauguuagcaccuagcaccauguucuugcccauaaaaaguacuugguaauuguugaacaaguaaaguaaacgaagaaaugagaggaugaaugaaagagugagucagugaacaguuugcuugaacacuaaccuaacauugaguuacucacuuauaauuagcagaauauuuucucacucauuucagaaucaaguuuuguuccuuagucaucaaauuucuucuaaauucuagaugcugccuagaauguuucugcguaaaauaaucauggaucauuggcugcuauauuugaagggguuauauaaugggugucuggcugguccagccuccauuuugcuggcagagaccacccagcuguuccugccaaggacgugagaccuuggacccuugcccaaccaucacucuagagcagugucugaggcaaccagggugauuucugucuuuuuucauauaauauccuccaaauacuucuuggccuggacuuacaauucuuuuuaaauaguuuucuuuguguuauuguuguugguuuccuggugacaugguuuuuauaucuuugguagguugggaacagaucuaguucauauuuuagugcaucuugcuuuuagucuggcacuucuuucuuucuuuuuauuuuuuugagacagggccucacucuguugcccagacuagagugcagugguaugaucccggcucacugcaggcucuaccucuugggcucaggcgguccucccaccucagugucccgaguagccggaacuacagacauauaccaccaugcccagcuaguuuuuaaaauuuuuuguagauacagggucucgcuuguugcccaggcuggucucgaacuccuggacucaagcaauccuccugccucagccucccaaaguacugggauuacaggcaugagccaccacgccugcccucuucuggcguuucuucuaaaccugacugcaagccccuuuuuuucccccuccccucuaaugaacucauuuugcgucugcuccuugauccuaucuggauuuuucacuucagcgaauugcugugcuuuguugguucauuuucauuauuuuuuauauuaaguaaaaugaaaaaaaucuuccaaacccuucucucaccccugaaaaccucuuacucaacuguuuuggcccuugcuuauuucaucaaucccaccagcagcccucuugucagcggcuugaauugauuuugugcugauuuguugguucuguuaugucuguugugcaguauugucccccugucccccagaucucugggaccacucuuuccuucauuauccaaguggcauagaaaaccucucccaugccacugcagugccaugcacccgagggaacccugcacacccuccaggcuuucuucuuucugaagaugucugaguucauucauuugccugguaguuacuugccugucacuucuugcuccaaauccuagccgauucucaauuuccccagucuccucccacucucagguuuccauaaccucucucugcagccccugaggcacacuuaaagcaaugccaccaucccugagccuucacugugaucauuuucacucugacacauucucucauccagacagugaggagcugcucuuucguaaguaaaauggauugaucuugcuuucuaaauaaaagaacaauuccccccgagauuaauucucugucucccucagaauaugaaaugguuacaaucagcaggguuuuuuuaaaucauuuuuuuccuuucugauucauuaccuuuuggguauuuuaugaagcugaaaugcaccagcagaaguaaaugugccucguagacaguaauaugcuauacaaauaaaagaaauuucuguugucaaacauuuagaaaaauauugucuguauuuuguguccuuugaaaauaauaagaaccaagcacauagaauauuagguuuugauugccugaccagauucucauguacugagaaaaauggagauacauguggauuuuuauuuaugcaaagcaagagaagcagcagguggccuggaaggaguaggagcugcaggcaguagucacgcccuuggcccugggucugucugaggcuccggaucaucaucguaucaucguaucaucauaguggugucugaggguagggagggauccuggagccaaaggagcaauuacugagccccagaggaggcccuggaaaauuccgggauuugacccucucuguguuuccagcagcuaugucugggcaccugcgccucagaguugauccaggucuugauuuccaccuggcugaccaucagagcucccucuuggccuuugucgagugugaccuguggagcaggaccucugacgugugccccuccuguguuguauccagggacagggugccuuaucggagagacugcggagcuucagcaugcaggaccucaccaccaucaggggagacggcgccccugcucccucgggccccccaccaccggggucugggcgggccagcggcaaacacggccagccuaagauguccaggagugcuucugagagcgcuagcagcucagguaggugucacuuuacuuccccucuuucccacuccuugggccucgcuuucauugagagaggcccaguccgcaguguggcaugcagccuggcccuggccccacggaccugccaccaacgggguguccaucagaucaugccaggucagccaaggggcggagcaccccucaggcccggccaggaaaccagccuggugacugaucagggacagggcuaggucaccugcaccaaaggguccccuuuccuccauaugauugucuggggaauuggggguaguugggggcuagugucuaggcaaagccuggaggcagcaggcacaacuggaccugggccccgggagccuucuguguugucuucucagacuccggggaggcauaccuguugauaccuaaguguugucuucucacccggggcuuacugcucucacgggcccucuucccugccugaauauugccuguccucucucucacucugcugucuccuucucaucucugaccucucauguaccucacaccacccccagccucugcauaccaagggccaugcuagcucugaguucuuguuccuguggugaccaggaccuuacaguaaccacaccucugccuccaaugucugacucuggugucacacgcccaucgugggauugcugguauugggacugaccuggggaccucguuaaacaugcaaaguccugggcccauccgcagaggcuucaguaggucuggggugagacccagaagugugauuuucauugagaugcagccguguuugggaccccccgacaucggauccaccagcacggguuucaggcucauggagggugggggcacacaguuucccaggcugcuccuugggaggaugccaggggccuugggucucaggggcugagcacagcagcugcccaggacugauggugggggggugggggacgguucuggaucaccacuucugccucgcuguggugagaagggugggaaucuauguccacaaugucugucuggugacugcguggcccuuaaaucuauaaacagagaugucuggccaccugugacuaugcagccugcaggggacaccuuggccauaagccccauguccugacagaccccaucugaugcccgggggucuuagccaucaacaggaaggcaugaggccugcggcugccugggaauggcaacucaugcucagagccaagugcagcucagggcuccguccauuuccucccucucagcaguguccccuuggcccuucgcaggucuuaagacuguggcuuuucuguugggagauguuuuaacccugucacugcuggaagcagggcaggguuggggagguggaggcucggcugugggggugauggccaccucagggagggguuaccccccgagggacccccccccaggaauggaaucccaaaaggccagacaggaaaugaccucagggaucuuucagucaaacccagugauuuuacuggugaagagacagagguccagagaaggggacugugcagggucacccaugcugggcugcaguagagcguggccuucugacuccggggccagugcccauggucacucacucaucaaccauccaggcuuugucaagcaucuacagcuucugaucugccggacacugccccagaaauagggauacaaaacagaguuaagucucaucuccacacugcaucagcucaucaucuaccaagccucagaugaaagcugccccuuagauggaaaaggggccucaauucaguaaaacccagagggcagagagcaagaaccaguggggugaaguucgaaggggguagccacuugcucgccgcaugacccgggcgagcuauuuaccaucucugcacccuagauuucuuaucuacacaaggaaugacaccccuuuguagaguuguugugaggcuucaaaugaaaccagccaugugaaagugcuuauggccaugccuggcgccagugcauaguagcuguuaucauuguucuuuuuguaauuugucucuccugagaaggcgcauugucaugcugcaaguguccaggagcaaaaugggccaucuugggagguagugaggucccugacauuggaaggacacaagccaaagcuggauggucagguucgagggagggauuccugcuuuggcuaggaagcgggcuuagguggcccuggcgucccuuugccucuaagagucuguguugccauuuuagaggugagcccaguggaggaagcaggcucagagagguugugcacugggcugaggcccccaggcccagaauccaggccuccugccuagaccuccccuggugaauuauucagggcagccucagaacugggaaugcaagaagcuggcagggucugcagggagauggcagugucuucugggccuggaguaucuucccagcccagcaucagguagaaaagcauuugggaugauuugcuuuggcacuggcucugccacucuccaugagcagaggugaugacguccccugccaugccccagggaggcaguggggaguguucuggcugucccaggcugagaggaccagcugugcugcauuaugccccagcccuccucacugcuggcccccuuggccuccgcaccuaugaccacagggggcaaagaggaaaggugcaacccagcagggaggccaaggacaguguagugcucuuuccagcuguucuggagccuaaaauaaaagccaucucaaaaaggaagacaggagcuggguguagugguucacgccuguaaucccagcacuuugggaggcugaggaggguggaucaccagaggucgggaguucaagaccagccugaccaacauggagaaaccccgucucuacuaaaaacacaaaauuagccaggcgugguggugcaugccuguaaucccagcuacucauggaguagcugaggcaggagaaucgcuugaaucggggaggcggagguugcagugagaugagauugcaccauugcacuccagucugggcaacaagagugaaacuccaucuuuaaaaaaaaaaaaaaaaaaaaaaaaaaaggaagacaggugaaagauggccuggggcguggauauggggcagaauuuccugggucagaggcucuugggcuaucauacccugaaguaaggucaacaugccuaggaggaagucuggcagaggaagccaauuuauaccgggcugguguacucuccccagcucagcccccagugugggccucagaugccaggccagaucagguagcagaaagggccccagaaaaggggaagaggcuagacuucauccuggcugggugaugccgggccugugcagacacagcaaaugcagcacagcaaggcaugcuccuuccuccugagccucaauucagccucagaacuucucucagaacaacccaggcagucgcuaccauagauuuggccuuggcacagaggacagaccugauucccucaggcuuucuucuuuguaaaaaagaccgaauagucccuauucagccuaugucuuaggguugugaggagagcaaaccagagaauuugcaaacccuggacagguggcagggguugaagacaaccuggagagaggugggagcugcaccucguggaauucucugcagcugcuggaagcaacagauuaagggugcacacaguggaacuugaaagcaugaugccaggugaagaaaagugcaaaacagaaugagauuuuaucuaacaauuuauguaaaaaauauaugccuaucaugcaaaguaacaauacggaguuuauaugaagaacauguucaaacaaaaaguugcacauuaaaauauuaaaagugacacuccuugaggaggaaggagaaugugaguggggugugggaauaaaagucauguaaaggcacauaaaaaggguugccaggcgcggugacucacgccuguaaucccagcacuuugggaggccaaggcggguggaucaccugagguagagaguuugagaccagccugaccaacacagagaaacccugucucuacuaaaaauacaaaauuagcugggcgugaaggcgggugccuguaaucccagcuacucgggaggcugaggcuggagaauugcuugaacccgggaggcagagguugcggugagcugagaucaugccauugcacuccagccugggcaacaagagugaaacucugucucauuaaaaaaaaaaaaaaaagugaaggggaucccaugaaccaguguggaccauuugcugugagccaagaagggacauccaugugaccuccugcaucuugagaaaagggaggaagaugcacacaaacgaggaagggaggaaggggcacaaagacugucccugcacggucacucagcgcugcaagcuccuggcaggcagacaaggguucugugcuucccucuguaaaugccuacccaacauacucaccacaugccuggcacacagagaccucuguaugugcagugaggacacagggucuaggcguuggagaaggggaaggagaguucuuuccuguugcuuucagcacccaggauggggcugggcaguguacuuggccugacccucucucuugccuggaguuuuccucuuugcuuaaagggucagggcaggcagggacugacauggcccucccugcagaaugagcuggaagguguguagucagauaccauaugcugaaugccuagcacuggacaccaggaaguguacaagaaauguugaaagaaugauccuggccuuccauggacuuggagucacucagugagcauguauuuagugagcaccuacucuauugccaaggcccagaugugcaccaagaccaauggcguguacaaggcagcagccaguuaggccuuugcaaaugcccagaugcgaagcacuuugggguucagagguaagucuggggagguuuccuggaggacauucugaacuggaaagcaaagagaggaggaggcuuugggcaggggugcuuggaguuauuuuccagagggaacuuugacucugucuccggccuucccuagggcugcagggugcaaggacugacuuugugugccaggugaggguaucuucugcaccugagcagaaacugaaucugagaugacucuuuccccacuuuggugucucuacagagacccaccuuccugggaucccuauauuguacacacugggauccccacaccucuccagggccucccuguuugcccggggcugguuccuguccagugggggaugucacugauggugccccuaccccauucccacaguguguaccugcugcuccaccugcaggaccuggaaaggugaguaagcagccagccucuccgcagcgugcuggacucucacucggaaagagcuucuaaccaggagugggcaccugacccuggggcucccuuucagcugcauggucauagggaggggucaggagguuaacccuuuauaacagcaaacacaguagcuuacaguuccugugggcuagaaaucugggagcagcuuaacugggugguucuagcucagggucucucaagaggcugcagucaagaugucagccugggcugaguuaucggagggcuugacgaaacuggaggguccacuuucaagauggcacucuuauggcuguuggcugggccucuccaaggcugcuuaagaguccuuacaacguggcagguggccuggccuagagugagccauucaagagauagagggcaggcaggaagccaggguaccuuuucuguccuagguuuugaagucacacucaucacuucugccuuauucuauuuguuggaagcaagucauuaagcacagcccacauucaaggggaggagaauuaaucuccaccucuugaagggaggaguaucaaagaauguguggagauaucuuaaaaccaccacagggucacugggcgggguggcucaugccuguaaucccagaacuuugggaggcagaagugggaggauuucuugagcccaggaguucgagaccaaccugggcaauauagcaagaauuaaucucuacaauuaaaaaaaaaaaaaagccaggugugcuggugugcaccuguagucccaacuacuugagaggcugaggcaggagaauugcuugagccugggaaaucaagguugcagugagccaugaucgugccauugcacucaagcugggugacagagcaagacccugucucaaaaaaaaaaaaaaaaaaagaaaagaaaaagccacaacagggucauacuuccuugugcuccagguaaggacacaggaacuucagaggacuaagguccucugaaaugaugaaguccugaaguuccagggguuucugguccuggggcagccaagggagcccuguuccugcuuugccacuuacuugcugugcaacuuugcgugaaucaccuaaccgcugugagcuucaguuccuccucuuaaaacggagaugagaucccugcuucccggccucacugugcuguugugaaaguggcugugaaagggccauaauaauccugggaaggaugaugaggaugaugaugaugaugaugguggugguggugguggugaugauggugguggugguggugguggugguggugguggugguggugauagccuggagcauccaggagaccccagggagaguggaggucucccgguucuggacagagacuccuguugcugcccucccagcgugugagugauggcuuguuggagccacagccaccuggugguugccaugaccugcuucuccaguugccuaaccuuaaguagacacauuagggacuagugaggguccuggacuaauccagugccccuuucacacugccuggcuccccauagagaagcugccuuaggcuuggaaggcaagaggggccgugccuggccugcagccugcuggcuggugucaggggaggaaggaaggcacgcaaggugccuaauauagcuuuugcuccagcccuggugccgcggaggcaugacaugccccucccacaucggcagugagcaagacaggaaacugcauuaugugacguguccuguuuucccugcauugcuuuauuuuuaaggcucucagugcucagcuuuuuaaguccuuuauagaagagcuggggauuaggacaggcgcaguggcucacaccuguaaucccagcacuuugggagaccgaggcaggcagaucacuugaggucgggaguucgagaccagccugacgaacauggagaaaccccaucucuacuaaaaauauaaaauuagccgggugagguggcacaugccuguaaucccagcuacucgagaggcugaggcaggacaaucgcuugaauccgggaggcagagguugcggugagccgauaucaugccauugcacuccagccugggcaacaagagugaaacuccaucuaaaaaaacaaaaaagcuggggauucuggaggccauaaggccaaacugaacugacagaggagucugagcagggcugcagauggagagaagcgucccagcccagcucugacuaacccugugucccuguggggccuccugguccaaguuggaaaugaaggggcugcguucagcuguuuccagcaccgggcacuagacgcuggccugguggacacacuaguucaugggaaaugacccuguggugccaguggcuccaggcaauugcagggauuucugucuauucacacuguaguuuugagucugcaaauucugugagccauuccaaaagccucuaauucugggagauuggcacuugggggucggggagaguggcugcccuguccuccauucuuccccugacacugcucugugcugcucucagaagcccuucccugccaugacaucuggugguuucaugaucagacacaguguuuccagugcauuucaauagagcugugguugauuguaggaacugaauaguucuggaaggcugcaugugcauaagaguguguccaggauucaguguccaaguucugguuccuuauccccgagcagguugguugcugcugggauggggguugcuggacagcgggaagcaggugaggccuggugguggccucaagaccuggaagccguuguccuagcccuuccuuucuuggaccuccgccucuccaagggccucuuaauaccugugcccuggcucucaggucugcaugcaaggaacccuuugaugauuggccuacaccauucccucugaggccuugggaaagccccugcacucugcaggccucagucucccccuccaugaggugucccuugguccucccagcucugacagucucuacuggauugugcagugguggcagaugguguugggggaggucugucuugcaccuggggcuauaggcugacucuuaagcaguaagaggauuucacaguugucggggacacuuuccuccugguccccugaaauguugucacaaggggugcucacucaggccaaagccugggaagauucaaauuaccucuggggccaugcagagccccaggaucccucagcagacaggaacauuuucuaggaguuguaaauucaggucuuaauucaugauggggguagggaaaggaggcauuucggaggcugcuaagugccuuuuagggcagugacagagcuuagaggccccaggggcagcagccucuauucuaagcugcacaucucagaugccagaacauucuuuucccaucuuugcucuguuccugccccauuugucaacugauucccuauuguuuucugcaugucuuugucucucuuuuucugugugucuauuauuaucucucucucucuuuuuuuuuuucucugccuaccucuaugucauauagaacugaacucuggauuacugccugugugguuagucauagaggugucccucccccccuuuuaaaaucaagcauguaggacauaauuuuuaaaagcagucauccuuuuuguccucucagagagagagagagagagagagagagaauugcauuuugaguguggccucugggcaguguccuucugauuauagcaggaggagcugccugagguuuagagcaugggaagugagugagcaugugugugucuacauguguguaugugagugugucugugugugaguguguguggauggggaugugugcauggugcacacgugugaguuuuagugccaaagacccuucucuaacggaauguucuuuucucucuccucggugcuguuggggacguggauguaaguguuccagacaggcgugcucuucugcagacauuugcugccuuccauuaaugcucccgcuaaugugugcugugugggauguuuuugcuaaccugggggagguucugcugcacugcaggggugcggcagcccugggcccacugcaggcuacacaggccuuuaaagggcugagaggcucugccaguuucucccucccucccuuccccacagagagaagagguggagccugcagcccuggcugcuguagcccugcugacacauuugcuaauacagaaacaucagccaaggccacacacccauuccccugcuguggaagacggcagaaacccugcccuuuccuagaagcaacccagcuuugggcaucauaguggcagcucugcaggcucaaggccguggccaccaucaccugagguuugcaaguuguuauggccaugaccuugggcgggagacccuccucccacacacauugucucugggagccaauuagaguacuaagauguggauagcaauacucuuucaggccuguugccagggguaaggaccuguugggucaccaaucuuuagaucuucagggacaagaacauggaggaggcagagcaugggauuuucuacccagcuacucacucuccugcuccuccuggugccccucuuuugggacuauguucugugggguucauuucuccauuuauacuccuuccugauauaaaaaggaguuaggucuacuuguggaaauauaucuaaaguagcaaaucaaaguaagaaaauugaagcauggggagaagggagugggcaaguaagauggaaucaguggggagaaggacauuuuaaaugcauaccaucaagguguagacuguugagacaccuggcuuccuugaaaccacugcaaagagggaaauacaauuauuaagagauucaguccacugugcaacagccagcuagaggcguggaagcuugucuuauuuagaauguuuauucucacugguucugagaguaaggcaaauauuauagacaacacucuuggcagaaaugcucagcggacacagugacuaggagaugucuuaucuucuuaggagguucucucuguagcuucuuccugaggcuauucuggcucccucacugcccacacuggccucuuuugcucccagccucugcugagcugagcacuuguuucuauuccugcuuggauaucuggguuguccuugaaccaucacuccuacugggcuggagggucauuucuuuucuacccugcaauccuugcaguggagaacaugcacaaagccauuuugguuucaguccugagauuauagugaugauggugauuuugguaagugugaguucauugcucagccucagugaauccagacuggauaacuagccuggguuguuagaugccugaggaucucacggugacuuugggccaccuucugacacccacaaccaucaguacagggaaagcccuggaccuggauguggaggguacagcauaugcagaggcacagucucgaaccgguacccaccccacuuccaugucauggaguuggcugcugggguggagcuggccaggcugcuucugcaguuuuugccuuggucugagggcuuuuggucuuuuuucccuccugccaggcaggagguaucuguguccagaaggaauuuccugguuugguuaaugggggugucaagcucugacuugggacuagagcugagcucucugagaugacuucaggauucuauuuaguuuaguugaugaguggccacugugugcccagcccugggucaggugcucagagagacugagggaggaucagccauggccccccagucucaggaugccuucuguuggcugaggcaaugagacugacaugaggaccagggcacccaacacaagcuguguggcacagccuccaagcacugucgggucucagaguggggaggccagggagggucagaguauucagcgagggcucccuggagucacuggucuuugugcucaacaggaugcagcugauuaggacagaggaagggagcagaggacaaacuaagcccagaguaaauaagcugagggaagugcagaguagaaauaaaauaauaauaguaauuuaaaaaucaaaggaacaucagugaucucaggacuuuacuuacuaaggcccagucugaaccaaucacaccccagccuaaaauucagcuuugcauguugugcugcuuccugcuggcuguuggggagcacagcagugguaacugguaaagcugcccaagauuaggguucaguugucuguuuuuuuacuccacgccugguggugguauagucuagcaaguccacuguugauggagagagagcacauucgguggcugaauauguucuuaggagcagggugucucaagaagagcugugguuucuaucuggaggccucacggugauuggaccagaugacuugagaaccccuuagucuugcauucugugauucuagguaaaaacaauagaugcagcauagaaaaaugugugugugugauaccagauaagcuggguaggggcagaagauauuuuacaucucaacuaagaaccgccuagcagaugacauggaauauguauuagcauuuaacauuuaaaaaauacugugcguucaaugagaugaauuaauucugaagcuuuucccgcagauguauucaaggcagacugaaacaggaaucuugcuaucauuuuuuuuggcagaggcaucugucagauucuccuuccuuagguuucucugcuucucuaggacugggccuucgcaaaaaaaaaaacaaacaaaaaaacuauauagcuuuguuuaagguuaucacuuaaggccuccuggcauuuuauauccugucucuuacaggaugcuuggaauugaauaugcaaguauaauauacaaugucaacauggcuuguauguacaacauagaaacugcucucccaccccaccccacaucacugcugccauccucucuagaggagauucuuucccugagcauucaccuggugugggaucacaggacugagcugcagggauugaugugucucaguuaaagccgcuucuuucuucacccagggaagugaugcccccuuaguaaaucuacugaauuacucagaauucaguagauucugagucugugguuguuucugugcacagugccuggagauucacacaacugcacuuucacaaucccagauccccuguaaggaggcccccaaaacaucagugcuuccucagaccgaggggccucagcuguccucacaggccugguuugcugugcugugugccuaaccuugcccuucccugcucccugcacugaugcuuccuugcuauaccuugucucaucuguguagauuguaaauggacauuaagugguugagggagaugugaaugagggugguaugaaggcaugggagccccaccagguccaaaacccauuggcguuuucugacgacgaggaggaagaccugcuggauuucauguacaaguauaaagcaccucgaaggauggaauugccccuggagguacacagugucuggggcuguggguuggaguguguuuguccaaaggcuaugcccuggagauuggggguccugggagcagcaucucuuggggcaccaacaucuccucaauaccugggguggaaagaucuccuuccaucaaacaagcagaaccagucacuggauagcauccagcuacuugccaaggagaggaaauccuauuaauuucauuuagaaauaggagcgugagccgggugcaguggcuuaugccuguaaucccagcacuuugggaggccgaggcagguggaucaccugaggucaggaguucgagaccagccuggccaacauggcaaaaccccuuaucuacugaaaauacaaaaauuagccggguguaguggcgcgcaccuguagucccagcugcuugggaaacugaggcaggagacucgcuugaacccaggaggaggagguugcagugagacugcacugcugcacuccagccgggaugacacagcgagacuccuucucaaaaaaaaaaaaaaaaagaaaagaaaaacaaauaggagagugguaaaguaucuaggucuuuauuguuuuguuuugguuuuuccagguauuaacaacuaccacucuaaguugacguacaagugaaaaacaacccaaauugacuguuuugggggaagaaaacucagaauguguuauuugaaaaguuuuuauaaauaagaacaaggcuuguucaucgcuguaucuccaagacacagcauauagugccugguauaaaguagcuauucaugaaauguuagugaagggguauagcccuuuaggguuaccaaaaccaauacccuugacauauaugcuauuuucaguuguaggauguggauggaguucuggcagcaggagggcugagccuggagccuccugggccuugcucugugauguggguagggagucaccagucaugagcacaggugcagggaccccagucuuucucucugcuuccuaaggucuccucuccuauuccccaucugcugaguaucacggccugagaggccaucugaagcaaauaggaagucuccguacagacccuugugagacuuauauggggagaugccuugaaauguucccuucugcagacacugagcagccuagcauucuuauuuguuaggacuguaauuaugaccaccuccaugugcaguucaucagguuccuuugcaaggugaggcacacaugcaucccuuuuaaaguuagaggguuugggaaaggauguucugggcuuggacacugcuggaggagucuggccugggcaaucuggccugggcagccuccugauggggagaggagcccagccuaaagaauucuaaggcccaaggguuugugcuguuuugcuuuuguuuauuaaagcugcacaaacugcuuuacuguuuacaguucaccagccugccaagaggcagauuacuauaaagguggguuccguuguuuccguuuucagugucuguccagagguggcugguaagcauuuccuagugguaaggcuguagcaugaggacucuaugagagggccugagucuuguuuucuggcucauucacuuccugccuuguaugugccugcccagcacugagccacuuaccaggaaaugguggugaaugcgacaugggccugcccucaggaaguccccagucugguggggagagagugagcagggcccccacacacucccuucccacugggugcaaaguccucugcugggggacauguacaaaacaugagagaacaaaggaggugacgaugccugguugugcauggcugggcaguggcaggaggggcuccgggaaaccuuugcagaagugacuuuugagcuggguccucaagaggccuagaaauaugcaagacagaggagggagggaagggcuuccagucagaaggaauagaggcaugaaugggcacaguguagagaaagaaguucucuguguauacagagaaguggacagacacgggggccaaggguagguuggggccaguugugugaacccccucaagugcugugccagaaaauguucccuucacuuucauugaaauaggaacuccuccugugaucuguguaucccauggaaggaggggucucuugagagucauuugugggagagaugagguggagcccuucauauaaguugagcaucccuaaucgaaaaaucugaaauucuuugaguguggacaagacgcacaaaggucaugcucauaggagcauuuugaaucucagauuuucagauuggggugcucaauuggaauguauaugcaaacaucccaaaaucugaaaaaaaaaaaaaaaaaaucugaaaucccaaacacuucugacuccaggcauuuccggauaagggauauucaaccuguacuucaaggugguguuugccuuugugguguggugugcuguacauuaagagguuucucauccagaaaggggacuggaaauuugaugauggaaauuugaggcauguaccaaaacacauuaggcugguucccaaaggaaauaacaaaagcaaaggaagcaugcggaggugucucuuucugcugaaucauuuaagauaauuuugcuccucaggcagaaacaagaaagaugugucauucugcacaaccguucccuugggagauugaggagcauaauuuaagagggaggcaucagccucucaaagggcucagcuucaugcgauaugugggaugggacucugaugauugcuuccuguugcggagauucagggagaccccagcccuagccagcugcauuuggccaaaggagcuggaagucucaacacaaugccuuccaggugcugaccucaaaagaucccacauuuacaccaaacugagggacaccuuucuguuuucucuaccaggcaccgccuagaauccuucgaucucgcuucaggaagaaaaguaccucauccucggccaccgaaaccacgugagugagaugagccaacagcaccggauccacagaauguuucuucucugccuuaaagagcuauucacuaauaacauagaaauccgcaagcugggugugcuuugagugugcagccucacaaacauggccuuuucucucuccccuuccacuuuuaaggauuuauuuuuuucccccuuuucuuuauuuugcuggggagaggcuaaagggaaagguaguaggggcggggguggugaccuuuaagucuucugagguugguaauuuuccacaauuggauugucauuauagacagcaguguguuuuuuagaaagauaagagaaucaccccuaugcugcugagauguacauuuguaauuuaucuguugcauacuuaguuuuuaguccuguaaaugcaaacacagcauuuuuuacaacuuucuuuguucuugguacuuauacuuugaacuaugauguacauauuuauggcuuuuggcuuuuaauauaauggacuugcaagggcugccagagguucugauauguaagaaaacugcaaaaacaaauauagacaaauauuuugauucuagagaacgucucagaugugcuuauaaagcuuccaaauacaacuccaguaagacaucccuuucccugcaggaguguggucuauauucuuuagauaguuguuuagucaaaagaccagacaaguuacaaacuaagagaaacaauauuucacaacacaguaaagugugaugagaggucaggggaacaucccaguaaaagagaagagucacaggaagcucaucuccucccuggauucuggauuaggagcuucugaaucuuuuccagggauaggcagguagcucacucuuggugcaauuucuugaggaugggaacauguagagcugcuggaaggaguaauucugugcuugacaaaggacgauuucuccuuuaucgugaccagugcugccgauuuccugacagaggagcuuacacucugagcaccuuguuuuagcgaacucuagcaaaacuuguuuagcuuagcaaaaacaaacacacaaaaaacugagaacucugcuguuucagauaugccauaacauacaucugaaacacauguguaacaaucaaaauggugggcucuagaaugguuuuggagcucgagaucuucauggguuagacuugcuggucagacccaggagcaccuguggcucacaccuucuguuccccuccuggccugugcagaauguaaacagcagacucauacucaaugggcacuacaggccuuaucagacguuuuauacaagccuggauugcuuaguaggggaauaaggcauucucugagggggcuuuccacuuagauugagaauuuuauuugaaaagaaucugguuuaaauggcauugugguccgagguagcugcucuccccacugagagcugagccgaaauauaagaauaauauauuugugcuucgaguugguguuucuuucaguguaaugcaugcaguggucacaacccaguuacucauaauauuuggauuguauuuguucguagauaugcccagaagacuagagaauuaguguuauauaccauauagaacuuacugucagucaacuauaaacaggcccaauuaaaaacuguuccauuacuacgcaaacacauauuagaggccuuugcugaugacacauuagcuggaucuuagccaccccagaaaggguuugauuugaagcugauuguugccagauaugcauauuggaaucccaucuacccauaguuccucugaaggugauuuuguaauuugcaaaaggguauaggaaaauauaccuaaaagcgaauuuguggcugagaggauaaacagaagcuguuugcucauguucugugccccacacccaccaauaccuaaaucuguuaaggaagacagaaaauguuuucuuugugcucauugaguaguuccagacagaagaagaauauacucuuuaaaauguauuuaccuguuaguuggaaguacccagaauuaucagaaacgaaugcaaaaaaaaaaaaaaaaaaaaaaagcuuacacagcuucuuagcaauuuuuuuuuuuuugccgaaacaauaaauugccuuuagcagcaguuuaaaauccuaucgugaacaaccuauauuuucgccauuuuacaauggagaguugugacaaguacagguuaucaaguuugcacuuaacuaugccaaaaaaaguuugaagcgcucuauucucagacaugcuguauuauuacuucucauucaagauugaaaaauauaaagguauccaaacucugucuuaauguaaauguaacuauuuuuccuucaaguguugacuagggagucgguuucucucuuaaagacacucacuguacaacugaaagcagcugucauauuucuggcaaaauguguuuacguaucugacaaguuguacauuuguguaugaacugacauaaaaugugaaagccuguaaguguacauguaguggugugguguucugucuagaggauacaacugaauguuuuuaauuugcugacuuacagacacaggcuguuuacaaaaugcuagcuggaaagucuguaauguucaugucauaacuuuuaguuaauugccauugagcaccuguucugaggaggugagauguggacuugugcuuauaaacuggagaguuuagucauaaucccuccuggcuuugugugaauagcuugcucacuuugcuggccuuugaaauguguucuccgugauaagcuauccauguguuugugauaagagugcuugucaaccaugaccaucuuugagccuuccuaguccuccaccuggcacaguauuugaaauggcaaaggaugugcuucauccucuaacaguguacacucccagagcugauauucuggauuuugacugugcacauuuccucuaguucaugucuguagucccuauagaaugaucuguaauaaaauaguauacuggacugugcaucaaagggauguaaaauuacaguauuccaaagguugaaguucugcuguuuuguuauaaugccugauacacaucuugaauaaagucuuaacauuuuucuuuuaa

SEQ ID NO: 191622 - RNA, 13922 nt, Homo sapiens
uggaaauccauucguuuauuuacugagccugguccaaugucaacagaacuaggauuaacuagguuaagaguuggcaaaggacaggaaagcaaaguaauaaaauuuaaaagcugaauugguacaguguuaugaagaaguguuuauuuaguauuuauaguaccagauuacagucacuuguugauuuagauaugaauuuucauauguuagaagacucagggaaauacacaggaucccaaggagugagacugagauucugggucuuauuagcuguacuuuggguaauuuacuuaacccucucucagcuucaguuuccucaaaucuaaauuagggcuuaacuaaucauuauguccuuuguaagacuggaaauguggauuagcaguuagacaguauguauguacccaguuuuguagauaugcugggacauaguagguguucaauaaauuauacauauaccugaauaaacaaacuauacauaaauauuuuauaaauuauacauauaaucgaacaucauuuagguaaacucuuuaaugaaagacauuuauugucagauuauaaaaucaguguugaugauaagcccuccuacccacaaaacaaaaaucguauguaugaaauucccuuucccguaaguuaugugccugucagccaucccacuucaguccaucuuuggaugcugaggcucugguugccaguccuuaucucuacaccugucccuggucuagaggagaaacgaaggugcucugaggccccuguaacagagacccuugucauccauauuugcaauaaagacaucauggaggcugugcaaaaguauccuucuccccaacuucugcaggcaccauuuccaucucacuacccagagguacaucagagagcaggagccaggcaggugacaaagauguggaaggcuucuaagugguuggcuuugccgucucagaagugcgaagaaaugaaaauccaucaaaacagaaugccauuccauguuucaggcuuuuaccucaccucaaaucaaaugucuguucuuuauuuauuggucccauaaguagacacgcacuuggacuucugguuuuagaacauucuauuguuauccuuucuccuuuuaauaaacacacacuaguuucgaggaaucucccuaauaauccuggccugacaugcugcagaacuucaauuucauaauuuuacuaacaacagaggaauuucaucuuauuauuaccaacuaccacauuaaaggaucugaaacaguaauucaugcauaauucuauuuaauaaugguuuucaaaguacuuugcuguuugaaaaugcuucccagaugauucugaucggagaguugggaaccacugcccuagacuguaaccacucaauugaacuuuacucagugcugcuucccugcccacuucaaguaaacaaugcuuaacuuuuucguuucuaaaacaacugagauuacuuucucccccuuaguuucuacaaugauuguugaaaauuugugggaaaaguuuauccuuacaaaugaaaacaugaaaucugaaguggauaaacuaacuuuuaagaaauacauauccuuacucaguaagcugaggcaggaggaccacuugagcccaggagugcgaggcuucaaugagcuaugauugcaccacugcacuccagccugggcaacagagcaaaacuccugucucuagaaaaaauaaauaccuaucuuucaaaacuugcauaaaaagcccuugucuucacuuguacagccucuucuguuucaugaaugagcaugcugaagggcuauuuacucuccuaugaaaaaauguuguuacaguaaaugacaaguguuaugaacacaaugaaccugguguguuagauguuaagugugcugccaccccaugugaaccuccaagugaaacugcucacauaacuguuuuuuugcugcaugcaaaccugcuaauacaaagcgggcuccugacuuaaggacagccaaucccuacucuagacaaugacccaaccagaccuaguauaaaaagguagucuggcccaguuaaauucccuuggcaauuggagacuagcagcaggagcugaaggucaucauguagaaaagaaccucaaaggugcaaguuaaaguuauuacaaaggaacagaaacuguaaguaugcaaaagcuguguagagaaguuggugaauagagagaauggaguuaacaaugcaaaaagaagcaagucacaugcaugcagagcccaagccuaaacauccaccuuccccugcugaggagcaccacccaauuucuacucuuccugaggcugggaggugauuucugagugggagaugggguuggugaggugguuccugaauucccuggcacauauccuugaaauaaugucacauugcuugagcuaacuuguagcuuuugagucuuuuuauguuugucccacuugagauuccuugcaacuaaaagagcauaacugaaacaacuaguuaagccaauaccauuuguuaaaaauaaugcaccauucuaaauuucuguuucccuaaccaaaucuggcaaagucugauccauuaaguuuuaaaacuuuucuaaguuuaauguugucacuguauguuuacguauucauugguacaauuuacaucaaguuuuguacuuauccauuuuugcaaagauauguacacaaagauacauauccaauaacugagaaacaagugaaacuucugaucuauacuuucagguuuguucgaucaugauacuucugauaaggaucaucaacguaccaguuucgccucuuccagaaggacgucgucauuuuaucuaagaguuuacucuggguuuuauugcagaauacaaauucccucaaucgcuucuuccuugcaggugucuuuuuccauaauuuuuucuuauagccagccugucagauauuacaaagaaauguaaaacaucauacuauguaugaaacaacagguaucuucacaacucaagguuuauagacccaauaagaacaaaaaccagacuuccauaggggcuggacuauuucuuggaaagaugugauucucaauggccgggggaagggaggguggcggggagggggauggagaaagcauguguaguuuaaaaaagaauuaguaauaaaucauauuuuagaaaaaaauuauuuaaauuaaacucacagaaaauaaaacuaaauguguguggcugggaaaguacaagauaaugacagaauuauaaucacuaacuuaacagguaugaucuuacuaucucuucagcaaucuuuaacaacauacuauuauucuauuuuacaucuuuaaaaaaagaaaccauugauuagagaaguagcagacagaggucugagggcuaauaagaguucuuuuuuuguuucauuuugagacagggucucacucugucacccaggcuggagugcaguggcaugaucacggucacugcagccucuaccuccugggcucaagugauccuccugccucagccucucguauagcugggaccacaagugugcaccaccauacccagcuacuuuuuaaauuuuuguagagauaaggucucaccaucuugcccaggcuaauaagaguucuuaaccacugucuuuccuaauguagaggaggauggagugcaggcgagguaacaacauuaauauuuauuaaggaggcugaguauuacaagagcugagaagcacaguucucaaauauauugcuucauuuauuauuuucacacacaagggaccaauuuuuauaggaaguacuuuucuaaggaauuaugaauaugguaagacuauuauuaggaguggugaaggaaugguuaacccacauauuuaacccagaacuuucauauacacccauacagguauuauucauuuugaagaauuuauuuuuaaagacaggaaaggaaaauuugauugauuauaaaaacuauaaucauagccuguuuaaacuagaagggaucuuaggugccauccagcuuaauuaacaucuggcuaaaaccacacggugagcccuuggguccuuucaagccaagggcucuuuauggcacaauaccaacugaacaaaaccauggcucuuugccgagaaugugccuugcauuucugacaugucuuaguaucaucacugugaccaucaacuucuauaaggacagugaugaaauaaggaaagguuauuuaagaguucugguuuuagaaugcuagagguuagauuuuugcuacucacugcuuacaauuuuaaaugcaaacauuuaaagccaaaucuccacauuuguguaauaauuucauaguuugcaggccaaacuggguuacuauggaucucugacguacaaacaccuaauuuauugcccugcucauuaccaccaguauccuuuaaagauuauucacagaauggaaccacuaugaaaaugcuugaaauuuuuuagacaaucucuagauucaaaaauggaaggagggaaugaacaauaaauaccaaggacugcuggaugaaaccgugucauggaaaauacuuuguuuuacacauuaguuugaauucaucuacccagauuuuuuuuuucucugaaaauuagauuuugaagaggcagggcauucuauacaggguauacuuucgggagcccugaacugaagcuagguauuaugacuggagaguaugaucggguccuuuacaguaacaugagggccccagagcccaguaagagggacauggaaaggaaggcaaggaaacccacccauuucauuuuaccuagggcuagaagaggaccuggaaauaacugguauaaaaaccaaaggguggggcuaggcgucacggcccaugccuguaaucccagcacuuugggaggccgagacagguggaucacuuaaggucaggaguucaagaccagccuggccaacauggugaaaacccgucucuacuaaaaauacaaaaauuagccuggcaugguggugcaugccuguaaucccagcuacucggaaggcugaggcaggagaauggccugaacccgugaggcagaggucacagugagccaagauugugccacugcacucuagccugggcgauagagugacacuuugucucaaaaaaagaaaaaaaaaaaaacacauacacacaaaagggaagaaauguuuccaguggucucaaauucacaaaacucagaacauuagaccuuuaguuuagcugcuuuauggauuauaugagcuucugcugacugguguaggaaacuacccaccacaguguuucaauagagaaaugagcugagaguuccaaccaacccauuuaucuacuaauuuaguacuguuuauaaaacgggagaauccuuucaaccuuucaaacaucaagaaaguucuaccaacuauuuuauuuuuacagggaaccaaauuuugauuuuuaaagauuuaauuuccaaguaaugaaagggaauuaggauuugggcaguuacuaaaucucaaaaaugguuuugcaaaacuggucuuaagcugcuuucuuuucauuuuuugagaugaagucuugcugugucaccuaggcuggagugcaguggcgugaucuuggcucacugcagccucugccuuccagguucaagcgacucuccugccucagcuucccaagcagcugggauuauaggcaccugccacaacgccugaccucaaguguucugcccgccuuggccucccaaagugcugggauuacaggcaugagcuacagugccuggcugaauucugaauucuguuugauuuuaaucugcucacacuccuuuuuucuuuucuuuuuugagacggagucucgcucugucgcccaggcuggagugcagugguucgaucuuggcucacuacaaccuccaccucccggguucaagcaauuaugugccucagccucccgaguagcuggaauuacaggugccugccaccacgccuaauuuuuguauuuuuaguagagauggaguuucaccauguuggccaagcuggucuugaacuccugaccuuaugauccacccgccaaagugcugggauuauaggcgugagccaccacgcccggccucacauuccuuuuucaauuuaguaacagugugaagacucaccuuucuccucacccaaaggccacaaugaagucgaagaaaccuaucgaugacagcuuucacggucuuucucuugccuuuucuugcacugaaguauguuagagaucugacuggcagcuucaggacacuuggaagcacgggggccauucuaaaaauauauuuuaaaauuuuuagcuuguaaucagacugauuaaaggauuaaaauucauuaucuauacugagaaaugaguaaagcugcuccaauggacuggaacuaacuuuucauauacaauauuacuuccaaugacccaugacauuaagcauaaauuagaauagcaaccaucaccaacucgcaaucuucuaaaaccuacccccucaaucccuguaaaauaauucauucuauuaucaucgcuuuauuucuuauccaucuucccaccagauugcaaacuccuugaggacuucaauuuguuuacccuuauguccuuuuugccaaguacagugcuaggcacccagggguauuuaacugaguauuugcugacugaaugaccaacacaugcagcccauccuuauaagcugagcgucuugugcacccuccacuuuggaugacagccuccaugcaggaaagcacacauacaacaucagaagcaugcuguguuuggcauuuuccugcugcaggcgccuagauacauggaugucagucacagucucccacucaaucaagcagaugucuacauaauuaacugcagguaggcaaagaauaccaccuacuucuaggauaccccugcaggcaugaauaucuuggaaaguuugucuaagcaucauguuuauugaaauagacucuaccagccaggcacaguggcucacgccuguaaucccagaacuuuccagcuacuuaggaggcugaggcaggagaauugcuugaaccccggagguggagguugcagugagcugagaaugcaccacugcacucuggccugggcaacagagugagacuccgucucaaaaaaaaacaaaaaacaaaaaacaaaaaaaaccccacaaagaaauauacucuaccuauuaaggaucacugagguaugcccacaugucagguuucucucagaugugguaagucugggaguggaggaaacaacuggugucugaauaugacuaaaacguccaguggacaaugcagaaauaagagaggcauucuugacacaguugcgguagguugaagaugccaaaauauucaggggccguaggauuccuguaaagauaggagcauauauauuuaauacuccaaaauaugcauccagauauuaaaaauuaagagauguaucacugccaccaaguauuaaacauaauuaacgugcccugagcaucagacucaucugugaagcuuuuaccaccuuacuaagguauaaccauaaauuaauuacugauuuuauguauauaauucaacaauuuuuggaaaauuuagagagcugugcaaccaucaucacaaccaagucggaugucugcuagcucuauguccaguacuaagaaaagagauguguguaacauuuauucccaccucccagaucuuauacucuggugagacagaauucccacacacaguacaauggcaggucagggaugcaagagcauggacccuuccuggagagacaagaguggcgacagaaagauucucgaagaaaagagaagaggcacuugaguucucuagaaagugagcaggcccuuagaagaggaggagcacauuucagguaggacgaacaacauaagcaaaggcauggggacugaaacaaauacaggugacccuugaacaacauggguuugaacugcacagugccacuuacacacagauuuuuuucaaaaaaaguuacaccgaguaugccugccuuuccagccuccccuucuaacuccuccaccucuucuuucucugcaaucgcagagagagcaaaaccaacuccuccucagccuacucaauguaaagaugaugaagaccuuuaugaugauccacuuccacuuaaugaacaguaaccuauuucuuuucuuaugacuuucuuuucucuagcuuguuuuauuguuaagaauacaguauauaauacauauaacaugcaggauauauguuuuuaaaauucuuuuuuugaggcagggucuuacucuguggcccaggcuggaaugcaguggcacaaucauagcucacugcagccuugaccuccugggcucaaucuaucuucccaccucagccuccuaaguagcugggacuacagcaugugccaccaugccuaauuuuuguagagacagaauuuugccauguugcccagcccaaucuugaacuccugggcucaagugauccaccugccucagccucccaaaguguuaggauuacaggugugagccaccgugcccggccucagaauauauguuaaucaaugguuuauguuauugguaaggcuucuggccaacaguaggcuauuaguaauuaaguuuuggaggagccaaaaguuauacuuuuuuucaacuugauuuucaacugcuugggguugacaccccaccugcuguauuguuccagggucaacuguacauguauggguugaggaccagaccugccucagaggcugagacuguucgccugacuaucagagacgccuggggagaaguagugggcagugggguggaacaggucagaaggcagauuucagagagccuagaugugugguccggaugcaguccucuuaucaguccuucccacuauggccagacuaauaguucauggcugcaaaucggaaucacucguggagcuccgacuccacccauaaauucugacugaaguccaguuugggacucaaaauuguguguuaaaaaaguuccgcaggaugaugaaaauguccucagaacuuaaaguauaaaaaaaaaaaugcacuaauacaagacuaaaaaaaaaaaaaaaaguccuaaagcuggaaugugguaaugguuguacagcuugcuaaauuaauaaaaaaacauaaagcuguacacauaaaauggguaauuuuauggcauguaaauucuaccucaauaaaguugguuaagaaaaauacuccagccaggcaugguggcucaugccuguaauccuagcacuuugggaggccgaggcaggcggaucaccugagaucaggaguucgagaccagccugaccaacauggagaaaccccgucucuacugaaaauacaaaauuagccgggugugguggugugcgccuauaaucccagcuacucaggaggcugaggcaggaagaucacuugaaccugggaggaagagggugcagugagccgagacugcaacauugcacuccagccucggcaacaaaagugaaacuccaucucaaaaaaaaaaagcgaaaaauacuccaccugagucugaugcuuggcugggacuuagaacuacucuccuauuuucuacugcacugauuucagauaacaaaugaggggccauguugauauagaagugcuaggauuugaaugagaugauuugggcucauauucuagcucuaugacuuccuugcuguguaaccaggggcaaguuacuuaaccucucugugccccaguuuccucaaauuuaaaugaaguuaauuauggagagguaaugagacuugaaugagaugaagcauguauagugcuuggaaggguagcacagagaaaacauuuaaugaaugcuaauggcagauaauaaagaagagggauacuuagcaaagaugauacagguugaguauuaucugaaaugcuugugaccagaaguauuuuagauuuuuuaaaauuuugcauaaaggagauaucuuggagaugggacucaaguccaaacaugaaauucauuuguuucauauaaaucuuacacauauagcuuaaaguuaauuuuauacaauauuuuaaauaauuuuguacaugaaacaaaguuuugacugccaccgaucacgugagaucggguaaagaauuuuccauuugugggccgggugcgguggcucacgccuguaaucccagcacuuugggaggccgaggcaggcagaucacgaggagaucaggaggucaagaccaucuuggcuaacacagugaaaccccgucucuacuaaaaauacaaaaaaaaauuagcugggcaugguggcaggugccuguagucccagcuacuugggaggcugaagcaggagaauggcgugaaccugggaggcagagcuugcagugagcugagauugugccacugcacuccaccuugagcgacagagcgggacuccgucucaaaaaaaaaaaaaaaaagaauuucccacuuguggugucauguugguacucaaaaaguuucagauuaaagauaccuaaccuguauauuaauauguggccaucagugauaacagggccaggugugguagcucaccccuguaaccccaacacuuugggaggccccggcggaucaccugaggucaggaguuugcgaccagcuuggccaacaugugaaaccccgucucuacuaaaaauagaaauauuagcugggcagagugacgcgcgccuguagucccagcuacucggaggcugagguaggagaacugcuugaacucaggaggcagagguugcagugagccgagaucuugccacugcacuccaggagacagaaggagacucugucuccacaaaagaaaaagagauaacaauuugcaacugaaaaggguagcauaaacauuggugcagaaaacugaugagagagcccuuacauagggccuuggaaaucaaauaaguuaaaucgcaaagaacugaaaagaugugcagauguaauaaggcaggagguaaucuuuggaagauuaagugcauuggaggacuguagacaagaaaauguuccaauuuucacacgucaucagauuuugguaucucuugguuaaaaaauuaaaaccuaugaaauucuuuuguucucaauuuuuaugaagauccugaggcugcauaagacauauuuaucaauuuucccaaaaagcaagcugggaacaauggcuuguuaauguauuugugaagacacagaguaucagaacuccaagugaucuuaguaagagagaaaaacagaucaaaaccaacaagaugaaaucaggaauaaauacacugaaguuagaaaaaaugguuacgggaacaacaggaacugggaucuugguugagagcaguucaugggaaaauauguggggaggcucuaucuacugcgccuucugguggaucaaucaugugauuaagccugugagggaaaccuaacagucuagcuuuguuaacaaaagugcaguacaucaaggaaaguaacuaauuuccuucaguccucugccccgucugggcauuuucauacagacuagucuacucuaaacacacuguuguauagagaauacagauguuuucacaaaagagguaacgcaaaaccagaguuuugacagaguacgaagagacagagggaauaggacguacaaaggugacgauguacauuuggggaauuacaauggcccuauguggcaugaaucaaaggaaugaaugggggacaugaacugcacuggaugggaguggaggagacugugacaguaucgaaaccaggagucuucaagauuucugauccuauguuuccuaaaagaauuuugaaaaacuacccuuucacaaauucuuaauaucuaaaauaucaaauaguuuaaauuguuaaaaaggcuauaauuuccagcauauuuaaaauacugacauuuuaaaauaagcugucacaucacucuuuaaauuguuuucaguagaaucuaaauuaauaguaaguugauaacuaccuacaucaucuauuuaaaaauuacaagaacuauaaauucaaguagaugaaaaacaacuuuucgucaaagggcacuccaaaauaauguaaaaaagacaagccugagugggagaagcuaaaggacacacacaaaugaaaaacaaaaacaaaacaaaaaauacucuaaauaaauaagacaaacaauccaauaggaaaaugggcaaaauauuuaaguggauauuucauaaaggaaauucaaaaggccaauaaaaaugugaaacacacuauagcuuguuauuaaucagagaaaugcuuauuuaaaucucaaugagauaccauuacaaagccaccagauuaacaaaaauuuguaggucugacaauaucuauugacaauaucaauaucagguguuggugaggauguggggccucaacaguuuggcaauaucaggcaaugcugaauauauacauauucucugaccaggcaauuccacagcgauuuucacacauacccacauccucagaaacaauuggacucaugcgccaggaugagaucaaucagcuuuguacauaauugccccaaacuggaaauggagaauuguggcacagucauauaauauuauacagcaggccgggcaggguggcucacacccguaaucccagcacuuugggaggucgaggcgggcggaucaccugaggucaggaguuccagacuagccugaccaacauggagaaaccccaacucuacuaaaaauacaaaauuagcugggcgugguggcgcaugccuguaaucccagcuacuccaagggaaucacuuaaaccugggaggaggagguugcagugagcccagaucgugccauugcacuccagccugggcaacaagagagaaacuccgucucaaaaaaaaaaaaagaauuauauagcaaugagaaagcauuacagcuacgcaaaaugaaugaaugaaucucacaauguaaaagaagauacuaaagcguauauacuguaugaaccaauucaugugaaguucaaaaccaggcaaaacuauguucuugagaugcacauauggaugcuaaaacuacuauaggaaaaauaggcaaccuaauaguaacuauaaaaaugagaacaguguuuauaucugggggggaaguagagaauuuugauacauaggggagaggaggcuucugguagugcacuguuuugaccugaguguuaaacagguguuugcuuuagaacuguuaaaucauucaugcauacuauauaaaauuuucuucauauguauuauauuucgcgaacacaaaaaauacuccacauaaaaaaagcuuuucucuaacgguaaaauuuacaucgcugcauuuucuugacugaucucguauauucucccacaaaauguuauccuaacaauauauuuugugugaaaguaacuuacugagcauccuaugguauuuggaugauuuuuaacuuuuugcaaaaaguacuuaacgucacggcaacuuaauuuagucgccuuuacuucugcuaucucucagucaagaaguccucauaccagcccuugugccgggggcuguaguuaaaaauuaaauuagccuucaagcuuaccaugugucaggcacugcccaaaacgcuuuacgugcauuaucucauuuaauccccagguaggugguuaugacccccauuuuagagguguagaaucuuaaguuaggagacauuaauucucaagguuaaaggucgugaauggcaggucguagccucuaaaucagaaaguuaggugagacuuuuugguuucccucgcccccuccguuccaguuucucuggcuucuuuucuagggaaaaaaagcugguaaggaagcggcaaaugcgugacacacaggcccgcgugaguccgagucgggggacuugguacgggcugccggucacaccgccccagagaaaauugggcgcaaccuucuuaacuuaaauaaugacccuuuuugcuuguuaaccuccagucuaaacgcccauuccaucccgcaccaguuuccccuucugugaaggcaugcauggaguaugucgcucuccacugaccugaagcugcucucacugcaccagcaaaggcagaggcagccaucuucaccuucgccuacggcggccgcuuuggguuuaaaagcacaagagcaaaagagaau

SEQ ID NO: 191623 - RNA, 13922 nt, Homo sapiens
auucucuuuugcucuugugcuuuuaaacccaaagcggccgccguaggcgaaggugaagauggcugccucugccuuugcuggugcagugagagcagcuucaggucaguggagagcgacauacuccaugcaugccuucacagaaggggaaacuggugcgggauggaaugggcguuuagacuggagguuaacaagcaaaaagggucauuauuuaaguuaagaagguugcgcccaauuuucucuggggcggugugaccggcagcccguaccaagucccccgacucggacucacgcgggccugugugucacgcauuugccgcuuccuuaccagcuuuuuuucccuagaaaagaagccagagaaacuggaacggagggggcgagggaaaccaaaaagucucaccuaacuuucugauuuagaggcuacgaccugccauucacgaccuuuaaccuugagaauuaaugucuccuaacuuaagauucuacaccucuaaaaugggggucauaaccaccuaccuggggauuaaaugagauaaugcacguaaagcguuuugggcagugccugacacaugguaagcuugaaggcuaauuuaauuuuuaacuacagcccccggcacaagggcugguaugaggacuucuugacugagagauagcagaaguaaaggcgacuaaauuaaguugccgugacguuaaguacuuuuugcaaaaaguuaaaaaucauccaaauaccauaggaugcucaguaaguuacuuucacacaaaauauauuguuaggauaacauuuugugggagaauauacgagaucagucaagaaaaugcagcgauguaaauuuuaccguuagagaaaagcuuuuuuuauguggaguauuuuuuguguucgcgaaauauaauacauaugaagaaaauuuuauauaguaugcaugaaugauuuaacaguucuaaagcaaacaccuguuuaacacucaggucaaaacagugcacuaccagaagccuccucuccccuauguaucaaaauucucuacuucccccccagauauaaacacuguucucauuuuuauaguuacuauuagguugccuauuuuuccuauaguaguuuuagcauccauaugugcaucucaagaacauaguuuugccugguuuugaacuucacaugaauugguucauacaguauauacgcuuuaguaucuucuuuuacauugugagauucauucauucauuuugcguagcuguaaugcuuucucauugcuauauaauucuuuuuuuuuuuuugagacggaguuucucucuuguugcccaggcuggagugcaauggcacgaucugggcucacugcaaccuccuccucccagguuuaagugauucccuuggaguagcugggauuacaggcaugcgccaccacgcccagcuaauuuuguauuuuuaguagaguugggguuucuccauguuggucaggcuagucuggaacuccugaccucaggugauccgcccgccucgaccucccaaagugcugggauuacgggugugagccacccugcccggccugcuguauaauauuauaugacugugccacaauucuccauuuccaguuuggggcaauuauguacaaagcugauugaucucauccuggcgcaugaguccaauuguuucugaggauguggguaugugugaaaaucgcuguggaauugccuggucagagaauauguauauauucagcauugccugauauugccaaacuguugaggccccacauccucaccaacaccugauauugauauugucaauagauauugucagaccuacaaauuuuuguuaaucugguggcuuuguaaugguaucucauugagauuuaaauaagcauuucucugauuaauaacaagcuauaguguguuucacauuuuuauuggccuuuugaauuuccuuuaugaaauauccacuuaaauauuuugcccauuuuccuauuggauuguuugucuuauuuauuuagaguauuuuuuguuuuguuuuuguuuuucauuuguguguguccuuuagcuucucccacucaggcuugucuuuuuuacauuauuuuggagugcccuuugacgaaaaguuguuuuucaucuacuugaauuuauaguucuuguaauuuuuaaauagaugauguagguaguuaucaacuuacuauuaauuuagauucuacugaaaacaauuuaaagagugaugugacagcuuauuuuaaaaugucaguauuuuaaauaugcuggaaauuauagccuuuuuaacaauuuaaacuauuugauauuuuagauauuaagaauuugugaaaggguaguuuuucaaaauucuuuuaggaaacauaggaucagaaaucuugaagacuccugguuucgauacugucacagucuccuccacucccauccagugcaguucaugucccccauucauuccuuugauucaugccacauagggccauuguaauuccccaaauguacaucgucaccuuuguacguccuauucccucugucucuucguacucugucaaaacucugguuuugcguuaccucuuuugugaaaacaucuguauucucuauacaacaguguguuuagaguagacuagucuguaugaaaaugcccagacggggcagaggacugaaggaaauuaguuacuuuccuugauguacugcacuuuuguuaacaaagcuagacuguuagguuucccucacaggcuuaaucacaugauugauccaccagaaggcgcaguagauagagccuccccacauauuuucccaugaacugcucucaaccaagaucccaguuccuguuguucccguaaccauuuuuucuaacuucaguguauuuauuccugauuucaucuuguugguuuugaucuguuuuucucucuuacuaagaucacuuggaguucugauacucugugucuucacaaauacauuaacaagccauuguucccagcuugcuuuuugggaaaauugauaaauaugucuuaugcagccucaggaucuucauaaaaauugagaacaaaagaauuucauagguuuuaauuuuuuaaccaagagauaccaaaaucugaugacgugugaaaauuggaacauuuucuugucuacaguccuccaaugcacuuaaucuuccaaagauuaccuccugccuuauuacaucugcacaucuuuucaguucuuugcgauuuaacuuauuugauuuccaaggcccuauguaagggcucucucaucaguuuucugcaccaauguuuaugcuacccuuuucaguugcaaauuguuaucucuuuuucuuuuguggagacagagucuccuucugucuccuggagugcaguggcaagaucucggcucacugcaaccucugccuccugaguucaagcaguucuccuaccucagccuccgaguagcugggacuacaggcgcgcgucacucugcccagcuaauauuucuauuuuuaguagagacgggguuucacauguuggccaagcuggucgcaaacuccugaccucaggugauccgccggggccucccaaaguguugggguuacaggggugagcuaccacaccuggcccuguuaucacugauggccacauauuaauauacagguuagguaucuuuaaucugaaacuuuuugaguaccaacaugacaccacaagugggaaauucuuuuuuuuuuuuuuuuugagacggagucccgcucugucgcucaagguggagugcaguggcacaaucucagcucacugcaagcucugccucccagguucacgccauucuccugcuucagccucccaaguagcugggacuacaggcaccugccaccaugcccagcuaauuuuuuuuuguauuuuuaguagagacgggguuucacuguguuagccaagauggucuugaccuccugaucuccucgugaucugccugccucggccucccaaagugcugggauuacaggcgugagccaccgcacccggcccacaaauggaaaauucuuuacccgaucucacgugaucgguggcagucaaaacuuuguuucauguacaaaauuauuuaaaauauuguauaaaauuaacuuuaagcuauauguguaagauuuauaugaaacaaaugaauuucauguuuggacuugagucccaucuccaagauaucuccuuuaugcaaaauuuuaaaaaaucuaaaauacuucuggucacaagcauuucagauaauacucaaccuguaucaucuuugcuaaguaucccucuucuuuauuaucugccauuagcauucauuaaauguuuucucugugcuacccuuccaagcacuauacaugcuucaucucauucaagucucauuaccucuccauaauuaacuucauuuaaauuugaggaaacuggggcacagagagguuaaguaacuugccccugguuacacagcaaggaagucauagagcuagaauaugagcccaaaucaucucauucaaauccuagcacuucuauaucaacauggccccucauuuguuaucugaaaucagugcaguagaaaauaggagaguaguucuaagucccagccaagcaucagacucagguggaguauuuuucgcuuuuuuuuuuugagauggaguuucacuuuuguugccgaggcuggagugcaauguugcagucucggcucacugcacccucuuccucccagguucaagugaucuuccugccucagccuccugaguagcugggauuauaggcgcacaccaccacacccggcuaauuuuguauuuucaguagagacgggguuucuccauguuggucaggcuggucucgaacuccugaucucaggugauccgccugccucggccucccaaagugcuaggauuacaggcaugagccaccaugccuggcuggaguauuuuucuuaaccaacuuuauugagguagaauuuacaugccauaaaauuacccauuuuauguguacagcuuuauguuuuuuuauuaauuuagcaagcuguacaaccauuaccacauuccagcuuuaggacuuuuuuuuuuuuuuuuagucuuguauuagugcauuuuuuuuuuuauacuuuaaguucugaggacauuuucaucauccugcggaacuuuuuuaacacacaauuuugagucccaaacuggacuucagucagaauuuauggguggagucggagcuccacgagugauuccgauuugcagccaugaacuauuagucuggccauagugggaaggacugauaagaggacugcauccggaccacacaucuaggcucucugaaaucugccuucugaccuguuccaccccacugcccacuacuucuccccaggcgucucugauagucaggcgaacagucucagccucugaggcaggucugguccucaacccauacauguacaguugacccuggaacaauacagcagguggggugucaaccccaagcaguugaaaaucaaguugaaaaaaaguauaacuuuuggcuccuccaaaacuuaauuacuaauagccuacuguuggccagaagccuuaccaauaacauaaaccauugauuaacauauauucugaggccgggcacgguggcucacaccuguaauccuaacacuuugggaggcugaggcagguggaucacuugagcccaggaguucaagauugggcugggcaacauggcaaaauucugucucuacaaaaauuaggcaugguggcacaugcuguagucccagcuacuuaggaggcugaggugggaagauagauugagcccaggaggucaaggcugcagugagcuaugauugugccacugcauuccagccugggccacagaguaagacccugccucaaaaaaagaauuuuaaaaacauauauccugcauguuauauguauuauauacuguauucuuaacaauaaaacaagcuagagaaaagaaagucauaagaaaagaaauagguuacuguucauuaaguggaaguggaucaucauaaaggucuucaucaucuuuacauugaguaggcugaggaggaguugguuuugcucucucugcgauugcagagaaagaagagguggaggaguuagaaggggaggcuggaaaggcaggcauacucgguguaacuuuuuuugaaaaaaaucuguguguaaguggcacugugcaguucaaacccauguuguucaagggucaccuguauuuguuucaguccccaugccuuugcuuauguuguucguccuaccugaaaugugcuccuccucuucuaagggccugcucacuuucuagagaacucaagugccucuucucuuuucuucgagaaucuuucugucgccacucuugucucuccaggaaggguccaugcucuugcaucccugaccugccauuguacugugugugggaauucugucucaccagaguauaagaucugggaggugggaauaaauguuacacacaucucuuuucuuaguacuggacauagagcuagcagacauccgacuugguugugaugaugguugcacagcucucuaaauuuuccaaaaauuguugaauuauauacauaaaaucaguaauuaauuuaugguuauaccuuaguaaggugguaaaagcuucacagaugagucugaugcucagggcacguuaauuauguuuaauacuugguggcagugauacaucucuuaauuuuuaauaucuggaugcauauuuuggaguauuaaauauauaugcuccuaucuuuacaggaauccuacggccccugaauauuuuggcaucuucaaccuaccgcaacugugucaagaaugccucucuuauuucugcauuguccacuggacguuuuagucauauucagacaccaguuguuuccuccacucccagacuuaccacaucugagagaaaccugacaugugggcauaccucagugauccuuaauagguagaguauauuucuuugugggguuuuuuuuguuuuuuguuuuuuguuuuuuuuugagacggagucucacucuguugcccaggccagagugcaguggugcauucucagcucacugcaaccuccaccuccgggguucaagcaauucuccugccucagccuccuaaguagcuggaaaguucugggauuacaggcgugagccacugugccuggcugguagagucuauuucaauaaacaugaugcuuagacaaacuuuccaagauauucaugccugcagggguauccuagaaguaggugguauucuuugccuaccugcaguuaauuauguagacaucugcuugauugagugggagacugugacugacauccauguaucuaggcgccugcagcaggaaaaugccaaacacagcaugcuucugauguuguaugugugcuuuccugcauggaggcugucauccaaaguggagggugcacaagacgcucagcuuauaaggaugggcugcauguguuggucauucagucagcaaauacucaguuaaauaccccugggugccuagcacuguacuuggcaaaaaggacauaaggguaaacaaauugaaguccucaaggaguuugcaaucuggugggaagauggauaagaaauaaagcgaugauaauagaaugaauuauuuuacagggauugaggggguagguuuuagaagauugcgaguuggugaugguugcuauucuaauuuaugcuuaaugucaugggucauuggaaguaauauuguauaugaaaaguuaguuccaguccauuggagcagcuuuacucauuucucaguauagauaaugaauuuuaauccuuuaaucagucugauuacaagcuaaaaauuuuaaaauauauuuuuagaauggcccccgugcuuccaaguguccugaagcugccagucagaucucuaacauacuucagugcaagaaaaggcaagagaaagaccgugaaagcugucaucgauagguuucuucgacuucauuguggccuuugggugaggagaaaggugagucuucacacuguuacuaaauugaaaaaggaaugugaggccgggcgugguggcucacgccuauaaucccagcacuuuggcggguggaucauaaggucaggaguucaagaccagcuuggccaacauggugaaacuccaucucuacuaaaaauacaaaaauuaggcgugguggcaggcaccuguaauuccagcuacucgggaggcugaggcacauaauugcuugaacccgggagguggagguuguagugagccaagaucgaaccacugcacuccagccugggcgacagagcgagacuccgucucaaaaaagaaaagaaaaaaggagugugagcagauuaaaaucaaacagaauucagaauucagccaggcacuguagcucaugccuguaaucccagcacuuugggaggccaaggcgggcagaacacuugaggucaggcguuguggcaggugccuauaaucccagcugcuugggaagcugaggcaggagagucgcuugaaccuggaaggcagaggcugcagugagccaagaucacgccacugcacuccagccuaggugacacagcaagacuucaucucaaaaaaugaaaagaaagcagcuuaagaccaguuuugcaaaaccauuuuugagauuuaguaacugcccaaauccuaauucccuuucauuacuuggaaauuaaaucuuuaaaaaucaaaauuugguucccuguaaaaauaaaauaguugguagaacuuucuugauguuugaaagguugaaaggauucucccguuuuauaaacaguacuaaauuaguagauaaauggguugguuggaacucucagcucauuucucuauugaaacacugugguggguaguuuccuacaccagucagcagaagcucauauaauccauaaagcagcuaaacuaaaggucuaauguucugaguuuugugaauuugagaccacuggaaacauuucuucccuuuuguguguauguguuuuuuuuuuuuucuuuuuuugagacaaagugucacucuaucgcccaggcuagagugcaguggcacaaucuuggcucacugugaccucugccucacggguucaggccauucuccugccucagccuuccgaguagcugggauuacaggcaugcaccaccaugccaggcuaauuuuuguauuuuuaguagagacggguuuucaccauguuggccaggcuggucuugaacuccugaccuuaagugauccaccugucucggccucccaaagugcugggauuacaggcaugggccgugacgccuagccccacccuuugguuuuuauaccaguuauuuccagguccucuucuagcccuagguaaaaugaaauggguggguuuccuugccuuccuuuccaugucccucuuacugggcucuggggcccucauguuacuguaaaggacccgaucauacucuccagucauaauaccuagcuucaguucagggcucccgaaaguauacccuguauagaaugcccugccucuucaaaaucuaauuuucagagaaaaaaaaaaucuggguagaugaauucaaacuaauguguaaaacaaaguauuuuccaugacacgguuucauccagcaguccuugguauuuauuguucauucccuccuuccauuuuugaaucuagagauugucuaaaaaauuucaagcauuuucauagugguuccauucugugaauaaucuuuaaaggauacuggugguaaugagcagggcaauaaauuagguguuuguacgucagagauccauaguaacccaguuuggccugcaaacuaugaaauuauuacacaaauguggagauuuggcuuuaaauguuugcauuuaaaauuguaagcagugaguagcaaaaaucuaaccucuagcauucuaaaaccagaacucuuaaauaaccuuuccuuauuucaucacuguccuuauagaaguugauggucacagugaugauacuaagacaugucagaaaugcaaggcacauucucggcaaagagccaugguuuuguucaguugguauugugccauaaagagcccuuggcuugaaaggacccaagggcucaccgugugguuuuagccagauguuaauuaagcuggauggcaccuaagaucccuucuaguuuaaacaggcuaugauuauaguuuuuauaaucaaucaaauuuuccuuuccugucuuuaaaaauaaauucuucaaaaugaauaauaccuguauggguguauaugaaaguucuggguuaaauauguggguuaaccauuccuucaccacuccuaauaauagucuuaccauauucauaauuccuuagaaaaguacuuccuauaaaaauuggucccuugugugugaaaauaauaaaugaagcaauauauuugagaacugugcuucucagcucuuguaauacucagccuccuuaauaaauauuaauguuguuaccucgccugcacuccauccuccucuacauuaggaaagacagugguuaagaacucuuauuagccugggcaagauggugagaccuuaucucuacaaaaauuuaaaaaguagcuggguaugguggugcacacuuguggucccagcuauacgagaggcugaggcaggaggaucacuugagcccaggagguagaggcugcagugaccgugaucaugccacugcacuccagccugggugacagagugagacccugucucaaaaugaaacaaaaaaagaacucuuauuagcccucagaccucugucugcuacuucucuaaucaaugguuucuuuuuuuaaagauguaaaauagaauaauaguauguuguuaaagauugcugaagagauaguaagaucauaccuguuaaguuagugauuauaauucugucauuaucuuguacuuucccagccacacacauuuaguuuuauuuucugugaguuuaauuuaaauaauuuuuuucuaaaauaugauuuauuacuaauucuuuuuuaaacuacacaugcuuucuccaucccccuccccgccacccucccuucccccggccauugagaaucacaucuuuccaagaaauaguccagccccuauggaagucugguuuuuguucuuauugggucuauaaaccuugaguugugaagauaccuguuguuucauacauaguaugauguuuuacauuucuuuguaauaucugacaggcuggcuauaagaaaaaauuauggaaaaagacaccugcaaggaagaagcgauugagggaauuuguauucugcaauaaaacccagaguaaacucuuagauaaaaugacgacguccuucuggaagaggcgaaacugguacguugaugauccuuaucagaaguaucaugaucgaacaaaccugaaaguauagaucagaaguuucacuuguuucucaguuauuggauauguaucuuuguguacauaucuuugcaaaaauggauaaguacaaaacuugauguaaauuguaccaaugaauacguaaacauacagugacaacauuaaacuuagaaaaguuuuaaaacuuaauggaucagacuuugccagauuugguuagggaaacagaaauuuagaauggugcauuauuuuuaacaaaugguauuggcuuaacuaguuguuucaguuaugcucuuuuaguugcaaggaaucucaagugggacaaacauaaaaagacucaaaagcuacaaguuagcucaagcaaugugacauuauuucaaggauaugugccagggaauucaggaaccaccucaccaaccccaucucccacucagaaaucaccucccagccucaggaagaguagaaauuggguggugcuccucagcaggggaagguggauguuuaggcuugggcucugcaugcaugugacuugcuucuuuuugcauuguuaacuccauucucucuauucaccaacuucucuacacagcuuuugcauacuuacaguuucuguuccuuuguaauaacuuuaacuugcaccuuugagguucuuuucuacaugaugaccuucagcuccugcugcuagucuccaauugccaagggaauuuaacugggccagacuaccuuuuuauacuaggucugguugggucauugucuagaguagggauuggcuguccuuaagucaggagcccgcuuuguauuagcagguuugcaugcagcaaaaaaacaguuaugugagcaguuucacuuggagguucacaugggguggcagcacacuuaacaucuaacacaccagguucauuguguucauaacacuugucauuuacuguaacaacauuuuuucauaggagaguaaauagcccuucagcaugcucauucaugaaacagaagaggcuguacaagugaagacaagggcuuuuuaugcaaguuuugaaagauagguauuuauuuuuucuagagacaggaguuuugcucuguugcccaggcuggagugcaguggugcaaucauagcucauugaagccucgcacuccugggcucaagugguccuccugccucagcuuacugaguaaggauauguauuucuuaaaaguuaguuuauccacuucagauuucauguuuucauuuguaaggauaaacuuuucccacaaauuuucaacaaucauuguagaaacuaagggggagaaaguaaucucaguuguuuuagaaacgaaaaaguuaagcauuguuuacuugaagugggcagggaagcagcacugaguaaaguucaauugagugguuacagucuagggcagugguucccaacucuccgaucagaaucaucugggaagcauuuucaaacagcaaaguacuuugaaaaccauuauuaaauagaauuaugcaugaauuacuguuucagauccuuuaaugugguaguugguaauaauaagaugaaauuccucuguuguuaguaaaauuaugaaauugaaguucugcagcaugucaggccaggauuauuagggagauuccucgaaacuaguguguguuuauuaaaaggagaaaggauaacaauagaauguucuaaaaccagaaguccaagugcgugucuacuuaugggaccaauaaauaaagaacagacauuugauuugaggugagguaaaagccugaaacauggaauggcauucuguuuugauggauuuucauuucuucgcacuucugagacggcaaagccaaccacuuagaagccuuccacaucuuugucaccugccuggcuccugcucucugauguaccucuggguagugagauggaaauggugccugcagaaguuggggagaaggauacuuuugcacagccuccaugaugucuuuauugcaaauauggaugacaagggucucuguuacaggggccucagagcaccuucguuucuccucuagaccagggacagguguagagauaaggacuggcaaccagagccucagcauccaaagauggacugaagugggauggcugacaggcacauaacuuacgggaaagggaauuucauacauacgauuuuuguuuuguggguaggagggcuuaucaucaacacugauuuuauaaucugacaauaaaugucuuucauuaaagaguuuaccuaaaugauguucgauuauauguauaauuuauaaaauauuuauguauaguuuguuuauucagguauauguauaauuuauugaacaccuacuaugucccagcauaucuacaaaacuggguacauacauacugucuaacugcuaauccacauuuccagucuuacaaaggacauaaugauuaguuaagcccuaauuuagauuugaggaaacugaagcugagagaggguuaaguaaauuacccaaaguacagcuaauaagacccagaaucucagucucacuccuugggauccuguguauuucccugagucuucuaacauaugaaaauucauaucuaaaucaacaagugacuguaaucugguacuauaaauacuaaauaaacacuucuucauaacacuguaccaauucagcuuuuaaauuuuauuacuuugcuuuccuguccuuugccaacucuuaaccuaguuaauccuaguucuguugacauuggaccaggcucaguaaauaaacgaauggauuucca

SEQ ID NO: 191624 - RNA, 51839 nt, Homo sapiens
aauucucuuuaagagucacagcuguccauuuuccacgugcggcugaagaauggauuucagagcgcucucccuccggcaguguucaccuaguaaccccuuccggauaaggaccugcagcccgggcgcgacccggaaagggaauccgcccuuuucgccuccuucgcgccaaucgccuggaguuggcguuuccgcagccgggacacagcccacccucuaagagccgcggagucggggacgguagaaggggccgcgcgugcgcaguggcguccgcugugcuuccggugcgccgggcgcggacgcgggcacgcacacacgcaagcacgccuccacuuaacucgcgccgccgcggcagcucgaguccaccagcagcgccguccgcuugaccgagaugcugcgggccugucaguuaucgggugugaccgccgccgcccaggugagcacuggggcucccggaggcgcgugaggaggcugaacuagaaccgucagcgaaaaacgggggagccuuggucgcugccuagccuccaggacaaaggcgagccucagggccacccucgucgggagaggcccgggcgggcagcuaggcagccaccagggaguucgccggacugggaugacuugagguuauugcagcagcggggugggguguggagaguagcgggaggcgcggcuucgugggcauguaguccaaucagggccgcgcugcccccguccaggaccaauccuggcugcuggcgucugggucgccgguugggcgcgcgauagguuuucagugcugaaggucgacgggcgagaacuacaguucccgucaggacgagcggagcggcggcuuguugcauccuuaauaaggaggugccuggacuucuagcgagaguccacauuuuaggggucaagguuguaauuaucugggagggagugccuuucuuuucgcagcugagaacacuucugaguuauucuuaauccaaacaaaagcgaaagauuuucauuuguggagcugaaacuccuggucuucaaggaaagacaggagucaugaccuuguggcucauuucugagauuagggcagggaucugugucuccaggcgcugggacuacuuugacauucaaggagccuaaauacccaguuacuucuaguuuugcguaauugccaaaguuacuuucuaaaauugaaaauuaaaaagccuguuuccacugcucaugauuuucaggaaguugauauuuuggcaaaauguagauagcaaaccaaguacugugacucaagcaguaauugaacagaaucccuaggaauagugaguuagagaucauaaaagucaagcuuuguuuuuucaaguucgcuucucuuccuauuugcugcuagguaacagaagcagccccuuccauaggaaaguggaacgaaccuguguuaguuuucuauugcugcguaacaaauaccacaaauuuagcagcuuaaaacaacacccaugaaugaccuuacggguucuguaggauagaagucugggcacggaugaucuguguucuccgcuccaggucacauaaggcugcaaaguauuagccaugcugugguucucauuuggagaucaggguccucuuccaggcucaugcaguuuguuggcagaauucagucccuugcaguuacaggacugaaguacuucuuuucuugcugccucuugccagccacugcucccagcuucuacagccugccuacaguuccuugccucaaggccucuagaggccauucauaacauugauguuugcuuucgugcaggcuaccaggagcuugccucucugacuuccaaauuucuuuuacuuuggucuuuccucucuagacccagauuuaaaaggcuuaugugauuagaccaggcccaccuggaugaccuccuuuucaguuaauucagagucaacuuuuugggaucccauuugggaauuaagaaaacuaauuaaaacuugguaauaaaaaaugaacccuuuuauagcucugaaucaagaugucuaagcuucuugaaauugcugucuuguaaaauucuuugguuuauucucaccaucuccuuaauucuguagcauuugacauugcugcuuuaugaggcucuuuguacuuuuggcuucucucaaguaauauuuugggucccaucucucuuguuuuccuuuacugagucugcuucugcuuuguaccucgaaauauacaccuucucaucucuuccugucucuuuauagacucucuaauuugagauuacaucaacucucagaacuuuaauccccaagcaggugacucucuagccucgucguauuugauuguaucaacguauccagaauaucucacuugucaagauccuuuccacuuuauuaaaccccaucuuucuuuuuuuuuuuuuggauacggagucucacuuugucacccaggcuggagugcaguggcacagucauggcucacugcagccuugaccuccugagcgcaagcaauccucuuaccucagccuccugaguagcugggaccacaggcaugugccaccaucccuggcuaauuuuuuaaaaaauuuuuguagagacggagucucucuguguuggccaggcuggucucgaacuccugggcucaaaugauccucccacuucugccucccaaaaugcugggaauauaggcacgagccaccgugcccagccaaccccaucuucuuaaaugucuuacugcuuuuacuguucccuccuagaguccauucuuuacucuaggagggaauaguaaaagcaguaagacauuuaguaaaaggcuuuuuaaaaggcaaacaugaggucaugcucuuuggagacaucgcaucacauucaaaauaaaaucuaaacugcuuaccaugggcccuugaucugacucuucucauauuucauuuuucuacugccucacucagauucuccugguaaucuccagcaugugccucacugccuuuucaucagguguuucuuuugcccugaacucuucucacagguuugcuuaacuuauucccuucaguuaauuucucaaaugucaccuucccuucagagagggcauccugauccaaaauagaauucugacuacucuugccuuccuuguaucacuauaucuuuaccccauccuacuuuguuauacuuuguagcuccuagcacuaccugauguuauaauguguauuuauuacacaguuuccaccuuuaaaaaguaagcuccacaauggaacuguguccauauuuacugcuguauuuccaguauuaacaauagucccuggcuccaaguagaugcucagugaauguuuaugacauauauaaaugaaagaaugaauguguucaugaauuuuuuuuuaauuuaaaaagauuuuuuagagauggggucucauuauguuucccaggcuggucuucagcuucugggcucaagugauaugcccaccucggccucccaaaguggaauuuuucuuaaucuguguaaguggaugugaccucccuuuaaacaucccauagauuuucaaaccucugauuauauauucagauucuccagagaaacagaaacaauaaggguguguguguguguguagagauagggucucauucuguugcccaggcuggaguacagcagugugaucauaacucauugcagucucaaucuccugggcuuaagcgauccucccaccucaccuccugaguagcugggacuacaggcuuaugccaccaugcccagccaauguuuuggacuuuuaguagagaugggaucucgcaauguuguuccagcucauuuugaacuucugggcucaagcaauauccccaccuucuccuccccaaagugcugggauuacaggcgugagccauagugcccagccuaggaagauuuauuauuuauuuauuaauuuuuuuugagauggagucuugcucugucacccaggcuggagugcaguggcgccauuucagcacacugcaagcuccgccucccggguucaugccauucuccugccucagccucccaaguagcugggacuacaggcgccugccaccacgccuaauuuuuuuuuuuuuuuuuuuuuuguauuuuuaguagagacgggguuucaccguguuagccaggauagucucgaucuccugaccuugugauccccccaccuuggccucccaaagugcugggauuacaggcgugagccaccgcgccuggcugaaagauuuauuguaaggacucuacucacacaguuauggagacuggcaaguccagaaucugcugugugguuuggcagacuggagaccuaggacagccaauauugcaguugcagucugcuggccagcagccuggaaacccaggagaguggauggugcaguuucagucuggaggcagucugcuagagaauugccucuugcuuuuuguuguuuuugagcccucaacugauugaaugaagcccacccauguuauagggcaaauuuuuuuuuuuuuuuuuuugagauagggucuugcucugucacccaggcuggagugcauuggugcaaucucagcucacuacaaccuccauccaccagacucaagccauccucccaccucagccuccugaguagcuaggacugcaggcaugcaccaccacacccagcuaacuuuuguauuuuuuuuucuguagagacaggcuauauuacccaggcuggucucaaacuccugggcucaagcaauccacccgccuuugccucccaaagugaugggauuacaggagugagccaccaugccuggccacuaguucaccaauuaaaauguuaaucucauccaaaaacacaguccaaguugacacauaaaaugaaccaucacagauaguaucuaccuuauucuuugcccaggcuggaaugcaguggugcaaucucggcucacugcaaccuccgccuccuggguucuagcaauucuccugccucagucucucgaguaacugggacugcaggcacgugccacugugcccagcuaauauuuuguauuuuuaguagagacaggguuucaccauauuagccgggauggucucgaucuccugacgucgugaucugcccgccuugggcucccaaagugcugggauuacaggcuuaagucacugcacccgacacaguaucugccuuauucuuuauguuugggcuuaucauccuugcauuccuuagauguggguauucaguaaaugugcuuuagaacucuggucccucuguuuuuguuuucuucuuuuauuccucagaccuaacaccaucuuucuucucuuagucccaauacugcaucaccaggcccagccuuuuugaaguggucauugaguuuggaggacaugggcuuuccgccuagccuagccuucucucaaacuacaaaccuggaaguggucauuuacauauggaguagucuuuccugcuuauaacuugaaagaagaagaagaaacauuauuauucuugaggaucaaccgcuccagcuuacuuaagaccaaguuugauaacccagcuaguuuaggauugaacuuguguguggacaugagcuaucaucuucuagaauuccuucuuucuguuaggauuaugaaacauuauguuacucagugauagagauaggcagccaaccacacgugcuagaaaguaguuuaguagaucaugcggccagguguuugcuucuacccaugcuagaauccucuucauuguuccuuuuuucauaucucuagaccaguagccuucaaaccauuuugaaauacaucuuacgccguaacuuacuacaccgaagugauaacauacaaaauauauucacauaugugcagggaaaacuaaagugucaaguuccugcuuuugucauacugauaaguaucugccauuucuauaacuaaagagcacguguucuccuagaauagaauauguuuauacugaaauguaaugcugcuucaauguaaaauuguaauguaaaauguaaaauuucaauguaaaaacuuacuggauuuuuuugugggauauacuuuuuaaccuuaaugcaugauucuuauaaacuauuuuaaauuaacaguagaaaaaguuaauuuguuguauaucaaucuauauuucaaauguagaacugcccauuaacuuaugggugccuuuuucguuugugugggaggaguccuuauguaugacaagauccacaaaaacguuaucaguugacagcaaccagcagucuguggaggaaaccuggaaccucuaguuagaguucacaugaggcagcucauacuacaggcuccauguccagguugucaugcuagauugugguuucuuuaugucuucacuuuaguuugguagagcuaaggaacagauggucuguguaacagcauuaaucauggggcggaacacuugaggucaggaguucaagaccagccuggccaauauggugaaaccccgucucuacuaaaaauacaaaaauuagccgggugugguggcaggugccuguaaucccagcugcccgggaggcugaggcaggagaaucucuuaaacccaggagauggagguugcagugagccgagaucacaccauugcacuccagccugggugucacagcgagacuccaucucaaaaaaaaaaagaacauuacaugggaauuauauguuuccucuuuuuuuuaauaucacguuucugcggguuagaagcagcaaggcuaaccuuauaacauaugucuagacagauugcuuugaaacaguguuguccuuucuaugucauagguccuuauuaauaaaaaggaauuccaggacaaaaaaguagccaauauuuuguguguuaauguaggauauuuaguuuauguuaauaguuuaguacuuaagagagcucuggagacagaccuuauguuuggcaaugguuucuuaacuauaacaccaaaagcacaagcaacaagagaaacuaaagauaaauuggacuucauuaaaauuuuaaauuuuugugcaucagagggauacuugagagugaaaaggaugaaaguauucuaauggauacuagauauuuuggauacuagacccucauaucugaugagguguuucuuuuuagguaaggaacuccugcaacucaguaacaaaaaagacuacccaaauaaaaauacaggcaaagggcccaggcucuguggcucaugccugucaucccagcacuuugggaagcugaggcaggcagaacgcuugagcgcaggaguucaagacuagccuggacaacauggugaaacucugucucuacaaaaaauacaaacauuagcugggugugguggcaugcaccuguaguguuagcuacucgguaggcugagaggugggaggauugcuugagccugugaggucgaggcugcagugaaccaugauggugccacagcacuccagucucggugacagagugagaugcugucuccacauauauacauauauguauuugugugcgugugugugugcgcgugugugcguguauguguaugcaugagcaaaggacuugaauagccauucauccaaagcagauauacagauggcuaagaagcacauggaaagaugcucaacauccuuugacacuagggaaaugcaaauuaaaaccgugagauacucaguucacaaccacuaagaugguuauaauaaaaauggaaaauaacaaauuagccgggcauggugguacacaccuguaaucccagcuacuugggaggcugaggcaggagaaucacuugaacccgggaggcgaagguugcagggagcugagauugcgccauugcacuccagccugggcgacaagagcaaaacuccaucucaaaacaaaaauggaaaauaacaaauguuggugaggguauagagaaauuggaacccucauacauugcuagugggaauguaaaaugguacagcugcugugaaaaaauaguuuaguggugucucaguaacuuuuuuuuuuuuuucuggagacagaguuucacucuuguugcccaggcuggagugcaguggcgcgaucucggcucaccgcaaccucuaccuccuggguucaagggauucuccugcuucagccucccgaguagcugggauuacaggcaugcgccaccacgcccagcuaauuuuguauuuuuacuggagacgcggggcuucuccauguuggucaggcuggucucgaauucccaaccucaggugaucugccugccucagccucccaaagugcugggauuacaggcgugagcgacugagccuggcugugucucaguaauuuaaacauagaauuaccauaugaccuugaaguucccugccaaaagaauaaaaaacagguguucaaacaaaaacuuuuagaugaauauucauagcaacauuauucacaauucacagccaaaaggugaggcaacccaaauguccauuaacugaugacugguuaaacaaaauaugguauauuuacgugauaaaauauuagauucagccauaaaaaggaaugaaguacaagcuacauaugugauacauguuacaaugugaaugaaucgugaaaacauuacacuaagugaaagaagcuggacaaaaagauguacauugugugauuccauuuauacaaaauaucucaaacaggcagauucauagaaacagaaaguacauggugguugccaggggccagagagagaggaaaaugggggaugacugcuuaauggauauaggauuuccuuuuagggugaugaaaauguucuaagauuagauaguggugaugguuguuguacaacaucguggauguacuaaauaccguggaauuguacauuuuaaaaugguuagaauggugaauuuuauguuaaggggauuuugucacauagaggaaaaaaaaaauaccugccaccagguauuugcagauggccggaaguauagagccagagcuagauacacacauacacacccuaaacuugcagaggcuuccauuggcccaagauaggaaaauuugagcaaaaagacaguaauuacaaaugguugaaauccaucaaaaguguuuaaauccaugaauuuaaaaagaucuguucuuaugaguuacagcugcauaacaggccaccuugagcuugggguaaaauaacaguauuuauugccuuacucaguucuggaaaauuuuugcucagagacccucaugaaguugcagucagauaguuacuaggucuacagucauccccaagucuucuuuacucucauguguggcaguaaauacuggcugcagcugacaccucagcagggacuguuggcuggaucacccaucuguggcaucuuuaagugucuggacuuccauacacuuugguggcuggguuccaagggcaagugugacaagaggcagagcuagguagaagcuguauccuuuuuaugucuuagucucaggaguuacagagcaucacuuucacugccuucuauuagugaauuaguaacaaaggccugcccuuguuuaagggaaguguacauaaaacuuauuauuguugggagaggggcacguuucuggaacagcaugugguauaggaaguauuguugcagucaauuuuggauauuauccucagccuucuggacccaacugacaucccucccacaugcacaucccucccacucacaaccuucuccaagacucuccagagucuaaugccaucaaagcaucagcauuaggaacaagaucuugucaucugaaucagauccuacuauggauaagacaucuugaauguggucccuaggguauagcuucuuaaacacuuuuuuuggugaucuaaagcccuguaaacuaaagagacaaauuaucugcuccccauacauucagcauauggugguaugacagacacaggauaaucacucuagacacuccuauucaaaaaggcagaaacuaagaggcacacagcagucaccauuccauaacaaguguaaaauucagcuggcccuauguuucuaauuccuugaugagagcucaguccuacugcuugggaaugauucuccucagcucuugguucuacccuuugggcuccugguuuuacacuugaauuauucuuccguuuccagaauauguugucuguuacagcugaauuguuucacagccuacuuccugucuguagaaguuugucuagaagcuucuuuucauuuuguccucuuuuucacuuuaaauauaagccagcauguuuuuuauugacacaauucucaacaaguuuguggguuuccugugaaucuuaaugggauuuucuucauuagaugcaugauacacaucuuaucaagauaagcccuucuccauuuugggcuuccugugaggcugcuguagguaacaccuuuaauguucugaguaaccuuauugauucaauagaaucugggaaacacauccuuaugauucuuagagggccuuuuccucaagguaaaaagacucucugaggggcaccuccuuagaucuuuuugagaucucaaaguaucuuuuggucacacacuagauuugaucuuuggcuugaagcccuucucuauuugagaaucuauuugaaaacaauaagcaguuuuauuuuugaacccaccaaauccugacucuuuuauauuuccuuuaaauuuugcuugaaagcaaaacagguuuuuguuuuguuuuuuaaugcuuaucucuguccuuaucauacucagcuaaaagaaaccaguuagcgcuugugaugaacacuauacuuggaacucuuuuguuuuuuuuuuuuuaagacagagucuggcucugucacccaggcuggcgcaaucucggcucacugcaagcucugccucccggguucaugcugccucagccucccgaguagcugggacuacaggcgcacacugccacgcccggcuaauuuucuguauuuuuaguagagacgggguuucaccauguucagcaggauggucucaaucuccugaccuugugauccgcccgcuucggccucccaaagugcugggauuacaggcguaagccaucgcgccuggccuacuuggaacucuuuagccaaguacgucaguucauuagguguagcuacagcuauacuuaauuuucuauuuuccaugucugucauuacagaugacaguuuugauaaacuucugucacuacauaacaagaauaucuuuuccuccagguuccaaaauuuuuuuuuuuuuuugcuuuucuuuaagcccucaccaacaggcucuggaaggccauuaggcuucugcucacagucucuucaagguucuucagcuucugccgcccccaacaccagucccaaagucaugaccucguguuuauguuuuguugcaguagcaccccucuucuagguauaaacauauguuugguuaucuguagcuguguaacagaccacccuaaacuuagugguauuaaauagcaguguaauuauaauuauuauauuaacaauaacaaacguauuaauauauaaauuauguaaauaaaaauuacucagugcuuugagaggccaagguaggaggauugcuugaggccaugaguucaaaacuagcuuggguaacauagcagaccuggcucuauaaaaaacaagaacaaaaauauuagcuggguauggugggcaugugccuguagucccagcuacucagggggcugaggcuggaggaucacuugagcccaggaguuagagguuacagugagcuaugaucauaccacugcauuccacaaccuuggcaacagagcaagacucagucucuuaaaaaaaaaauuauuuauaugcuugaaacacucuauuucuguauuuucaccccucagauugucaaugaugaaaaaaaaaugauacaauacaguguguuggagaaaaugugggaaaacauacuuucauauuacuagagggcaguuuggcuaauuuggcaguauuaaucaacguggcaaauuuuacuuuuaagaauagacccaaaauuguguauacaguguuacucagguagcauuauuuauuuuaacaaaaauuuagaaaaaaccucagugucccucaauaggggcugguuaacaauuaaacauuaaguaacaauggaauaccaaaucaugaaaucccuugggaagcuuuucacguacugauauacagugauuuaaaauauauauccuugaacuuuaauagagaauugcguguauauuaugguaucauuuguguaaagguggggaaagucaggagaauaugcacauuugaauaaauauacauaaaaugucucuggauaaauaagaaacugacagugucaguugccuauggcaagcaugggguggcuggggaaagaaguaugaggaagauuuuacucuaugcauauuuaaacuuuuaaaauuauuauuuaaaaccucagauuuuaaauuuauuuaguauuaggagcuuuuaacuuauagucaaaacacauucugucaaagggaggauggagagucaagauaaaagaaaauagaagguagauaaagaaacauuuaaaaauacugaugcugggcgugguuguucaugccuguaauuccaacacuuugggaggccguggcaggagaauagguugagaccaggaguucgagaccagccuggucaacauagcaagaccuggucucuacaaacaacaaaaaaaauuauuuaaagaaaaacugaugugacuuuggguagucugaaacucuaguauuaaauuugucccugauuuccuggagucaguuauccauugugcuugcugcuugauacuccaguuagcuaauuauccacuguugacagugccuuaacuuuuuaccugaauaccuauuuauaccuagacagauaaaaaaugcaaccuuaaauauaauacaacuucaguggccucuuaauauuuucucccuaagucacaaaaauggaauuguugacauauaaaaauagaugcauuucuguuuacaauuucauacuacuuuacagaauagaaggaaaacacccuuuucuauuaaaaaugguucaaaaauguugggaauucuacaggguagguaauaauugaaauacuggguuuuuuuuguuuguuugguauuuuuuguuuuuguuuuuguuuuuuuuuuuaaggggaguggaggagacagggucucauucuauugcccaggcuggaguggagugacacagucuuggcucauugcaaccuccaccuccggggcucaagcucaagugauucucaugccucagccucccaaguaucugggacuauaggcacaugccaccaaaccuggcuaauuuuuguauuuguaguagagauggaguuuugccauguugccaaggcugguucugacguccugggcucaagcaauccccgccugcgccgcucacccucgccagccucccaaagugcugggauuacaggcaugagccaccaugucaauaauugaaauacuuuuuaauaccaguuguaucugcuuuacauauuuuaaaacaucugauuuguuuuuuuguuuuucaaaauguaugacugcauuaguuagcuguuuaccucuaggcuuuggccaguagaguguaaauuauaacuagaguaauuucauguguccuaugaucaugugauagauuuuccuaaaacuauagauacuuuuaaaaggaaguuuguguuauucugauauucguuaaauacaauuucauuaaagaaccuagaaaaagcauuuuuccucuuguugcaguuugauuuuuccuaguauuuuuuaaaaagauacuuuuauggauuugauaaguguaaauuuucaaauuaauagguaugaaugguuuaaaguuuaugaaaaccuuccccaauaguauuuagaugcuuguucauuugcuuaauuuaggagauccacauauuuauuauuaagaaauauuuagguguauuuuacucuuauuaaaaccaaucacaagccauauagcccugaucauuuguuuuuauguaaggauagacuaguuauauggggacagguguacuugaacauuuacaacauuaauuaaaauguuuuucuuaaaaugguuggcuuuuagacuaacaauaugcuaagauaaaccaaaaaucagcuuuuaaaugaaugccucuaggaguugaccagcugcauaguuagcuuagagaugagaaaccugguuuucuggaucaguuagcugagguuagaucugucccuugaguguguauccuguaacgccauguuuuuagcuagacuuugugggugauuuuucagaugucuaaacuaagcuuuuaaaguaaaaauagauuuuuuuuuuugccaauuaagaaaacauauagcaaauaccaauuguauucaagaaauaauuaacauacuuaagacuuauuuaaaggugcuaauugaucauagucugauaauuuuuuuuuaauauuaaaaguaauuuuaugugagccuugggguguaagaagcaucacugcuuuuaggaaucuauaaauaugguucaugauaaauugacuucugaaaaaaaguaauuuuuuguuuaaugaagacauuuuuaauaaaaguauuauuucuguauuaccaacccuaaaagcuuaccaguuuccuuuaacuguauugguugugauguguuuuccuucuuuagaguugucucugugggaaguuuguccuccguccauugcgaccaugccgcagauacucuacuucaggcagcucuggguauguauuaugucucccuauaaccaggcuuuucacugugugcugcuuagggaguguguguuuuccuugaauaugggaauagcugucuaaaccuuuuuuuaaaaagggguacauacaccgaagcuuugcuguaacauuauugggguaccuucuggagcauuguuuguagguaaaaauuuguuaauaaugcaccuuuuggcucuuugguaauuggauggcauccgaggcauagcccuccuuguaugugcaaucuuccauucuauggcaaauagauuuauauccagaacucagcauguuguaacuuaaauaaguguuaaauuuauuuggcauuuuauuagcuuuucauauugugacuuaagcaaguguuaaauuuauuuggcauuuuauuaucuauuuuuuuuucuuuuuuuuaaagacagagucucgcucuguugcccaggcuggagugcaguggcuggaucuuggcucacugcaaccuccaccucccagguucaagcgauuuuucugccucagccuccccuguagcugggacuacaggugcaugucaccaugcccaacuaauuuuuguauuuuuaguagagacgggguuucaccauguuggccaggcugguuuugaacuccugaccucaggugauccauccgccucggccucucgaagugcuggcauuacaggugugagccaccauggcuggcugguauuuuauuaucuuuuguaaagaguuuauuguguuuaggccgggcgugguggcucacgcuuguaauccgagcacuuugggaggccgaggagggcagaucaccugaggucaggaguuugagaccagccuggccaacuuggugaaaccccgucucuacuaaaaauaaaaaaauuagccgggcguaguggcgcaugccuguaaucccagcuacucgggaggcugaggcaggagaaucacuugaacccgggagguggagguugcagugagccaagaucgugccaucgcacuccagccugagggacaagagcaagacuuugucucaagaaaaaauaaaaaaaagaguuuauuguguuuauagaaauguuugauugaggaagaggagccuugaaagugauaguucuuguuuggguucagagagaaucucaugauugugaacauguugaguuaaaggguagauuucuagauauuguauuuaaaaaaaauuuuuaguuauucauacuuuuauuuauuuauuuauuuauuuuuugagacaaggucuuguucuguugcuccaggcuggagugcaauggcaugaucauggcucacagcagccuucaucucccagucuuaagcauuccuccuaccucggccucuugaguagcuggggcacgugcuacuacaccuggcuaauuuuuuuggcagggugugguggguagagauggggccuuacuguggugccuagggugguuuugaacuccugggcucaagcaacccuuccaccuaggccuccuaaaaugaauaaauacuauuuuugguggcaacauguuauaaacaaaucaggaaaaggugaugugcagacauggugguaaacuuggcugcuaugaucugaauuagugguagauaaguagaggcuagaggucuucgagaugguuacauugguauaggaaaauagguguaggagagccaagaaauauaaauguauuuccuguuucuuucacuuagguugacuacuggcaaaauugcuggagcuggccuuuuguuuguugguggagguauugguggcacuauccuauaugccaaaugggauucccauuuccgggaaaguguagagaaaaccauaccuuacucagacaaacucuucgagaugguucuugguccugcagcuuauaauguuccauugccaaagaaaucgguaagaguuuuaaacaauauuucaguuuauccaaugaaauacuuuaaaagcaaguuguuuucauguugaaaauacaguugucuuuugguauucuugaaggagagguucaggaccuccuguggauacaaaaaucccauggaugcucaagucucagauauaaaauguuacaguguuugcauauaaccuauguauacccucccauauacuuuaaaucaucucuagauuagauguaauaucuaauacauuguaaaugcugucuaaauuuucauuauacuguguuauuuagggaaugaugacaagaaagaaaagucuguccauguuuaguacagaugcaguuuguuuuuguuuguuuuuguuuuuguuuuuguuuugagacagaguuucacccuuguuaaccaggcuggaguauagugguaugaucucgccucaccgcaaccuccgccuccggguucaagcgauucuccugccucagccucccgaguagcugggauuacaggcaacugccaccaugcccggcuaauuguuuguauuuuuaguagagaugggguucaccauguuggccagacuggucucaaacuccugaccucaggugaucugcccgccucagccucccaaaguguugggauuacaggcaugagccaccaugccuggccucaggugcaauuuuuuaaaaaauauacuuuuucaaucugugguugguugaaucuauggauguagaaccuacagauauggagagccaguuguguuuugucuguaugcagugcaacuugccagauguauguauguuaguuuucuuuuuuuuuuuccaagacggagucuugcucuguugcccaggcuggagcacagugaugugaucucggcucacugcaacuuccgccuccuggguucaagcgauucuccugccucagccuuccaaguagcugggauuauaggcgggcgccaccacacccggcuaauuuuuuguauuuuuaguagggacgggguuuuaccauguuguccaggcuggucuugaacuccugaccugugguccgccugccucggccccccaaagugcugggauuacaggugugagauaccaugccuggccaguuuuuuuuuuucuuuuuuuuuuuuuugagauggagucuugcugugucacgcaggcuggaaugcaguggccugaucucagcucacugcaaguuccgccucccggguucacgccauucuccugccucagccuccugaguagcugggccuacaggcgcucaccaccacgccuggcuaauuuuuuguauuuuuuuuaguagagacgggguuucacuguguuagccaggaugaucucgaucuccugaccucgugauccaccugccucugccucccaaagugcugggauuacaggcuugagccaccgcuccuggccgccaguuuccuuuaaauugaacuaauaguagcugguacagauggauaauuauucuuuuggagucccauaagugcucucaguacauaucacauagaaaauaacugugcugcacacaaggguaaauggaggagauacuuggguagagguaaccaugguuucccuauggacugagggggacaucuauauauuaucccauacuguugcagcuaucaagcucuuacuuagaacacuauaaaaacaagugcagaauggucaugacauaaaaccacguauuaugguuaguaaugguuccuuuuagaccauaacacaaagucacagaauuuucaucuagaugcugauuaguugacaggauaucuuguacuauuccuguaacuuuguguguauuccuuuuuuucucaccagccuuaaaauuuuuuucuuuuuuuuuucuuuugagacagagucucguucugucgcccaggcuggacugcaguggcgcgaucucggaucacugcaacuucugccuccuggguucuggcaauucugcuucagccucccaaguagcugggacuacaggcgugcaccaccaugccuagcuaauuuuugcauuuuuuaguagagaugggguuucaccauguuggccaggcuggucuuaaacuccugaccucaggugauccgcccaccucagccucccaaagugcugggauuacaggcgugagccacugcgcccagccuaaaaaaauuuuuaaacucuaaucuuaaauguuucuucauucacacacagcuucuuguaaaaaaaaaaaaaagucuguaaaagagcauggauuuuuggcucuuugguauugggcauuucuuuacgcuaggaggcuggacauagcugaucaguuuauucuuagaaacuggguggacuuacuguccaguaucuaacaugaucuagagacccauccuauagcaaaaguuaacguuuggaaaaauaaaugucauccaacuuccucccuguaacccaccccaaccauacuuuuucacaauguuuuugacuagucuucuacaucauuuauucuucccuauggacuuuaaaauguccauauuggcugagggagauaauuuugcagcuucauaagucaaggagcagaacccuguggauuuauucuaaaaucuugaaucuauuuuaagcugcaugacccaggaaaaaauagcuggaagcuguucuaggagcauggaguaagguugaaaaauucagagaaguguucuuuucucaguugaugugacuucagauuucauucuuuguagaugaauccuuuaucucuccaaauagccuuggccucuccucacuccacuuuagcuaccuuggagaacauuucuaguuaauaacucagcauguuuguacuaaaccaccuccacacuuacacugcuccuuauuugcuuuuuuggauuaaagauaguaccaaguugucagguguagcuaggccagaauucguagauucuucacagguugcucauauuuuguuagcuauccuaucuuguuuaaucuucuugcauuaccacuauccguaccccuauucugaccuuuaucacuucauauccaaauugucuccugaacuaggccuguugcucuccaugcgcacacagucuuucccaucuuccucccagucucuacccaccuagaucucuccuccuaacagaaucugggucauccuuauauuaauaccagagaaucuucuaaaagaagugcuaugauauuuucaugauaacaccuauuaauguacuuccagauauuuuguauuguuuaaaagauggaagaccacaggauguaaaaacuagagaaaucuuucuuaccuucugaauaaguaugaagccaggagugcuuaaaugucagccuaggaacuggccauugggcuccuuuauuucuguaguuuguggucuuugcuagcuuuuaaguugacauucaauacccuuggcaaucuggcacuuguuuaccuuugcagccuuaucucuggguccugcacauaagcccuuagcuguacaccaguugcccuucauuacaaauaugucuuugcuuuccauuuauucauuuauucaaccaauguuaaucaaaugauuauuaugcugcaggcacuguuccaagggccaugcuuaaagauagaacucaucuaagaucccuuccauuuguacagcuuuuuuucaggauggucuccuacccagaaugacuuccuuuccuucgcuuauuaauguucucuucaggggcugcauccuucacuguacagaucuaaguuaauuuucucaccucugaauuacaauagcaguuaguguuucuauuuuuuuuuuuuuuaccauuuacucaagcacucucuacuguuaaacaucgugucaacuuguugcugugcauuuuauuucauaguaaccuuuuuaguggcaacaugauuuguuauaacauugucucuauauuuacuguccaugcauaaaaucuuuuugauggacauggaauaacaccugccuaaaugguuacaacuguuacauuccuggauagaacuucauaucauaaaaaugucauuucucucaaauauauauguaugucauuaaagauaguaccaagauaguaccaaauauauauuaagauaguaccaaauuacauuaagauaguaccaaauauauaugacauacauauauauauauuugagagaaauguauauguauauauuagagagaaaugauguuuuuaugaugugucuauauacacaaaucuaguaagaauuugaaugaauuuuucuagauggugaggaaccagauaauacaguuuuaacauuuauauggaggaauuaaugauguacaagacuacucaagaacauuuugaaaaagggaugaggaggggugcuuuucuagauagacuuuuuuauacugcuacuuuaauaaaauaagguugggacacaggaaaagaaauuagaggaauaaaacaacugaauuuggaaauagaucacacacaaacuuuaauuaugagaaugugaaucacuagaaccuuaagugaaagugaucuguuaacaucuguuaaaaauauacaaccccuuugacccaacaauuccucuucugaaaacuaucccauagauauuacacuacggugcuuuucauuuaaauggacagggauggauguucauugcuuuguuuguagcagcaaagcaaaacaaaacaggaaacaauuugaaugacuauagaggagaaguugaccaaauuaugggaaaucguuauaugaggauauuaugcaacuaaacagaauuucuugaccugaaagagaauguccaugauauaguguuaaauaaaaaaagagcaaguuacaagguaauuuguauaauauaacccuauuuugguuuguuuaaggaagugaaacauuguuuauguguauauacgagagcuuuugcucaggaguagaaggauagauuccaggcuauuagcaguggcuaccuaagagaguggaaagggaaaggagcagugaagaggcaaguuaaagccacugauauaucuuggcauuauuuugcuuguuacaguaaacagucuucaucauucaaaaauaauauuuuaaugaaaauggaaauaauucugguuucugguagugacuaaguucagaaccacccuguuguguuuaaguagucauguuagggauaucugaguccuacugccaaguuagggcaaaaaguggaauaacauaaguggaaauaaaaauaaaaguaauuuucucuggcacauaucuggcagcccucuuaaaugaauagugucuuaaacuuagagcaggcaauaauugggaaaggggaaggcaagccuugcuuacaaauugaucauauaucuuacugugcaauugcaugaauccuggagaucaaagaaacaaaauucauuuguauuuucacucagagccuuuaauaaucauuugcuucuaacugaauguauacagaagacaucauaguuugauuuagaaaggaaaugauaauagucuucuuaauacuguguaaguacaagcaaugguguuuaaugagaagaucauaugucauggacuuuauuggucacccuaauagaaaccuuuguuacuauuaaaauaugggcuggucauuuggaaugaaauuuuugaacugcacuuuucuaguaauggugguuucucucaacuauguuuaauaaaauacauauguuacaaaguguugauaacuuuauguuaaaagccugaaagacuuggcauuugaaauacugcaaaucacuguaccuuuuuaaaaaacaguaguauaucugaaauguuaaauguuuuuuauuuccaagauucagucggguccacuaaaaaucucuaguguaucagaaguaaugaaagaaucuaaacagccugccucacaacuccaaaaacaaaagggagauacuccagcuucagcaacagguacuuauauuuugaaccaucuuuuuaaaauuauagguaaaucucuucaccaauucuuuuuuuuuuuuugagauggaguuucgcucuuguugccuaggcuggagugcaguggcacaaucucggcucaccgcagccuccaccucccagguucaagcgauucuccugccucagacuccugaguagcugggauuacaggcaugugccagcacgcccagcuaauuuucuauuuuuaguagaggcggaguuucuccauguuggucaggcuggucucaaacucccgcucucaggugaucugcccgccucggccucccaaagugcugggauuacaggcgugagccaccaugcccggccucuucaccaauucuuuauccucucuucuuucuuagugaugaaagugucuugcucuagucccugcagauauuuuuugacuucagaaacuaccagucaccccacccuaauuuacagcacuugccuguugaacucuaaccuguucaguauacauuugaacuucuuauguuucuccuuuguugugucuguccuugauuaaaucaccugacuuucuuuaauucagcagaaauuuacugucuuuucugugcuagacauucuuguaaguacuggggaaacagccaugaacaaaaacaguuaaaaaauuuuuucagcuaauauuucuugauugggugcggagaggaaauaaacaaguaaaacguauaggaugucagacauugugggagggaauacugcaguuuuaaauggaauguguaaggaauaccuuaccuggaagggguuaucugagcaaagauuagaaagagauaagggggguaagucauguaaaagggugguggggaaaagcaucccaggcagcaggauuagcugguguagaggcuugauauauucaaacaaagggcaaaugaggcuagagugaauugaguaaggggagaacaggagcaaaugaggucagagagggagcaaaaaguuuauuguggcaguccuuggaagccauuguaagaauuuuauuuuaggccaggugcaugggcucaugccuguaaucccgcacuuugggaaaccaaggcgggaggaucaccuaagcccaggaguuugaaaguagccugggcaacuuagcaagauccuguuucuauaaaaaauuaaaaauuagcuggggauggcggugcaugccugcagucccagcacucgggagggaggaccacuugagcccaggagguugaggcugcagugagcuaugauugcaccccuacacuccagccugggugacagggcaagacucugucucaaacaaaaaaaaacauuguuucauaugcugggugggaugggaagagaaugcugagccaggggauugauaauugacuguuacuuuaaaaccaaggccgggcacaguggcucacaccuguaaucccagcacuuugggaggccgaggagggaggaucacuugagccuagcaguuugagaccagccugggcaagagaggggagacccugucucuacaaaaaaauguaaaaaucagccagguguggugguauacacguauagucccagcugugugccagaggcugaggugggaguauugcuuguuccugggaggucgagguugcagugagccaugauagugccacuauucuccagccugggcaacagagugagaccuugucucaaaaaaaaaaaaaaaaaaaaaaaauauacuacacacacaaaaaauugauugagugauugauagagaugggaucuugcuguguuggccagguuggucuuggccucccaaagugugcaaaaaauauauauauauauauguauuuuaacucaguucuguucuugaucacugugaccuuucaucuuuuuguuuaaaacuguaaucuuuuuccugcucacacgucuucuaccacucuucaaagcaauuaaaaaauauucuuuguuuaguugcuuucuuuugucugucuucaucauuaacaggcuuuuuccuuuguuacucuuuuuccauguguaaauguccccuucuuguguguuaauauuauuauuauaagccuugccuggaauaaugaugguuaaaaugcagguggaugcagacaagacuucuuucuuuuguucguucccaaccauuguccauuuugugugaguuuauguaugcaguggacagugccccuguuuguguguuauucaaacauguggcaguacaaauauuugugucucuaaggagucagaugugaaguggguggugauggugguaguaaauuucuguguguuucucuguuaacccaggaaaguauaaauaccaugaguaacauauauuuauagcaccuacagaagcggcucaaauuauuucugcagcaggugauacccugucggucccagccccugcaguucagccugaggaaucuuuaaaaacugaucacccugaaauuggugaaggaaaacccacaccugcacuuucagguaauuuaauuauuucuauuuguucuuuuauacaugauacacucaucagaacuauuuaaugccuaggcaacacguagacacuaaguauacauuuacacuagguuuaggucuucagaguuucuuaggaaauuuuuaaaauuuaaauguccgaauguaucuuuuuaaacaagaagauuaaagccugauuccuauuucuucauuuuggaaucauuaagaguaaugauaugguuuuagaauucuuaacacaaaaaugcccugcauugauauaacuggccaguacaaacgaugcuuuuuuuauaucccuguuagcuauuaaaauucuaugcugaaauuugauuuccucuuauuuacuuuugcugcaagaagaagcauccucaucuucuauaagggagcgaccaccugaagaaguugcagcucgccuugcacaacaggaaaaacaagaacaaguuaaaauugaguguauguaaaccagacagcuucuuaaggauuuugggucaucucccaguugcucucuucuuaaacuaucagcacaaguuugucaucuaucaccuaguugugguuucuuuuguugcugcgguuguuuuuuaguggcauugcuuuauucaucaccuucauuucaucuaaacuucuuuuaccuaagugacaaaggcuauucuuaguguauaguuggugaaaacuccaaauaauacuaaagauuauguuagcgcuaaagauucuuuauacucugggaaacagaaauugauuauuuauguuuuagcagcuugccuaaaaguccuuuauuuauuuuuuugagauaggcucuuuucugucacccagacuggagugcgguggcacugucauggcucacugcagccucaaccucccaggccaaagccauccucccaccucagccuccucuguagcugggacuacaggcguguaccaccauacccagcuaauuuuuuaaaaauuuuuuauagacacaggcaucucacuauguugccuagacuggucucguacuccugggcucaagugauccucccaccuugaacucccaaagugcugggauuacaggccugagcccuuguacccagcccuaagagucuuuuauuaauaauuguuaauuuauacuuguaaauaauuguuuauuaauaauuguaaauuuauuuguuggagucagaauggcuuacacugccuuaucaucuagccucuggacucucuaguagugcuuuuaucugacacugguggggcauggaauguucuacacaucgcugguuuccagcuaacaagcauauuccuuuuuaaguuucaguuuuaugguuuuuuuguuuguuuguuuuuaagagaugggcucuuacuguguuggucaggguaguguuggacucuuggccucaagaaauccucccaccuuggccucccaaagugcugggauuacaggcaugagcuaccacaccuggccaaguuuuuuuuaucauuauuauuauuuuugcuguccucgguaggucaggauucuuaaauuuuuugaugguuuaaaaaagauaauagauauuuaucaauuuauuuuucugucuuaaagcacauguaacauaauuuuuuguacugugcuauaauauguugaugucucuggaggucgugggauguagcuuuuugcuggacagagaguucaguacucauggcagcuguuuauaguuuuuugaucuccuugucauuuguuuugcuccuguuucccuuguaaugugcugguucugcccuacccugaggaaccaaguuucuuagaauagcauaggugucauucugugccuauggcauuaguuuuccuacuuggauuuggauuuucguuuuugauuuuuuguauucuucugauuguguuacaaauauuugugaauauuuaauaaaugacuucuaacuaagugaaauauuucauuuuuccuacuucuuuuuucuuuuaguccuguuuuuucuucacuuuucacuuuucucucuuuaucacuugggcaccuugaaauuaaguuauaaacguaagauggagaugucugcuguuccagcuguucuuuuccuugccugguuccucucaucuuucauuuugggcaaagugaaaauuuucagaauuuuaucugucaccucuuaauucccccucaaacuugacuuuaaaaauauacacauaugcauuugcaugugaaauauuuaucaaggaucaaaggacagugacuaaaccucugaagagggcuggaagcagcaggugccucccagcagcccacuuucuguggccuccauaaagugguucacaacugccuguacuugauguccacuguucacucacgcaugucaugggauccaaauaccacgguuucucucccuugccccuuucucuuguuguauccccugcucucauuucacuucuaucacuucugucaauuucuuuuuauuuucuccuuauuaguuuuccucuuaucuuucuugcagagguaccauuuguaguuccucagauuccauuuguucauugcuaguuuaugcuucuuuuccucaaaaucaucuuuuuuucucgcuugucaaauacauuuuuuauuuuuugucaugugauaucauuuauuuaauuaauuuguuuugagacagagucucacucugucaccuaggcuggagugcaguggugcaauaucggcucacuacaaccuccaacucccagguucaagcgauuuuccugccucagccuccugaguagcugggacuauaggcacccaccaccaugucuggauaauuuuuguauuuuuaguagagacgggguuucacaauguuggccagccuggucucgaacuccugaccucaggugauacaccugccucggccucccaaagugcugggauuacaggcgugagccacugcgccggcccauuuauuauuaaauuaguauucuuacuagccgccuuucuucaaaugaccauuuauuuuugcauuuuaguaaauuaucuaaaauugucauuugcuuuacuuuuugguauucccgaaacagcauauagaaaugugaucuuaauagauggaagccucuugaacauuggugucugcuauuucuugaguccuuuuauggaagaacacuguccauuucaaguugccuuuggguuuuguuuuguauuuuuugaccuguuuucuuauuugucuuuuucuuucucuugucuguuuucuuguaucuugucaacauaaguguuuugcuaugaguauuccuucuugccaaggggaugaaaugggcaccucuuuuucccuguuacgauuguuguuuaaaaugaagaaagcugauggauuuguugaguuuauagccacaauauguaaaaggggcuauaguguccuaaaccuuguuucucccauuugaaauacauuacccuucuuuaaauaauuuugaaaaaaaaaaacacuuuuuauuuugaaaaaguuuagauauacagaaaagaaaaaguaggcugggcacgguggcucacgccuguaaucccagcacuuugagaggcugagguggauggaucacgaggucaggagaucgagaccauccuggcuaacacggugaaacccugucugcuaaaaauacaaaauauuagcugagcgugguggcaggcaccuguagucccagcuacucaggaggcugaggcaggagaaucgccugaacccaggaggcggagguugcagugaacugagacggugccacugcacucuagccugggcgauagagugggacuccgucuccaaaaaaaaaaaaaaaaacaaaaaacaaaaaaccgggcacgguggcucacgccuguaaucccagcacuuugggaguccagggugggcggaucauggggucaguagauggagacuauccuggcuaacauggugaaaccccgucucuacuaagaaauacaaaaaaauuagcugggcguggugguaugcaccuguagucccagcuacucgggaggcugagguaggagaauggcgugaacccgggaggcggagcuugcagugagccgagaucgcgccacugcacuccagccugggcgacagagcgagacucugucucaaaaaaaaaaaaaaaaagaaguguaauaaagcuucauagauuuaucauccagacuaaauuaucaguauuuuaccauguuuucuuuuuuuuuuuugagagagucucgcucugucgcccaggcuagagugcaguggcaugaucucggcucacugcaagcuccaccucccagguucaagcgauucuccugccucagccucccagguagcuggaacuacaggcacccgccaccaugccuggcuaauuuuuguauuuuuaguagagacgggguuucaccacauuggucagguuggucucaaacuccugaccuugugauacgcccgccucggccucccaaagugcugggauuacaggcaugagccacugcgcccggccuuuaccauacuuuuaagugaaacuuugauucccuaaauuugagucucauguauuuuguuccuuuuuaaauuuuuugggaaaugcaauggaagacuagauaggagaacagcaaaaguuuaaagucauuuauggggguaggauuuguuuuuuaacuguucuuuuuuuuuuuuaagcucuagccaagagcuuagaagaugcucugaggcaaacugcaagugucacucugcaggcuauugcagcucagaaugcugcgguccaggcugucaaugcacacuccaacauauugaaagccgccauggacaauucugaggugagcccaaugaaugauuagaaguguucuggcugucaugacuuggaggacaaaaagaaaaaucgaggguggagagaaguguaauauuuaacagacugcuuucuuccguaugauaucggcuuucucucacuaggggaagauagucuggaauaauuaaucuuuuuuuguuauuguuuugagacggagucuugcucugucgcccgggcuggaguccaguggugcgaucucggcucauugcaaccuccaccucccagguucaagcgauucuccugccucagccucccgaguagcugggauuacaggcucccgccaccauacccggcuaauuuuuguacuuuuaguagagacaggguuugccauuuuggccaggcuggacuggaacucuugaccucaagugauuugccugccucggccucccaaaauguugggauuacaggcgugagccacugugcuuggccuuagaguaauuauguuuaaaaaacaaacugaaaaaagccuuuaaguuuuuuagaaugaauuuuauacauugugcuuuacuauaucuuacaacaccgaugcagcgcaagaauuaguucagauuugcuuucauauuuuaauagcacuuaaauauuuuuguuguuugcuuuaaaauugcuauuuccauagguaaacuuuuuaagauacuucucaaacuucacaugcaguuuuaagaaauaauacagagagcucucauguucccugaaacaccugcuauuuuaaauguuuaugauuauuuaugcgaaacacuucaaagaaugaaguaauaacauugauuuuucaaaauuuaauacugggacuuaauacauuauuuuauaauuacauuaaguuauucaguauguauaaauguaucucuauuccaagucauuuaaggaguaaauuaaaguaaaaugcauaaauuauuaaucuuaaggaucaggaucauacauggucaguaaaguuacuuugccaucauaauuguaguuuuaaaaaaaauuuuacacacacuuuacauuguuucagucguauguacuuauauuacaaaagaguuuaauuagaccucugauguuaguagcaagaaacuacaaccuuugaaauuuuaaggaaaauuccauuuuauucaaaguccaagaaaaauacuuaaauaucagaguucagucagcaaaguggaaaccacccaggaaauuuaauuugcugguuaccgauaugggaaggcuagaaguugcgugauguaaggguguuggguucaaacccaaguagaccaguaucccucagaaggacacggauuggaagcuuuaaaugccauguuacuacuuggguauaaggguacacaaggugguauuucaucuuccuaacgcacauaauguguagcacauggugauuagacaguguaaaaucuauugcagucaagauuuuacaaucuaaugguagcaguuaacagaugagaguauuagcuaauguacaaaauaauuggaaaaauguaugaacacauuuuggaauguuaagaaugaauuccagcuuuuguuuuuucuaguacaagaagcuacaggugcacauguaauuucuaauauauacugaauaacuuucacaaagcaguguuugugaagaguuggauuugguaauacuaggauuuaguuugguuguaggggaaucugugucuguuacaggguagguuuuccuuggacuucuguaagcaggaguaccuucaacaagggugauaaauuuuggcccccagauaugucauugacauuuacaugcuuuguaauucuauuugggucaguucauguggcccaacucagcauccauuccuuuuuuuuuuuuuuugagacagagucuugcucugucaccaggcuguagugcaguggcgugaucucugcucacugcaaccucugccucccagguucaagcaauucuccugccuuagccucucaaguagcugaaauuacaggugcccaccaccacaccuggcuaauuuuuguauuuuucguacagagaggguuucacuauguuggccaggcuggucucgaacucaugaccucaagugaucuaccugccuccaccucccaaaagugcugggauuauaggcguaagccaccaugccuggccccaaaucaguauacauucuugauguauuuuauuuucaagaugacuaaagcgguccaggcgugguggcucauaccuguaaucccagcacugugggaggcugaggcugguggaucauuugaggucaggaguucgagaccagccugaccaacauggagaaaccccguuucuacuaaaaauauaaaauuagcugggcaugguggcccaugccuguaaucccagcuacucgggagacugacgcaggagaaucgcuugaaccugggagguggagguuguggugagccaagaucgagccauugcacuccagccugggcaacaagaaugaaacuccaucucaaaaaaaaaaaaaaaaaaaaaaugacuaaagugggaauucacugaaacaucaacuuuauuuuucgcaucauaagauauacuuugcaaaauuuuacauagaacauucuuuuuuuuuggagauggagucuugcuuuguugcccaggcuggagugcaauagcgugaucucggcucacugcaaccucugcuucccagguuccagcgauucuccuaccucagccuccagaguagcugggauuacaggcgcccaucaccacacccaucuuaguagagacaggguuucaccauauuggccaugcuggucuugaacuccugaccucaggugaucugcucaccucagccuccaaaauugcugggauuacaguugugagccacugcaccuggcuacauagaacauuuaaaaagcgauacaugaagacaaauauuucuucuaaauguauggacucuuauccuggaguugagucuguagauagaauucaggggcucauugaacuugaaggagggaaacaucuuuauuuucccuagccucaaauugaaauuuaaaaccauuuucuucaacuaugaauacuggcaacaaaccacaguaauguuagcaguacugugaccaugucaccaauagaaagcacagauguuuucagaucacauuauaguacuugcagaucucuugaauauuaucugugcucaucacuacuucuaaauaggguguuuauuaguucuaccacuagaucuuguuuauuauuucacauaauuuuuuguuuuugagacagggucuugcucugucacccaggcuggagagcaguggugugauuacagcucacuguggccucaucccaggcucaaaugauccucccacaucagccccucaaguagcugggaccacaggcaugagccacuacgccuggcuauuuuuuuuauuucguugaaauggggucucacuauguuguucaggcuggucucaaacaacugggcuuaagcgauccugcuacagugcugggauuacaggcaugagccacugcacccugucuaggcccugaguguucuggguaccuugcacccccucauagugugggacucuugcugcacuuagugguauuagaguguuagaggguuuucuuccuaauauuauauauccccuaaauaugagccagcucugcucaaaaaaguggcaaugaguuccauagcuggagaaaaacauguuggaucugccuaagauuuucaaggaaaacuuuuuuuugagaaguagucuuucucugucgccaggcuggagugcaguggcgcaauuuuggcucacugcaaccuccgccuccuguauucaagcaauucuccugcuucagccucccgaguagcugggauuacaggcacccgccaccacgcccagcuaauuuuuguauuuuuaguagagacgggguuucaccauguuagccaggauggucuugaucucuugaccucgugauccgcuggucucagccucccgaagugcugggauuauaggcgugagccacugcgcccggccaaaacuuuuuuuuuuuuaauacacauuucacauaccguaagagucaccucaagggagguuuuugacaauaguugacuuauauguaacaaauuaagaagaauaauuccuuagaguaacauuuaggaggaauaaggacccuacaaauauguaaaccuccuauuuauccuuaaacucugauuuugguuuguacauccuuuugagaaucuuaaaaaaaaaaaaaaacaacucuccuuagaaaaugcuuauauggcugggcaguggcucaugccuguaaucccagcacuuugaggggccgaugugggcagaucauaagccuuaaauuaagaacauaagccuuaaauuaagaguucuuacucuggagaaacauugcauauaaauuuuuaccuuugaauuuaaugucacauguuucuguguucaaucuuguuggccuaucauaugacaauaauagcaguuauuuauuauauaauuaaaauuuuuuguuuagauugcaggcgagaagaaaucugcucaguggcgcacaguggagggugcauugaaggaacgcagaaaggcaguagaugaagcugccgaugcccuucucaaagccaaguaauuacucauggacuuuaacaaguaauuagggccuccugguggcuuucuuugggccggguuuucuuuguauugucuguauagaauaaagaggagguagagaaacccuucucucacuuuuccaccugugcuuguucugaauuggcauuaggaauuuguacaggccgggcacgguggcucacaccuguaaucccagcacuuugggaggccgaggcggacagaucacgaggucaagagaucgagaccauccuggccaacauggugaaaccccgucucuauuaaaaaugcaaaaaaauuagcugggcgugguggcgggcgccuguagucccagcuacucgagaggcugaggcaggagaaucaccucaacccaggaggcggagguugcagugagccgagaugaugccauugcacuccagccugggcgacagagugagacgcugucucaaaaaaaaaaaaaaaaaaaggaauuuguacaaagguguaaaaagagagaaggaauaaaauauaauuaguccaggcugaguacaguggcucacgccuguaaucccaguacuuugggaggccuaggaggcagaucacuugagaccaagaguuugagccauccuggccaacauggugagacccugucucuacuaaaaaugaaaauguuagccaggcgugguggcaugcgccuguagucccagcgacucgggaggcugagguaggagaaucacuugaaccccggagguggagguugcagugaacugagauugugccacugcacuccagccugagccugggcgacagagcgagacuccaucucaaaauguauauauauaaaauuaggccagaauaaauuuggcagaaacuuauauaaaggauuuuuuuuuuuuuuuuuuaauucauggucuugcucuguugcccaugccguagugcaggggcaugaucagggcucacuauagccucaaccucccgggcucaagccauccuccugccucagcccccugaguagcugggacuggcaugagccaccacacucagacauauaaaggaucuuacauaaaagucaguuucgcuuuggauuauugcuuagaugauguaucucuacagauguacugagauucugcuguaguuuuaagauuuuacugggacaguuugggcaguuuaucagaauguagaaaguaugucacaaucugucugccuuaaccaaaauaguggguauguaauagguaugccacguugaccuugauuccuggaaguuggcuaaaacuaggauugagcaagcaugcccagauauaagaucaaccucuguugauggaaaccuacauuugacuaaagauccucaucagcaguauggaauaguuauuugucacucaaaauuuugcugucuuuuuuaagaaaauauuuauuauuaguagagaaggaagucuucugauaaaacuagcauaucuuuuaggagauuuaaggcauuaugcucauaucacuuugaguucuguguuuuaugguggguagaccacagucugacggacuuaugaaacauucugaaucgugagggcucccugagacccaguuaaguauucgcccagugagguuuuuggccuucuccugugccuuugccugccuuagcucucucucauugguuggugagucaaguugauccuugcaagagcugcuguuuauugugugcucaugauucagccaggcacuaaguacuucucaugaauuacuucuguuccuuacacgaaagcauguaggaaaugagaggcugauaugggagcugaaucuggggcugucuuacucugaggucugggucacuccauauaccaugcuaccucucugguucacucuaguaaaucuagcuucuaaccaagguguuuucaguuguugaugagaaaagccucucuguguauugacuccagaaaagcauugaugcucguccaaagguagugaguuagcucaguugauuguucacagucaguuacggaucgaacagucucguucuagucuuuccucccuuacuauugcacuugacuagucuuuaaaaaaaagaaaaaaaaaagcaauuacauuucuuucauugacuuuucuuuuaguuuuuuuaauaaaauagaggcaugguuucccuauguuguccaggcuggucuugaacuccugggcucaagugauccuccugccuuggccuccaaagugcugggauuacagguaucagccacugcucccagccuguuucauagacuuuuaacaauuauauacugugcugacaucaaaacuuuuuaauacaguugacaagaaguuauauuaaaucuuuguuuuguugguuuccagagaagaguuagagaagaugaaaagugugauugaaaaugcaaagaaaaaagagguugcuggggccaagccucauauaacugcugcagaggguaaacuucacaacaugauaguugaucuggauaauguggucaaaaagguauguuuccuaagucuuauaguauuuuauauuuuaaaauauaaucucuuaaaggauuuuaaggauuuaggaaaacagcaaauuccuaccaucuccccgucuuuucuccugcaaaguguauucguuguuacuguuuuaaaaaauuugccuuggcuggguguggugguucacaccuguaaucccagcacuuuggcaggccgaggugggcagauaacuugagcccaggaguuugagaccagccugggcaacauggugaaacucuguuucuacaaaaaauacaaaaauaaguggaugugguggugugcgccuguaguccuagcuacucaggagacugaggugagaggaugacuugggccugggagguugaggcugcagugagcugagauggugccacugcacucuauccugggugacagagugagacccugucaaaaaaaaaaaaauuuuuuuuuuuugccuuggacaccaaccaaguggauuguuccauauuguugauacuuucuauaauagauaacauuuuugguuaugauuauugucacuuaugaaaauguccauuuuguagcagaucuucugccugcacuuauaugauauguauggagggagggggcauaguaagaugggaaagggccuguccaugguauuugaauaggaauuagaaggaaacaaauaaggcuuauauucuauuucugagcuucagauuuccuuacacauuuccaacaaaauguaaacaaaugaaggaauacuacuucuguuucuuggaauguuuaugguauuuuuuguucaauuuaaucacauacccuguguauuugcucagguccaagcagcucagucugaggcuaagguuguaucucaguaucaugagcuggugguccaagcucgggaugacuuuaaacgagagcuggacaguauuacuccagaaguccuuccuggguggaaaggaaugagugaguacaacugaaguaauguuuuuuuuuugauguuuuaaccacuaaucaaugaaucuaaacuugcuucaucuccauuguaguccacaucccucuggcaugcaugcauaucucuuuuuguuacagcguuuuauuuuaaccacagucauuacagaugacacagcugcaacacuacucuuguaguuuuagcuguggugaacaugaguuccagcuaguguuuaauuccauaauccgugauugguucuguucugauauuugcuacucaaaaaaaaaaaguuuggaauuugagugaacaaaagugacauuauaaccuugacacuacugaaauauuauuguauauguauaaguauuaaaaaaccuuauuacuuuaaaaguauuuguagugaauuauuuaaagcacacuuuaugucugcucugugacaaaacaacacuuuguugagaauuuaccuagggacccugcauugagaaaggaaccagcugucuggcuauccacuuccucaagcugaaacuacagagaacuuugaugcugaagucguuacaugguguagcuauagucacauuucccugaaguucugugagaguacuaagaaucacagagaucaccugucucagcaaaauuaaaauaccguuuauuuuuauuuuuauuuuuuuugucguugcccaggcuggaguguaguccuccaccucccggguugaagcgauccuccugccucagcuucccaaauagcugggauuacaagcaugcgacaccacaccaggcuaauuuuuuguaccuuuuuuuuuuuuucuuuuuuuuuuuuuuugagacaaaguuuuacucuuguugcccaggccggagugcaauggcgcgaucuuggcucacugcaaccuccgccucccacguucaagcaauucuccugccucagccuacugaguagcugggauuacaggugugagccacugcgcccaaccaauuuuuuuguacuuuuaguagagacaggguuucgccauuuuggccaggcugguuuugaacuccugaccucaagugauucgcccaccuuggccucccaaaaugcugggauuacaggugugagccaccacaccuggcucaaaacacuguuuaaaugcuagcauuuguuagaaagcagacuucucauguuguaggccucucugggcugaaggugucaggguugcaucacagaaccacagcuggucuaaggaaugaagguaauaaauaccagugcagggauuuauaaucauucugcaugauggccacccagggagacugaaugucaagaaguggaguuaaggcugucaaaagauaacucagacauugagcucuuugaaugcaguugacucaggaggcagauaucaguuagauuguugucaaauaaaaaagugacaguaugauuuaugagagagaauaauguggagaaauacaaaguucagucugggaccagugacuuuuguuuagacacuggauagcuaccaucgagcaaagaaggcauuguggacaauuuauccuugagaaggauaaacuugagccacguuggcacugcuucccucaucagaauuucucaagggguugucugugccucauugagguuacaauugaaacagaugugagcaccugagagacuuucccugauuauauuccuccacaaaccacuguaccauauuaccuuauuuuaucuucuugaaauucuuauucauuggcuuguuuguugucucuuugcauuagauauauguaagcuccuuggcauaaauuugacauugguagguaguagggagucuccaguggcucaaauaaaaugaaauuagguugacagggcaggacaaauuuuauuuguggagaguuagauacgagcaucaacccuaagaauuugcauucugucuuuggucuucccaguagacuaaauccuacuaauuuuuccaagccagcucucagguuuuuaacuuuugcuuuuuuucugcuuuugaaagugccuaucgcaaaacuuuuuuuuuuuuuuuuuuuuugagauggagucuugcugugucacccaggcuggagugcaguggugcaaucuuggcucacugcaaccuccgccucauggguucaagcgauucuccugccacagccucccgaguagcugggacuacaggcgugugccaccacacccagcuaauuuuuuuguauuuuuaguagagacuggguuucaccauguuggucaggcuggucucaaacuccugaccucaaauuauccaucuaccucggccucccaaagugcugggauuacaggcgugagacaccacgcccggcugccuaucguaaaacaugaaaauguuaaacagugguucucaacugagggcauuuugucccucacaugacauuuggcaacaccgggagacauuuuuguuugccgcaacuguagggagcuacuggcauguaguggguggaggccagacgugcugcuaaacaucaugcaguacacagaauagcccccuuacagcagagaacuguccggaccagaaggccaguagcaccaagguugagaagccugugcuaaagaaagggccauguagaaaaugaaggucccuugugaagcaaucuauauuguuucuuuuuugagugaccuccauuuaaaucuuuauuaauuuauaaaauagaguauauauucacaauacaaaauuugaaagguacaaauggcauuugaaguuucccucucacaguuuuccuccucagggacaaccgguauuacugauuucuuauguauuucuagagauaguaauuauuccaugauuacccuagcccuccguggauguccucaccucugaaaucagaacgcacuaagaccuaaaccaaauuuguuaguacugguuuguguuaugaggcauuuugcucuuauugucauuauuucuuuauuauacuuuaaguucugggauugcucuuauuauuucccuaaacgacaaauguccugaugauguucacuacauccaguacucuuucuguguuaucuguagcugagcaaguuuccaaacgcaauaauagcuagugguauugagcauuauuuuguaccgggcacugaguucuaagugcuucacauauauuaacuuauuugaaauucauaacagccuuacaaggcaaauuugguuauuaucccaauuacauagaugaaaaaagugagacagaaaaguaauuugugcaagguugggguaagagccaggauuucauucucccccacuagcacuauucucugccuaaaugauuuguaucagcagcacgggacucccuuuuggccuuuugagaagaggaaugauauaaccauaauaaggaggaaauuuuauuuuuaugagauugacgguguaggagggagugauguuuagucaguugauguucagagccccuuggaugaaaaauaccugucuuuggacuuguugaaugcaaagguuauuaagaaggucaggacuggccaggugcaguggcuuaugccuauaauccuagcacuuugggaggcugagguggguggauugccugagguuaggcguucaagaccggccuggccgauauggugaaaccccaucucuacuaaaaauacaaaaaucagucgagcaugguggcaugcgccugugguccuagcuacucgggaggcugaggcaagagaaucacuugaacccgggcaguggagguuacagugagccgagaucgugcugcuacacuccagccugggcaacgggagacuccgucucaaaaaaaaaaaggacguucauaccaggauguucagcagcucauccugagaggcaguagcugcgacuggcugcauuccccuucuccugucacguguucacacuggguacuugugauacuugugauuguggugggggacaucauucaaacuauacagaaugccauuuuuucccuuuacucucaaaucaggccauuguaguucuuuaauuugcacagguuaaaugaaaauuuaguuugaauucauuguuuuaaaaauuucaaagaagaacugaauguauuaaguaucugaaauguuaagagaggccugguacugugaacagagagucaaaacugugauuuaguaaaauacuguaugaacuaaugaaaaugcgagggauaaaagaaaauuauaguuucuaugaaaugcuuaaguugaggcugggcaugguggcucacgccuguaaucccagcacuuugggaggccgaggcaggcagaucauuugaggucaggaguuugagaccagccuggccaacauagugaaaccccgucuacuaaaaauauaaaaauuagccaggcguggugggaggcgcauguagucccagcuacuugggaggcugaggcaggagaaucccuugagcccaagaggcagagguugcagugagcugagauugcgccacugcacuccagccugggcgacagagcgagacucugucucaaaaaaaaaaaaaagaaauguuuagguugcugggugcaguggcucaugccuguaaucccagcacuuugggaggcugaggaaggcagaucgcuugagcccgggaguuugagaccagccugggcaacauggcaaaaccccuucucuacaaaaaaguacaaaaauuagccggguaugguggcauacaccucuaguccaaguuacuugggaggcugaggugggaggauugcuugagcccagcagguggagguuguggugaccugagauuguaccacugcacuccaggcuaggcaacagaggaaggcucugucucaaaacaaaaaaacaaaaaauuuaaguugauuacugugaaacagagauaaguccuuugaaaccaaaaccacaauuaauaucaaugauucuuuuauuuucuaaaauguuauuuaccuugauuugucuuguuuuacaguuuaaauuuuagaaaauagccguaucauuucauuuuccaguauuaaaauagcuuuuccugguacuagucuccgauuccuucuuguuuccuuuuagauauuucuguuuaaugaucaauaacuaaaguaugugcauucuuuuuuuucaaacuguucuauuuuuuccuuuguagguguuucagacuuaggugaguguuauguauauuucauguuuaaagucuuuuguuuuggguauuaagagacuaaagucuuuuuguugugccuaugauucuuacacaaagccaucuaaauagauauaaaguagaauuaugucacaugauaaaucugaauuggauauuuuuggcauccgaaugcucucaggaaugaaaauguuucaucaagugauuggaauccuauagaugugaaguguguguguguguguguguguguguguguguguguguaauauggauuguaacugauuacuuuggagaauuucaaacauuaaaaaguaagaagaaaacuaaagaacuuccaggacccaucacucaguuuuguagccaucagcacaugaccaguuuugucucaucuauucccacuccuccucagcuuauauagaaagcagacucaaauaucacauucuuucacuuguaaauacuuucaguauguuucaaaaacaucaccauacuauuaucacaccuaaaacuuaguaacaauucccuagucaccaaauguccauucaguguuaaaauauccccuauuauuucauagaaugagucuuuacaguuuuuauuugaaucgauaacccauagacguuccacauguugaguuuagucaauaaaucucuugccccuuuuuguuuuuugcuuuucaauguauuuauuaagaaauugagucauuagucauauagaauuuccuacauuccauauuuugcuguuggagccauaauucuucacuucaucuuagccaaaagacuaagaagugauggagucauaauucuuuuuuuuuugagacaaggucuugcucugucaccaggcuggagugcaguggcacaauuucaguucacugcaaucuucgccuccuggguucaggcaauucucgugccucagccuccugaguagcugggauuacaggcaugugcccccaugccuggcuaauuuuuguauuuuuaguagagucaggguuucaccaugauggccaaacuagucucaaacuccuggccuaaagugauccacccgucucggccucuuaaagugcugggauuauuggcaucagcuacugugucuggccgguggagccauaauucucucuuuuuuuuuuuuuuuuuugagauggagucuugcucuguugcccaggcuggaauacaguggcgcaauuucggcucacugcaaccucugucuccuggguucaaguaauucuccuaccucagccucccgaguagcugggauuacagguguccaccaucaugcccagcuaauuuuugcauuuuuaguagagacggaguuucaccagguuggccaagcuggucucgaacuccugaccucaggugaucugccugccuuggccucccaaagugcugggauuacaggugugagccacugugccuggcuggagccauaauucuuaaucuguguauguguugcuacauuuuuggauugagauuuuaaaaaaaaacaaacauugguuuaagccuagaugagaaucuuuggguguauuuuaaaaagcuuugcagugauucugauggacagcucugguugcuguguugggauuuaaucuagaucauauguguuuaagaaaaguaaaaaaacuuauuaaggaaaagucugagagaauuugaauuugauuuuuaguuuuagcagaaaagaaucuucaauuggaugccuguuauaacuaaucagaguuaugccugaaagaaaauauagaagugauuguauauauaaguuuugucuuuaaaggcaaaguuacaguaaaugagaaaguccauuuauaauuaguucagauuaaaagaggguuccuggaaaacaacugauuaucugaaggccuaccugaauuuugccagggguugaaaauaccuuauuggacacuagccaauuucugauugaacuggggaaucuaaaucucuuuucauguuagcuaaguuuuacuuucguuuacugcucuuaaauuauaaucaguugaugcagauuaccuuguaaugagguauaauuucagugacaucauuaauauuuuaacaugcucuuuugcuuagcugacaagcucucuacugaugaucugaacucccucauugcucaugcacaucgucguauugaucagcugaacagagagcuggcagaacagaaggccaccgaaaagcagcacaucacguuagccuuggagaaacaaaagcuggaagaaaagcgggcauuugacucugcaguagcaaaagcauuagaacaucacagaagugaaauacaggcugaacaggacagaaagguaagagaaaugagaauuguugccuaacauuuaaagugacucuaacuugauuguuuacuuguagaaauaauacuggcucagccgggugcagugguucaugccuguaaucgcggcacuuugggaggccaagguggguggaucccuuguggucaggaguucgagaccagccuggccaauauggcgaaacccccgucucuucuaaaaauacaaaaauuagcugggugugguggcucgcaccuguaaucccagcuacucggaaggcugaggcaggagaaccacuugaaccagggaggcagagguugcagugagcuaagaucgugccacugcauuccagcuugggcgauggagcaagacugucucaaaaaaaaaaaaaaaauacugacagucauuggcuuuaggauauugaauauaagucaugccagcugaccuuuagaauggagcuuagguccucauuccccucaucagaacuucuaggaaaggagugaucgagcagaguuccuuuauguugagcagaugcagaaguguaagaaaggaauaagcuacugguauccaggauuaucuagcucaucuuuccaguggagcugagccucugucccuuaaagcagugcugaacgaaucuuuguuggagucugaguauauuuuucucugcuauuguuguuaagugguuggugguuaaaaaacaggugaaauagcuucuuuagcccucugucugggcacaccauuuauuaaauagguguccacaggcugauuugggaaccuaacuacucaucccaccuuugugucuucuuagcaguacuacuggccacuccuuccuucuugaaacuauuucuucccuaggcucccugacaccauacucuucuggccuuucucuuaccuugcuggccacuccuuaaccuccuuuucugcucagccucucaaaugguggcauaccuggcauuaguucugaaacguuuucuccaucugaacugucucuaaguguucuuguugagucccgugacuuggaaguuuaaauaccaucuauaccugauaaaugucuaucuccagcucugaccucugccuuggcuucagguuccuauccagcagccuaccugguaucuccagcuugauuuucaguagucauuucaugcuuaucaugcuccaaacagauuuauuuauucucuccaaccugucuuccagccccucaacuuguuucucucuaaauaaacugaguugaacaaucugcucagcuauuccagcccaaaucaugcuuuguuguuccuccaucaacucauauucaguugccccacagauccuaccaguuuugcauccaacauaaaucccaaaucuguccacuccauuacuaccaccuuagcccaagcugucaucuuaacagcuuccacuauuuuuucuuuuucuuucuuuuuuuuuuuuuuuuuuugagacagagucugucuuuguggcccaggguagagugcaguagugcaaucuuggcucauugcaaccucugccucccagguucaagugauucuugugccucucagccuccugaguagcuagacuuacaggugcaugccaccacauguggcuaauuuuuguauuuuuaguagagacgggguuuugccauguuggccaggcuggucucgaacuccugaccucaagugauccaccugccuuggccucccacggcgccagaauuacaggcaugagguaccaugcccggccuuccccaaggaauuuaaacaccaaagugcugggauuacaggugugagccaccaugcccagccaauuugcccuuucuucauacccuucuuucugugucuauuuacgcaggcaaauaaaacauagucgaaucagacacuacacugcuggaaauccuccauggacuacccauuucauuuaauauaauuccaaauucuuaaccaguacccaaaaggcuucuugaucacugcaugccaugagccauuucacugcuccaggcacccugguauuuuuugucuguaccuugacuauaucuuuugucuugggaccuuuauguuuucucugccuaguacauuguucuauccucucuguuuaaaccuugagcucuaagcuuaaguuuuaagccuagaugucacuuuguuagcaagacugagauuuccuaucccuucaguccaaaguagagucucuguauuacuuucuguuauguugcccuguuuauuuuaaauguaaggugggggaaaaggagguugaagggguguugaugcuucacaacagguccuugccugcucagucauauguagaaauauguaucacaaucucagaugucuuuuuuguuuacugucugcugccuccauugagauauacacugugagagcaagaaguucgucugcccuaagcaccauuggauccguacagauaguaggcacugccuggcacacagggcuaguagcacuucauaaauacuuaugcacugacugaauggauucauugauuuauuauauuguuucugagaaaaaauaaguucuggauuucagguaaucaguguuaaguaauuuguaaagugaccuauggcuauuuguuaggcaagguauauuuuuugguuuuuuuuggcccauguugaauuuaaauucauuuaaaaauaagcaguuuucuuuguuuagaagucuaugucaagucuaugucaauaacuaccagauacuuacuaauuuucuuuucuuuuuucuuuuugagauggagucuugcucugucgcccaggcuggagugcagcagcgcaaucuuggcucacggcaagcucugccuccucgguucacgccauucuccugccucagccucccgaguagcugggacuacaggcacccgccaccacacccggcuaauuuuuuuuuuguauuuuuaguagagaugggguuucaccauuuuagucaggauagucucaaucuccugaccucaugagccaccugccucagccucccaaagugcugggauuacaggugugagccaccacgcccggccaacuaauuuucuuaaugauucuucaaaguaggcauuauuacucacaaaugagaaaguggagauuugagaagauaaaucauuuccccaaggucacacagaugguuguaguaaagcuacgcuugauuccaaguauauaguuacuuuuuuucauauccuggauuuaguuauuucucagaggagcaugugauucaggaaauggcaguguuuuauaugagaggcagccuggugauguggaaaaaccacaaguuugggggugagagagaccuuuguuugaaaucugguuuuugccacagcugugugaucuuguuugaaucaccuuccaggguuuaguuuuccguuucacaugagaaguagaaguguacacaugccuggcacauuagaggcguucaggauauggaagcugcuguugucaugguugauaguggucuuucuguuuuccuaaaaguauauguggagaauugaaaacuaauaacuacuauguuugguuucacagauagaagaagucagagaugccauggaaaaugaaaugagaacccagcuucgccgacaggcagcugcccacacugaucacuugcgagauguccuuaggguacaagaacaggaauugaagucugaauuugagcaggugaggaccuggacucccuucagccacaccccucuuccugacaggauuaagagacucuccuuuccuuuuaauguacucugaggaugucgaagauuuggaaaucuccuuguaugucuacaaaacugcuucuuuuuacauaaugguguaccuguguguucaugaucagauguguuuuuaaaauauauauucuagucauuuggaaucuucagagcuuuaaggagaguugguaaaggggauuucaggaaugcagacaguaauauuugacauguguaucuuccuccuauagauggcaugguacugcuuagauuuuuauaacugagguaauuucccagagaaguuuugaaaucccaguaaauuaucaggaugccuguaaucauaguuucuauucaagaaaucauuuacaguaauauuaacuuguuacuuugucuugcaagaagauauugagguuuucuaaguaaaaucuuccagagaaucgcgauguaugucaguaugaaaagguauuuuaaauucuauuuggauauuuuucugagaaaaauuaauguauaagcucuuaaauacaagauauuagaauauaauuuaaucuaauuauuauguuuagguuugcaguacagauaauuuacuuucuaaagcugacaauuuguggcugagcacaguggcuaacaccuauaaucccagcaauuugggaggcugaggcggguggaucgcuugaggacaagaguucaagaccagccugcccaacauggcgaaacccugucucuauuaaaaauacaaaaauuaccugggcaugguggugcaugcauguaaucccagccacuccggaggcugaggcaugagaaucguuugaaucugggagguggagguugcagugagcugagguugugccacugcacuccagccuggaugacagagcaagauucugucucaaaaauaaaauacaguuggcaguuuguuucugacuuuaacagccuucucucuucucuugguaugccuccucuaauauuagguuccaucaguaaaccuguaaagaauuauauacaucggccgggcacgguggcucacgccuguaaucccagcacuuugggaggccgaggugggcggaucacgagguuaagagaucgagaccauccuggccaacauggugaaacccaucucuacuaaaaauacaauaauuggcauggugaugcaugccuguaaucccagcuacuugggaggcugaggcaggagaaucacuugaaucugggaggcggagguugcagugagccaagauugugccacugcacuccaaccuggcaauaaagcaagauuccaucucaaaaaaaaaaaaaauauauuauauacaucaaauaugagucaggacauuuuugaaacuuuacacaaaauguaggaauuucgugacaacucuaaggcccucuuugcuucagcaaguaguugcuggaagauuacacaguuacaugacaugcauugaguaucacuuuuuucuggaacuauuucuguuuuauuucagaaccugucugagaaacucucugaacaagaauuacaauuucgucgucucagucaagagcaaguugacaacuuuacucuggauauaaauacugccuaugccagacucagaggaaucgaacaggcuguucagaguaagcauaagcuauguuuaucuuacagauaauuuuccucagcauaauuuaucaaaauaauuuuauagggaaaaugggguacauguacugacaucaggacauaaaaauacuaaucacucuacuuaauugcaguuuuugccauuaaaaguaauggcaaaaucuauauaacuagaaauuuauaccuuguaugacaaacacaaaaucaccauuuacaaggcuauuuacccaguauccuuuggcuaugucgcaugugccugggugguaagggcuaggggucaguguggucccaugcuugccuuccacagacuugguggguuaucuggagguggugauuugccgaguccaacuaccaaauggacaguauuuaugcugaggccuccaugugccacauugaaagagaaaugucaugacaaugaggguauuaauaaaauggguuuuuuuaggauguuauggaaucuuuuuuugucacauaacaauaaaaauaaauucaauacucauggaauuucaagauccaguagucuguuaaguucguuugaagucucccauuucuuuuuuuuuuuuuuuuuuuuuuuugagacagagucuugcucugucgcccaggguagagugcaguggugugauaucgacucacugcagccuccgccuccuggguucaagcgauucuccugccucagacuccugaguagcugggaauacaggugcgugccaccacgccuggcuagguuuuguauuuuuaguagacacaggguuucaccauguuggccaggcuaguccugaacuccugaccacaagugauccacccaccucggccucccaaauugcugggauuacaggcaugagccauugugccuggcccugaagucucccauuucuuugcagaaaauuucucauggccuuagcguuaagucuuagccuaauuuaaauaauauguuucuuucucaacuaguaaagguaaaaauauguggauuagauaucaugcagaugugaaugacuucugacuuugauaugaagaggccagcuaggaaaauacaccagaaauaaguggugggggugggguuguaagaaagucucucuggccucaucuugcacauguguagauguagcuuguugaaugugcaucaguucuguggauguauguugucagauggagagaaaaauguuuggcuuugccuuuuuuucuuuguaggccaugcaguugcugaagaggaagccagaaaagcccaccaacucuggcuuucaguggaggcauuaaaguacagcaugaagaccucaucugcagaaacaccuacuaucccgcuggguagugcaguugaggccaucaaagccaacuguucugauaaugaauucacccaagcuuuaaccgcagcuaucccuccagagucccugacccgugggguguacagugaagagacccuuagagcccguuucuaugcuguucaaaaacuggcccgaaggguagcaaugauugaugaaaccagaaauagcuuguaccaguacuuccucuccuaccuacagucccugcuccuauucccaccucagcaacugaagccgcccccagagcucugcccugaggauauaaacacauuuaaauuacugucauaugcuuccuauugcauugagcauggugaucuggagcuagcagcaaaguuugucaaucagcugaagggggaauccagacgaguggcacaggacuggcugaaggaagcccgaaugacccuagaaacgaaacagauaguggaaauccugacagcauaugccagcgccguaggaauaggaaccacucaggugcagccagagugagguuuaggaagauuuucauaaagucauauuucaugucaaaggaaaucagcagugauagaugaaggguucgcagcgagagucccggacuugucuagaaaugagcagguuuacaaguacuguucuaaauguuaacaccuguugcauuuauauucuuuccauuugcuaucaugucagugaacgccaggagugcuuucuuugcaacuuguguaacauuuucuguuuuuucagguuuuacugaugaggcuugugaggccaaucaaaauaauguuugugaucucuacuacuguugauuuugcccucggagcaaacugaauaaagcaacaagaugaaaacuga

SEQ ID NO: 191625 - RNA, 35976 nt, Homo sapiens
cccagucaagugguuuauuuuaaccuguaaaacaaaauaaugaagacuacaagcuucugaaucuuaguaguuccuuuaccagccaacacacccaccccccuugauugcuuauuaggaacaaagaugauaccgaaaaggggacccugcuuggccaggccuguauuuuccuuccucgugcuuaaaaaucuuccugagauguaacucaguaacaugugcaaaaagcagcggagccucuucuuggauucucagugcuacuucaaggagaugauggagucccaagggccaggguuauccgggagguggauauagcccugagccauuagggcagguaggcuucucuucacccuuucauuuaaacugcaagugaaaagucacacgacugccauuuccacagcaaaaaucauaaaaagccaaaucaucacuucugucuugguuucauccucaaucuguuuuacucugaaauuacuuuauugccucccuccucacugauguaggacaguguucaacaucuuaaaacucacacauccugauuuaacauuuucauguuuaauauuucaaaauaauguaacaaacuaaaaccuaauuuuagacugucuuuaaggcacaccaccuucauauuccuuuguauuuaaauccccuguucucuuaacagguucuggauaaaagcagucuccaagucccaaaugaguggugccaccaguuuuaaaaguaacuugcuuggcucagugcagaacagaucauuugauuuaacacagaagggaaauaaaaaggcguauuaaauuucaggcagauucgcuucaucagguccaguggucacuacaccccuguuguacuauaggucuaugcuucccugguuuccuucccauugauguauccagagguuggcagggagcuugaggaagcaaaggaugggggcagggaggagggucaccugcccacugcaacucuuacccaugugaggaguagguuucacuagucuauuauuaguuuuguugaaggacuucugcagggguugugaggcaagagcuugugaaagggccauuguugugggaacagacaccacggguacuuguggcagaacuuagauuguccugggaguaaauucugucaugaccuuuacuccucuuggacacucuuuucgagcaucuuaaaucacagagcucugaaaaacauccuugggcuugauccccagcaguccugaauccugaaaguccacagcuggacaguuuuuuugguuuuuuuuuuuuuuuuuugagauggguuuucacuguguugcucaggcuggucuugaacucaagcaauccuccagccucagccucccgaaguccugggauuacaggugugagccacugugccuggccuggacagcauuuuuuaauaggcuauuuccugggccaggaugaagacuuguucacugccuagauuuuguguaaucugauuaucccauguccuagcaaauugccuuacagcacccaaaucaaauacacccauuuuuuugguaaaaugccacucuaccauuaauguugaaucuaaaugguuguauaaaaccugccuuauacauccaugcuccuagugacucaauuuccuagcguaucuuacuuuuugaccaugaccagcaguaaaaaauuuacaucacgauuugcuacacuuaaugcauauaucuaugcacagaucuauacugcaaugcaaaaaugcaccaucacaaaacuguaggugacgugcuuagauguucuaaugcauuucauuaaaaaauugcaaucacccacaaaaacugauuucaaacccugcaguuugaaagacaaaugcuacccugucuuagagaauauggguacauagccagugacaguacaaucugacaucuuuuccucuaagccuagugcuugguauaguguuuauauagcagcuaacugguuuuuuuuuuuuuuuuuuugcuuugagguugcugaaaggggagucugcuuuacugugguuacguuaggacuucucgaaguucuguuucuuaggcggucauaugcccuacuuuuaguagcaacaugacuaaggucucaaaaucaaugaauacuuugcagaguugguggcauucauuaagcauuuacuaagaagcaccuacgugccagauuugaguuugauucuagacauguagaaucuuuugagugccauccaaccucuugaauacuuugauggcuauaaaacaacccucaaauguugaaccaaacuagaagucuaguuucugacuucuacacauugguaauguaacucuguggcaacacugagcaaguuuauuccacauauaguaagacuccccuuccccuucccauuccaugaguccuuaaucccauuugcuuuuuuuuuuucuuggagacaagggucacucugucaaccaggcuggaaugcaguggugcagucauggcuacugcagccucagcuucccaggcucaagcaauccccuccaccugucuccagaguagcugggauuacaggcaugcaccacuacgcccaacuaauuauuaaaaucuuuuguagggaggggggucucacuguuacccaggcuggucucaaacuccugggcucagguaauccacauuggcacccuaagugcugggauuacaggcaugagccacugcacucagccccauuugcucuuccaaaauucugguuucuccaagacagggucuugcucuguugcccaggcuggagugcaguggugcaaucacggcucacugcaaccucccucuccuaggcucaaacaauccucccaacucacccucccaauuagcugggacacagauacauaccaccagucuggcuuuuuauuuuuuuguagauccggugucucacuauguugcccaggcuagucucgaacuccuggaccuaagugauccucccaccucugccucccaaagugcugagguuacaggugugagucaccacacccggccgaagagaacauuuuacucauaguagaggcuaaagacuaugauaaaauaagcauuuacagagaauggagacucauccugugaggccuuaauuuuucucuauguucaaggcaguuaauugcucagaguauggguuuggaggaucuguaccacaaacuuaaaaguaccaagcuaacaaaucacucauuuugaaagucuacuacaaauucauaggccaucuacccaaauggauuuucuccuaucaacucuagcugcagagcaacauggugauucagaauaggugccuggauaggaagaggcauaccgugaaucuaaggacuguauugaauaguaaggcuaacaagagucaggcaucugcaggugcugaugaacuagagacaggaagggaccgaguuaacauuucagguggccaaggcucuccuuggaagcuguaaaccaagacugaaggcuaauuuacucucucuguccugcaaaucugcuuugauauggagcaauacccauggaugcuuaaguagcuagcuacuauaucggcuuuuuuuuuuuuugucccucaauuaaaugccuuaagaccugacauuccaagagaaaacaaaaaccauacuuugguuucuaaggauguaugacugggucccggccuucagaggauggcagacagaugggaacacaaguauaaguagacuagaguaucccauaauugucaacucuggcaagguaaagaugaagcugcuuauguggacaacucgugggguaccuaaguaaaucugggagccagguacgugcaaaguggucagugguagaagcccucaugaaggcaggaaugcugcaaaccuccacuuacugccuuccaggaccacuuaagucauagugguaagagcugcuagaaguagucguuaccaacuugauuaccagcaauacacaaugaugucaagaagacauuccacauccuucugucaucacuagcucucauuucaaccacuaaaauagguaacagcuauagacaaaaaaaaagggagacaugaaacauucauggcuguucaaguuagaaaacuauggcagcggcuauauuaacaaaaauacaaacguguacacuaauuacaacauuuaucuacagucauuuuaccaguugugcagccuaaacugccauuaucuuguuuagucauuccuaagaugcguuauuucugacaucgaaauauccugaaauugggaaacuauugacccaaccccaacuguguuagaacugcaugaacaccuaagaugaaggaccagcaucacagcagcacaucaggccaacaaaggcagaaguccagcagcaggagagggcaaucgcacgaggacagcaucgugaggucagcucaccgacacucuaggugugcaggcuuauccugaugacaagagccauggaccucaccaugugucugaaaaccgcaauguugcuacuuaaaugcuaagccuuuaauggugcauuaauagaugguuaaguagcauauuagcagcuuaaaucuacauaagucagcuguguacugacuguaccucacaguaacaaauucaccaaaucuguaucuuuucuucuuuguaacaauguuaaauauugguauaucucaguucucaggugugauuccagcagcuauggugagacccauugcugcuccugaaucuccacuuucauuugccuucacuggugucacugucgcugucacugcugcugucaguaucacugucacuggucaaugcaguuagauuacuuagggcuucccuguuaagaaaagaaaauggaggauuacacugcaauucaacugggugcugggguucucggugucucugacacucaccuauagccugucaguuuugaaaucagaaaaagggacccugcaguugcauuaaacuauauuagaaacaaaaagcuucuaacagucaaaucuauaggcuuuccugacuugcaugacaaaugaaauagucauuaaauuacuacauucugacuuuuugaaaggaaauagaagggauagaaagcuaugaacauuuugaaugggcagauggaugaaaggucuccauuuuacaaacuaugcuucauggugaccacuuacuuuuguuccugguugauugcaaaaucacucauuacucucugggugaggcccucacaaauagguaagcugaaggcacuugccagcucuacuacuucaauggccugggaagggcuguuagacacuuuugcacuguccauaagcucauucagcaacucacuucuguaaaagaaaggcaaagugugaacuuucuccagccccuucaguaaaacauuuauaggcaagauccaguguaaguucaguaacagaauucccaacaguauuucuggagacaaagaugaagucuaacauuuauuuuuacuuguuuccagugagguuagaaagucuaaagggccaaauggauuaucaacauucauucaguaugacuucaugaugaucuauucaauguagccccaauguaugaugauccgucaacacagauaaaaaacugcuugccucaggaugcccuggauaguagggaguugacgguaugcuugccuaacagaagagugcccaaaugugguggcuaaggcuggugaagaaauuccaaauguggcuacuuccaggcuguacccaaagagagcuggcugauuucaacuuaccuaggaaucuuauuaugcuuccugaaaagccccaacauuuuccugcucaagaaaggaaaaagauuaugaauacuauuagaaaaacaaggcaaucagacacuauagcugucuucucucugaaaucagagacuaaaugcccuuuucuuaacuauacuguaagcucccaaagacacacaucugugggcucuacuagcucccagcccuguguguacaugagaaucaccgcaggugcuuaaacuccccaaacgaaucuacacugcaguuuucacagguaaaucugauaugcugccaaugucaagauuugcugguacagguugaauauuccuaauccaaaaaugcuccaaaaucuaaaaccccauacacuucuggucuuaagcauuuuggaaaagggauacuccaacuguauuuguccucuuguagaggaucaccacuguccuucuaaggagggaauccauccugugcacagcuggaaaagaggcauagaacagaaccugcuguuucccucucuuaaaguacagcagggguucagucugucuuagaauucuguuaugaagugcaggcucagauugaggcaacagucucauguaagugcuccccaucagccugccacaugcaggacaaaggagaaacacauacauucagcucccaugacucagcugagguccguaccccugcgccaaucaucacagccugguuguaucaagugugugccaaacugccugcgcuaacaaccaaaugcaaaugucauacgucucugucacuagcagcauaguugcuagagagacacgugugagccacaccucaaagacaagccuucaucaucuuuuccuggagauagcugacuagcaaucagauguucaaauaaagcuacuuucuuguacaaggagccaugcacaagcaccccccacuaaugacuuuuagaacacacauuuauauacaaaacaaaauacaggaaaaccaccugucacuaccccuacaaaagauccuuuugcucauuuuuggaaacaugaauaugcauaagguucccauucacaaacacuaaaaauuaguaugugaaugaagugcugauaaaaacauaaccagaacacaguggcaccaaucaaggacggguuguggucaaggccaaguuuaguuaaugugcguaaaugccagcuuccagaagucuaaguacacagcccacauuuuaagcuggagagugggaugggagaagcauccaaaaauacuucaauaacccaaaugaccaaaccauuuucaaaacuacguuucuuugaucauauauuucuuugaucuuuaguucauuuaaguggaauaaugagguuaagugacuuacuuguccauagacacagaaaguagaaagauaauucucagcguaugguuugagagaacuaugccuuaucucaacuacaucaugcauacugucuucuuccaaaaguuugcuuuuuaguugguauuugcaaguucccgaaucaaauacguguuauguggccaaaugaaagaaccucuaccagcgugggccaauguuuuagauucaaauacaaaagcuucuaaaguguauacuugugguacuguacucaccaggcuuccugaguucucccagcccuuaaaaagaggauagcuauacaguugagagagguggcuggccaauccugagcagucugucugauggguuggcuuucauacgcagauuugauaucagcagcacagucagcaaaugccaccugaagcugagaagcuuaggagucagcagaacugccuaacugauuuuaugagaauuucaguucaggagacuaacacaggauccuuaaaaucugagcaaugcauuuuaccauuugaauauauuauguguauagcacacaaguaauuuaauaaaaaaaggacccuguccuaaguauuuugauuagccacaacuuucaaauucagcuaugcauuuccuuuguagauggagauuuuuaaaaaagcaagcugaagacagaagcuaauuucauguugcuugcuuuggacuacaggaaagaggguaacuuuaagaacagauuucugcuaagggcaagauauguuuagauguaucaucacucaaauauggguuuggguagcagaacucuccaaaauggcagauaaaaccagggaagcuagccuuaagaagaccucaguaugggaggauauacuggcuggugaguuucaggccuaccucuggugggugcuugucccuugccaugagcaucaggaucucuucucucaggucacugcggaaaguaugaccauauucuuuacuaucuugaaacaagaaaggaacaaggagugaucauuguuauguaaaaccaacacacuuuuguucacugucaaccuauuuuuugguagguaaaaauaaguugcuguuauuuauucuaggcuuaucccaggauuccagaaacccaccaggauucacaguggaacaaauguaaaagccaaugccugggccuugcuccagugacguguucaucacggcaugugcacuacaugggagcagccaccagcuccacgugguuaagacguuguuuuauagcacuugggaauuugauauacuuuuaucacucauuagagcagucgugugaagcaggagggcgggacuagagccuacugacuuuaugauacaguagucaccuagugaaagauacagaauaucuauuucauuuugcagccaaguuauacacauaagacacacacacccgugaugcgugaugcucauggcuauuacuuggaaacagaaucaucacugacugugguuagugaagugaggcaacacuggcacagaggaauuacacaggcuuccgggucaaagaccuuuauucagauuuagggucugccacgccauuagcauuuauuuucuuugggucauaucccgcaacaggugcacaaaacucagcucauuccuaugucacgaagggacugacuuaagucauuuucaacaaaauuuucuccugauagccaacaugcaacaugagcacaugaccuugaaguacaucucaacuaacacauuugguucagucaaaauggaaguuuucaucccuaacaguaauguuagcacauucauuaucaaaguagaggauauugaggugagaugcaccuggacacauaaaaaguaaaacugaccuuuccaaauuuuaggaaucacuucuagccgauuggccacauccaaugcuuggagaagauguaucauuguuugggaguggggaaaguaggccugauuaagagaaacacauuuuuaaagcauuaaucugcagaaacccaauucaucuagaaugauaaauaacaaguaaugaaccaucuuacugaagguaucagguccucauaccacuucaagguaacaucaauuuguuccauuagacaaaucaaaucgaagaacuuggaacugugaugaaggcaaaaaguauguuuagucuaaagucccuaugucuaacaacaggggaaauaaggguugaaauuauagcauauuauauguuacaaagaauuucaaaauacuuacaguuucaaguuaaacgagccaauauuugguuuaagagcugccagugugugcugacuucucaauuaaacacccuacccucaacuggucauuucuaacuguuuccucuguauacucuuaggucauggugaauagauacugaauuucaaauucauuuuaaaaacauucaaugugaaacaaggauuuggauacacagaaaacaauucucacacaucuguuaacaugcugccuucuuaaauucauguucuuaucugccuaaaagcaaacccauuuagggaguaucucuagguuccaguaucuucaucuuugaauacaaaagcaagggaggugaaaggaaaucuucagggcucacccugcuauaacaauuugaaaauguaaaaugagaggggguagaggaaaaagauauguggauuuuacaguguugcaaaaaaaaaaaaaaaaaaacccuuaaaggacacaaacuagucuuucaaaucuggcaguuuuaccacugcuuuaauuccuaagugcucaauuaacauguccuauuagaucauuggcauguugccugaaaccagaggugagguaugaagggacaucaacagccucccacuugcagaaucugguaacucaugcaaaaggauauguuuccaacacacuuacuaauagaaauuacgauguugaucagguccaaugaauuuccaguugucuccgguuuuuaaaaggccauguacuugguaggcaaguucuagaucucugagagaugagcacugaaaauaugcaaguaguaaguaucacucugauacccugucagccagugguucacaaauaaauaacaacaguagagugucuugugaaaauaauguugauucaacauauuauugguugacagcaaguaaguuauaagaaaugggggggagacaaaucccaaguucugugaaauuuauuacaauauuauuuuaauuaagcaauuauaccauuaaaaauuaauccuguaacaacaccuggucaagugcacaaaagacaccugcacugcagagucuggacuaguaaaaaucuccaugaaauaacuccaaaaucuacccacaggaaaguuaaguuaugguucuuacuaugaaauacugguugcugccaacaaauaaaacacccugaaaguaugccuggauauacauacgcuugaguacccagaguaaaaaccuugugaggauccauacuaaauacuagguuggugcaaaaguaauugugguuuuugcuauugaaaguagcggcuuuuguaauugcgguuuuugccauggaaaguaauggcaaaggccacaauuacuuuugcaccaaucuaauaguaaagcaauuaaauuacccuuagggaacaagguucauccuaaaacugccugaaauuuuuccuaugauaagcaugauuacauaaacuaaaauaaaaaccauuaucaauuuuaacuuacuaauaggcaaaucugaaauauuauggaagcuuaucuguucaggggcaugaaaaaugucaauguaaacaauaaacaaaggguagggauaguaugugauugaaaaguacagauuuuaggccaggcgcguuggcucaggccuguaaucccagcacuuugggagguggucaggaguucaagaccagucuggucaacauggugaaacuacaucucuaccacaaaaaauacaaaaauuagccaggugugguggcgcacaccuguagucccagcuauucgggaggcugaggcaggagaaucgcuugaacccaggaggcagagguugcggugagccacugcacuccagcaugggggacacagugaaccuccaucucaaagaaaaaaaaaauuauagauuuuagagaaagaagaaaaaacagaagcaaagacaugaacagaagaguuagaaagugaaaagaaccagggagaacccuccaguuacagauaaauuuaggaaauggauagcaaauuaauaaagaaaugauacuuacuaugcucauggcugacugaaaaaacuuaucugaaaaucaaaguucacaagagcuuugguuacaauggauaaaauauauuuucaagucaguaacauuaacaaaaauccugccaacaaaacugguaacaugcaagauaaagcuaagaacauaaaaacuuaagagaggcaggaauguaccacaauuuuggcuuucucagaaagaccauggcaaauauuacuaagcuauauacaccuacuauguacucaaauuuauuuaaaaaaaaaaaaaaauacuucuaagcuauagggaucacaaggccucuaacugguacucagguaaaccggcccucugucuuuagaggaggaaaacacaagugauuucuauacaugccaucauccggguccuuuggagaaaaucucuuucccauuaauucauucauuauaucauaaaugaugaaggaugaucucuuuaaagggucuccugcagaacaagaaagcaaauguguuuaauccacuuccuuuaccaccaccaaacucacuguaccuaauacaaagggacacauuucuccuuccuccaccuccagccuaaguccucgcauagaucuggguggaggccaaugcuugcuaaaggaaccacuauacccugcagagagcaauucucuguaaaaucuggaauaaucacaggucucuguucaugugcuccacugagacuuucuccuuccuuuagucucuucacaugaagccugacuuacugaaguaggcggcagacaguaacacacacucccucaccaaaccagcauacuuagaaaaacaaaauuuuuuuuuuuuugagauggagucuugcauuauugcccuggcuggagugcgauggcacaaucucggcucacugcaaccuccgccucccggguucaagcgauucuccugccucagccuuccgagcagcugggacuaacgcccucgccaccacgccuggcuaauuuuuuguauuuuuaguagaggagggguuuccccauguuggucaggcuggucuugaacuccugaccucgugaucugcccgccucggccucccaaagugcugggacuacaggcaugagccacugcacccggcuaaaaauguuuuuugcuaguaaucauuuguguucccuuuaaauauaaucagaaugaggucaagaaaaaguaaacuagaauuaauggacagggcaguucuuaaauauaacaugaacugagcacuaauaggucagaaaaucaucugcaauauucccagucaaauauuucucuacacuccuuucccuaccuguuuuguauguuugugguaguaaagcuguaaugacaguacagauagaguuucacaauuuacucaagcaugcuucccuuugcuaauauucuuaauuuuauuaguuacauaauauucucuuuucaauguauuguuucuagguuauuuuaggcucucucuuuuggguaaauuccuagaaauuauuauuacuauugagacagggucuugcucugucaccuaggcuggagugcaguggggcaaacgcagcuuacugcagcuucaaccuccuggccacaagcaauccuccugccucacacuccugaguagcugggacuacaggggugcgccaccaugcccagcuacuuuuuucauguuuaguagacauggaggucucucuauguugguuucaaacuccugggcucaagcaauccuccugccuuggcuuccuaaauugcugggauuacaggcguaagccaaaacuacugcugcagacaggcaaauuuauauacauaagacaaaccaacacagcucccccagaacccccaucccccaguccuggcuguuacuuaggaaauguaaguacaucugacuuugauuagcaauugaaccagugaugagaguuacagaggaaaggaauauacuuuggagucagaaauacuagcuccaucacaaucucaccaagguugaguaaaauuuuaggggacacaauuauggaaacuguuuaccuguuuccaagguauagucaauuaacugguuccuuuuccuaaagauaaaauuugccuauacaggugaggauauggauuuuacaaaauuaguccuccaaaccagagagaaacaacuucccuucuguaauuuuuauagucuauccacaagaaagaaugacuagaacugucaauucugaacucaaggguuauuucucaggcuggggauaauggacaagaaccaaaagauuuugagugccucauaugugcccuccaagcacaguagcagacacaguguggaacucauuuaacuaccacacccugcugcuauuccucagguagguaucuagucgcuuugacauagcugguaaauaaaugguagaguggacaucucagcucaggugugucucucuucaaaguccaucuacuacagagcagagcucccacuggaacugaccuaaaaguggacaacgcauggagccuugagguccucccaaaacgcuucacaauaaguuuaccuuuccucuggagcagaaacguccacaaacuuuuggcaaagauggaaauguucugaaucugcaucacgacacaugguagccacuagacacauggcuacugagcaccaaugugacaaaauaauuuauuauuuuacuuaauuuuaauuaacuggccacauguggcuaguggcuaugguguuaaauagcacagcuccagagaacaaaaggaauuucaaccaaaauauauucuacccaauuccuguuuguacaacaucacugccaguacaauccauaacccucuccccuccagcucaaguuuuagaccacaaacaagauugcuacccucaagaauaauuuuagguaguaagacccuguccaaaaaaaaaaaaaaaaaaucagcuaggcaugcuggugggcaucuguaauccuaacuacucaggaggcugaggagggaggacuguuugagcccaggaguucaaggcugcaaugggcaagauccuguaucuaaaaaaaccacaacuuucugcucaggcuguacagguuaauuuacaaauucucucuucuuaauucauaugcagagaagauaacuacaacaauuaaucacauaaacucaagaaagcuggucaauuuucuauauaaauuaacacaauuuaaggccauacauaccagguugaucaaacaggcgaauaauauggugauauguugcaagcgaggguucucaaauuaccagguagacagaaaaaauaaacaaugagguaaaaacacagcaauccaaaacauaguuuacugagacacacugaauuaaaaacauauuguuaauauuuaagcaaaauaugcauuucuauuccuuugaacaaaguuauuuuccaacucauuaauguaaagguaaaaaacuaucacaaagacuguaucacuuuuugaaaguccaaauacuuauuagucacauucuucacugagaacaguaaaauauauugaagugaauugauucccaaagcaacuuucaauaaaguaauuaaugaaaaauauacaauacacuagcacacacuuagguucaaauaccuaauuauguugggaaaaugucaugaauuuaaaacuagcuaacucaaagcaaucacuucuccucagauucaacagauccauaaacaaaguaccuaaaauacuaaugaacacuaagaugauaaaggcacucccacuauaauaaguacauguaaguaaaugugccaaacauggaaagaaaauuuccaacauauuauguaagcacaagaauaauuuaaagcucuuugcuuauguagcccugaaaccucuggcuggcacagucucuguccucagagaacucaagggcgcauccucaccuauuccaauggcuuucauuucacguaaaaccuguaaggcuggcgaucuugcaaacacaugaaaucuucggagacauuucagaaugguauuaaaagucugaagauuugguuucaccuucugugcaaccaugugucuuagcagcuccuaggugaauaaaaaacaagaaguaucuuucaugccuggguaaucuguccaauaaucuauguuucauacaaaguaaagaauuuagcuuucuugcuuauguuuaaagcagguuaguaacuauaucccucuuuuaagaacuguuuauuaauuagcagguuccaugauucugccuuuuaaagaagccugcuaauucaaacacccaccccacuugauagagguggucaacugucuucagucuucuaccuaggagaguuuuccaagaaaagacgcaaaaauaauagacuaguaugauauaaaaaagugguugguuuuuuuuuuuuuuugagacaaaguuucgcucuucuugcccaggcuggagugcaguggugcgaucuuggcucacugcaaccucugccucgugggcugaggugauucuccugccucagccuccugaguagcugcgacuacaggcgagcaccacuaugcccggcuaauuuuuguauuuuuguaguagagacgggguuucaccauguuagucaggcuggucacaaacuccugaccuaagguaauccacccgccucagccucaaagugcugggauuauaggcaugagccaccgugcccagccguuucuauucuuaaguuacuaggcgagaaucaauccagugauuucaacuuuuugaaauuacaccugauaggauuugacagcaaauaugcauuacuuuguaacagaaaaacuauuaugaaaaauaaaugaauaaaaugguccagaauucuagcucuauacucucggucaagcaacuuuuucuucuuaugugccagacacagcugagucccagggcugcggaaaggguagugaacagguaacugcuacacagugacugccauacacaugcucauaaaugcugucuccagcccauguacuucuguuucuuuuucuuuuuuuuuuuuuugagacggagucuugcucuguugcccaggcuggagugcaguggugcgaucucugcucacagcaaccuccgccucccggguucaauagauucucuugccucagcuucccaaguagcugggauuacaggcgugcaccaccacgcccagcuaauuguuuguacuuuuaguagagacggguuucaccauguuggccaggcuggucuccaacuccuggccucaggugaucugcccgccucggccucccaaagugcugguauuacagguuugagccaccacaccuggccagcccauguauuucugguaaagaguauuuaagcccuauuaaaaaauaaacugaggauuccuccuuaccaguauuuuacuccauuuuuccucaaauuucucauuuaucgcacauacuguugcuucaaucaaugcauuaaauguguauacaucagcuguaaaauaauaaaaugauaaaauuugggguugaagauuaaucccuaaauggcugaguuuaaggcaaagcagucauuccuaugugucccuugacuaaucacauguccacaaaacuggaaaacuacucuccucucuggaucucuacucuugcuucaaucaucuacgccucaggaaaagguaaaguguaggccaaugacugaggcacgauccaaagccuucacacagacaauuaaaagaaggaaauggagaaagggacagaggggaguucucaaacucaccauggagucuguuguuuaguaacucaguguacaaguuuaaugccugcucauaagcucggugcuggaaaaggaaaaauuaagcaucaucaaauucauuuacuuaagaaguccuugcacauuucuguccuagaguuugguaauauagcucaggcucaauagaucaggcuccuguucucaugaagcucauacucuagugcagugggauuuucuauccacugguaaugccuaaacauauuuuuauuugucacaacugaaagugggggaggaguacacuacucacauccaguggguagaagccagggagcuacuaacauccuacaaugcacaggacagaccccacaacaaauuaccugacccaaaauguuaguaguucugaggcugaaacacccugaucgguggaaaugaaagacaaaaauaaauaaaacaaauguaccuucaccauuccucggaucauugugcaauaggaauguucauuuuucucuggcauuagagaaaagauucucucagcguuguuuuuugcucuagacacaagagaguaaaugugaacccaggcaauaagaaauaccaaugagagcuaccaccauuuacugacgguuuauuauguucuaggcaaugugccaaguacuuucuauacauuaucucaauucuuacaggguauuaugguuauuaucauuuugaaaauggggaaaaucaagacuuaacgaucuuaauguguugucagggcuucgcagguuaaguggcagaauuacaauugaaaaugaaaaguuuauaaacaaguauauaaauaucugugcuauuaaaaacaagaagcaacuguaugacaaagucccuaguaaaguuuccucaccuuucuucaaucuucagauacuacuucccagaggcaaaacgguuucuuuuggauccuucuggucauauucuagcauauguacuuuuaacucuucucucauuccauaaccuccaccuccuggguuuaagugauucuccugccuccaccucucgaguagcuggaauuacaggcacgugccaccacgccuagcuaauuguuguauuuuuaguagagaugagguuucaccauguuggccaggcuggucucaaaccccugaccucaagugauccaccugccucggccucccacggcaccaggauuacaggugugaggcacugcguccagccuaccccaaggaauuuaaucuuucauccuaucaaauucaucacuucaauaacaauuuuagauaaucaugguagcuuucccucuccagacauucacaugaagugucuuccuuuuagacacccagcuaauucuccaauauaauuaaguuauuaccuuucauucaaacugcuguguaugucuacauguugucaguggucuuaauuuagcaguacacucuaguguccaugauauuuuuaguaaacaaaaguauuaaaucuuucagaauuagagguauauauuccaagguagcacuguuaaugaaacuaccaaaggaaccauaccauaugaaaguuaugcugaguuaaacagaugagggaaaaaaaagggucaaagucucaacagauucuuguguuguugaauggagauaaagaccuuauugaaaaacggucuaaauguguaugaauacaaauagugaaauuuauauugcacaauaaaaaucaauuauuuuagaacaucacaagaaaacaucuucacagggugauggggcauauuccaugcacuguaagacacuguaauucaagguucuaauuacgugugacauaccgccauguaacuccaaacugaugaccagcuuuccuccuagaugucucaucauuuuccucuuccugaaaugaauaaucaucaaaagaaauaaaaguuaaggcaauggaaugcauuucccagucagacuacucaaaaucagaaaggcaaagggaacucagaaaaauaaaggaaacauagauccagcagaaggcaaagaggaagcccaguuacgcuuacaccuauacaguuaauuucuuaagugcaaaucagaugaaaggccaaguugacucucaaagcaacaagugacagcguggagacaagaugaagccaguucccuguauggccugguccucagacagaaagaggaaaaccaaacaacacagccuauuugcucagagacuacaucuggcuugauccauacagauaaacugucauaauuagggugaaagcaagauaaacaacauauaguuaaugccuaacacucacccaagcaaacuaagacuucuuuuuuuuuuuuuuuuuaagacagagucucgcucucucgcccagguuggaaugcaguggcguggucuuggcucacugcaaccuccaccuccuggguucaaggaauucuccugccucagccuccggaguagcugggacuacaggcgcgugccaccacgcccagcuaauuuuuuguauuuuuuuuaguagggacgggauuucaccauguuagccaggauggucucgaucuccugaccucaugauccacccgccucggccucccaaagugcugggauuacaaguaugagccacugcaccuggcaagacuucuuacaagaauaaaucuugucuuuauuuauaaaccaaggucugggaugaggcugacguagagcaauacaggcuugguuggcauugcagaggucaguguuggcucuguagccugcugccucaagagcuggggcuggagaggcagagggccaaccagagcagggcuucaggaagugauacucuggaaagcaagguuuaacugcaaccuacugccuaugcacuuuuaaaaauguaaaguucucuacauaaauaauccacauuuggccaggugcaguggucaguaaucccaaaacuuuaggagacugaaggaucaccugagccccagaguugaagacaccauccugggcacuacagcaagacccuaugucuacccgcccuccccaccccaaaaaaaacuagccagacaugguggcccacacuuguggucccagcuauuugggagaaugaggaaggaggaacacuugagcucaggaguuaaaggcugcaguaagcuaugauagcaucacugcacuccacccuaggugacagagugagacccugucucugagggggaaacaagaaauccacauuuaguugggcaaagaguagaaaagauagaaacgaagaaaaacaccaauaaucccaucacccagaaacacuuuuuaaaugauuuuuuuguaugcauuuguaaaaacauuuuuacaaaaauggaauauauacugcugauagccugcuucccacuuauuggaugaauguuuccauacccaaacacaucuacucuaaugugcucaauggccacacaacuuuuaucaucauuugaucaucuacuguuggacaucuagauuguuuucaacauuuuugcaaguauaaauaccuccucaugaaaaaugucacaugagcaucucuauuugacugauccaaaggauuucuugagaccuaguucuagaaguaaaauucgcgagucgagagagaggcuaugacucaacuuacaggcgggccccggcacacuacuguucugucuccagccuaguguguucucuccucuaaguccacguaugaauuuuugagggggcccaggccacggagucuuucccuggccagaauacaucaugucauuacucuaaguggcacaggccagcccaaacauuucugaucaacgcuuugccuuaauaugaaguaggugaggacaacauauuguuaaaaaguaaacuaggacagaaguaacuguuuaaaaucucucuuccuccuauaccacuuuuuaucaaggcuaucguaccacacaucucaguacaaaucucuacuacccugacacauggcaaaacaacccaucuuauuuuuaaaagcaauuucuucaaaaagaagcuuaaggaaaaaaaaaaaucaaggccaacaguuauuaccaaugcuucugacuguccaguuuguugaaaaugguaaucaguugagggcuccuggucaccauaguaacacaauaaauccaagagacuauuuguuguuucaagagacacagugguuccuguggguaagagacagaaagauaaagaaaccuugaaacaaugaagaacuaaagccuguuagguuaaaaugugucauuuuuuuauauuagcgguggucuucagggcuacacacuuaauguuguccacuacuuuaugcacucaacgucaacuuaaacaccugaagugacguagacagggacauaaccccuauuaaccauguaauuugacguagaagauuggaacacaagaugaaguuugggccugugcucacuuauuuuauguacucauuauccucaaacuacuucaugguuuuaauuaucaucaccaaacugaacacacugcaaacuauccccacuuaguucccccagcccaggugcauuugaacaaaugcaaguagaauuauuccauuuggauccagauacucacugaaaacuugccuagaaauacuagcauaauugucgaacuauaguagucucuuaaaaauuguucaaaacauuauguccccaucuugacacucauuaaaaaggcuaaaaagggaauaggaggaagacaaguaugagauauaaucugcuaucuuauaagaaaaguaaauguaucuuuuuguuuugagauagggucucauucugucgcccaggcuggagugcaaggacaucacagcuuacuacaaccuugaacuucugggcucaagugauccucucaccucagccuuccgagcagcugugacuacagguaugugccacugcaccuggcuaauuuuuaaauuuuuuguagagaugaggucucgcuauguugcccaggcuggucuugaacuccugggcucaagcaauccuccuguuuuggccucccaaagugcugggauuacaggugugagccaccaugccuagccaauaaauuaucuuucuaaacaaaauacauugauaaauuuaaaaugcccaucaggaaauguaaaaaguccagaagagaaagcagggcagaggguacaggcuauggagaagcaacugguucacacuaucucaaagcuaugagacccuggaaaaauuaccuaauaauuaccuucauaagauuauuauaaaacacaccaaugaauaagguauuguagaauuaaguaugugaaauggcuagcacaguguuuugcacuuauuaggggccugacaaugaaauguucuaggauccuuucccugguauguuagcucacuuuguuacugagcuaugggucugacaccugucuuuacugaaggacugcacacaccuauccaauaaaggggguaaaacuagaaaaagacaagccuuagcacuaagaacuucaaugcagacucacaccagaugccgaucauauuaacaagcagagggaagcgccucacuaaauuacaaucuauugccaucacucagccauacaucugaugcuguaccaagccacacaccaaaauucucaaacauagcuuucugcaaauguuucuuguguucaaguguauaaugauucaguccaguuuccaccacuuccauguuuauucuaaaucaccaaauagcacucuagauucuaaaaacuuaaugccagcugcuucugauguugcuauauguagauuuucauguugacuuaucagcugugcuauuuacguguguagcuccgcaaguuuacauccagcuccaauucagagaaccacacaauuuuagagcuagaaguuuugagaaauuaaguaacuuuuugaaugcuaagaacaauuagugacacagauggcaccagcaucaaagccccugauccuaguugagugugcuuuccuuuucacguauuucuuucuuguguguuguggcccaaucuuccaaacauccuuaaagagucuaggaaagcugggcgcgguggcucacgccuguaaucacaguacuuacggaggccgagguggguggaucacgaggucaggagaucgagaccauccuggcuacauggugaaaccccgccucuauuaaaaacacaaaaaaguuagcugggcgugguggugggugcauguagucccagcuacucaggaggcugaggagggagaauggcaugaaccugggaggcggagcuugcagucagccgagauugcgccacugcacuccagccugggcgacagagcaagacuccaucucaaaaaaaaaaaaaaggaaaaggguacaggaaaucugggagcacugcauaccuaccuaacauuaaaaacagaagcuaagguagaagggugauacaauuucucuaccagugcuacaauaaaccaacaaagcugcaauucuacuucgccuguaauucuuaaguaacacuaaagcuaaaaaugaaauaaacuacuaaaaauauaaagcacgcagccaucaaagcagaguaaguacagcaggaccuguaacucuuacucaaaauauaugaaucauauaacuugggcccacuucaaagcccauguuauuagaggggcuuuaaucgaacucagucaccugcuugcaaaagcugaucaaacauguccacagaggcuuugacuuuucugagcucaauucguuccuucagggcggcuucacuuaugucuuugaucugagguucaaaguacucaggcauuaaacacuaggaaaacaagaugacuaaaguuacuacaaacagguaaaggugagggaaggauaacugaguaggacaaaacuuuuaucaccaacauaccaaaguaaaacuucacugcuccaauucauguuuccugcaccagauacuacugaucauuuuaacaucacugucuucacagggaauugaacuaaaccuuucaucucuaaugcuguguaucaucuaaacauuuaauacuacccaagguaugcugauuuuaccucauucacuaacuuauucaaauacuuucugaaugccuacuauuuuaccccagacauuaagcuuggcacuggggauacagagacgaaaggcauucucuaccuucagggugcucacaaucuaauggagaaagacacugucuuaguuuaggauuuuaauauuuugacuuacacaaucacacuggcuuccucaucuaugugcaaguucuacuaugaaaacaagaaguguguguuucccugugagcuuugggaagcagagagauguagggauaugggagcaguuuagauaugaugagucugagauuaguacuuccaccaacaaacucaggagggcagaggcgcaucuguuuugcucaccacuguauggacaagcacuaagcacaauacccaccacacugcauaaauccucacuccaaaacuacagaacaaagagggagcuggaaauacaauguggaguucaaaguaaagggaucuaggcuagauauacaaaagaguaccaaauggauuauaagcgucacugaaacagaagaguauacacaauaaaaagagaaaaugagcauaaaaaucuaagaaagauacccaugcuuaagaaguggaucaaggccggacacgguggcucacaccuguaaucccaggacuuugggaggccaagucggguggaucacgaggucaggaguucaagaccagccuggccaagaugguaaaaccccgucucuacuaaaacuauaaaaauuagccaggugcgguggcaggcaccuguaaucccagcugcucaggaggcugaggcaggagaauugcuugaacccgggcggcagaggcugcagugagccaagaucgugccacugcacuccagccugggcaacagagugagacuccaucucaaacaaaaacaaacaaaaaaagaagcggaucaagagcaagcagcaguggcuuacaccugcaaucccagagauugcagaggcugagaaggguguuugcuugagcccagaaauuugagaccagccugggcagugcagugagacaagacccuguucucuacaaaaacuaaaaauuaaaaaaaaucagccaggcaugguggcacaccccuguaguccaagcuacuugugaggcugaggcaagaggaucacuugagcccagggguuccaggcugcaaugagcuaugauuguaccauugcacuccagccugggugacagcaugaugccguuucaaaaaaaaaaaaaaggaagagaaagauguguauagagagguagugaaggaaacuucagucauagaauuaaagaccuaagagcauggugucacaaaaaucaaauggggaaaauauuaagaugaagagcaaauaaauacagaaagaauuuuaaaguuagucuugugaucaaagcuaacuccacacuuuaaaaggcuuaucauccaaauauugaggguauucaaauagcuacugaaauauuagccaugaaagccugguuuaauuuacauuuaaaauaguauuauguaaauaauguaacuaccucuccuuaccgguauaugagguucagcuauguccuucugaaaauauuugggguaugaauuaauaauaaacuuggccacauucuccccggauuucuuugccaguaaaaaugaacgcuauauaaagaaaaagauuuaaauacauguaauuuaaacucaagcaagauuauaguuacacucucagcaagaauuucuccccccucacaaaaaaaaacaaaugcaacaacacgcagaaucccaauuagaaauuauagacuaucccaccuuuucuacugugauauaauuucaguuagcaucuuauacacagcuugaaauauauaaaaagcaagccauuuaaacugagugggucacuccagugugaaaaagcccuaaguauuagaaaccaaaaccaaaaauccuuuccccauugacgauauguacaucuuuuugaagaaaguaguaaaggauucacauagucuaucaauuucucagcauuuguaaaccuuucccagguuauuacaacuaaauuauuuauguacuguuguacgcaaaccagagagauaaaacacuagaaaauuauaugaaaauacucacagauuccaaagaugaugcuggcauaagguaaggaucaucuugaaacacauaaggcacagcugugguauccuguggaaaagacauaauacaauuucuauauuuauuuugaagacagcucacuguaacuuuuagcuccuggacucaagggauucuccugccucagccucccaaguagccuaggcuacaggugugugccaccacagcuggccauuucacaaaauuuuuugcagagagggugucuugcugugucacccaagcuggucucaaacuccuggccucaagcaguucucucacuucugccuuacaaagggcuaggauuauagacgugagccacuguauccagcccacaagucuuucuagcuaaauuuuuaagaggaccuugugaguuuugauaaacaaaaauuccguaaguuguaauuauguauguaaccuaaaugcgcaaacgugugugggcauauauacauguauauauagagaaaaaagacaaaagacaaacaccugcacuguacucucagcucuacaagacuugccuuuaauuaugcaaggcaagcaauggcuuaagccucccuccccauggcugauuuuaauauuuaaguuugcuaccacuggggacuguuuuaaacucuagguaagaaucaucugaauuaacuaguccuaacagcagaaucccagaauaggauuuccuccaaagcaaggucacuauccacccacgcucaacuucaccaagagucccuccuccaaauggaagauaucaccgugcccucugaggaaugaacaacagaaccuucucccacguccuguuacccauuaaaauugcucccuaaaccugagcauaaucaacucuccaauaccaccaggggccccacugagaaaugccccagaauugcuuucuuuauucucuucugugucugagugccuuacuugggccuuuauuccaaagcaaaaacuuauccuauauccuuaaugcuguuuuacugaccuggacuccucagggagggggcacagaagcuucccugcagcucucaacggaaagcugcucauaccuggaaccuggaggcaguguuuuauuuuggaccuagcuuucugcuaccccuuucaaaaaccccuuucccuugagccucaccuuagcagcccuguugugaacuucaguuuuuauuugaauuauacuaauggaaagccaauguugaauucuuaagagugauaugauccagggucacuacagcugcugaacugagagcagugugcagggaggugcagugggagacgacagagacugcugcaauuaauccagacuuguaagacgacaauaaccaaggugacugguagugauaucaggcaucuaaaauuuugauauuuugcagaaaagaguuaacagaccugaaaccauuauccuuaggaaggucugcguccaaggcuggcccuuggcugccaucugggaaccuggauauuggaaggguucucaccauuccuagaacugcuaagaaugguucacugugccuaaccuguuuguacaacguguuuugugccaaacaccugcuucccuucugggaguauggaaacuugguauaauauaugccagccaguggguggucuacauggccagccuccccuaaaaacucugggcacugggucucuaaugagcuuugguagacacuuugcauguguugucacaagucacugauggaggaauuaagcauguccuguguugaaucuucuggagaggucuuuuggaagcuugugacugauuucuuuuggucuuuauccaaugagccuuuucucuuugcugacuuugcuuuguaucuucuugcugucauaacucuuagccugggaguggucacggagaccucacacacacguaucuuuugaagggauaaacaaaggcuuugcuaacaauucccaggauuuuggccugagcagcuauaagaauggaguugccauuaaugagauggcaaagaaauaugugaggaauguuuggagggaaugggguuugguuuuggauaugcuaagcucuuuaucacacucucaaguggaaagcuuucccauucuccacauagcucucuuuucuaaaaugucugcuuagaauuccuuuacccccauccuggcuaacacagugaaacuccgucucuacuaaaaauacaaaaauuagccgggcgugggggugggggcgccuguagucccagcuacucaggaggcugaggcaggagaauggcgugagcccaggaggcagagcuugcagugagcugagauugcgccacugcacuccagccugggugacagagggagacuccgucucuuuaaaaaaaaaaaaagaaagaaaaaaaagaauuccuuucucagucuuggcgauacaaccccuucucagugcuaccucagucuuccccucuagaacuacacaauaucugugucuaauucuauauccagcacagugcuugauaagcaucauaagggcacaaaauauuguugcugaaugaauggauaaacgaauaacucuuggauuuuaagggccagauaagucacaauucuacacacaauucuauaacuucuuugauuugaaaguggcccugggccauucucauugaaauguugagaauaucucggagguccauuucuauguuuacauuucaggugccuauuuauggauaagugagcuacugaaaaucucaaugcuuugcaaguagggagauguaguaaaguccuuuuucagaaacugguagaguacaccagugcacauuagacccaacacuaucuuuaguagcuccaucuuuauuuuauauuuaauuuuuuuguguguggcgggggggacagggucucacucuguggaguacaguggugcgauccuggcucaccgcaaccuccaccuccaccucccaggaucaagugagccucaccucagccucccaaguagcugggacuacaggcgcauacuaccacgcucagcuaauuuuuguguuuuuuuguagagacaggguuucaccauguugcccagacugaucucaaagucccgagcucacaggauccacccgccuugaccucccaaacugcugggauuacaggcaugagccacuauguccagccuaguaguuccauuuuuagauguaguuuaauauccacaauagaagaacaauucugcguacuuguaauaaucgacuuaaggaggaucaauauccauacagauacuguggcagaaaaaaagacuuaauuauuuuagacuuuuccccacagacgaaauuaaaaguuuuugguuaauaaaaaauacaaccaagcagaaaguuccauuucugaugcauuuaccaaaguuucaguguaucuaccagacuacaaacucuacucuugaguugccaacagagaaaauuucaugucaaugaaaucaacaauacaguaguagcaguaacaaaauacaauguaccaagaauuuccuuugucccagacucuauccuaaaucuuacguauacuuaauucauuuguuaauaauuccacugcaaccuugagguuuggugcuauaauuaacccccaauuuauaagucaggaaacagaaguaucaagagguaaaguaacuucccuaagaucauaaagcuaguugcuuggcuauuaaaacaaaccaguaggcuccaggacccagauuauuaaucauuacaugauugucagcaugacagguacauuauuucuccaaguugguauacuacagccaaaucguccccuaagaacauacauuucaacaagcccuuccagggauuaaagaucacugguaugguagaaaaacacugcauuucgagauaaaaggcgugaaauuaagccuuuaauuaagguuuuaacauccuaaccagccacuggccacuuucaaaaccuuagcuuccuccuuugccaaauaaagggauuugauaauuuuauuuuaaauuuuuuuuuuuuuuuuuuuuuuugagacagagucucacuaacucacccaggcuggaaugcaguggcaggaccuuggcucacugcaacuucugccucccagguucaagagauucucuugccucagccuccugaauagguaggacuacaggugccaccaugccucguaauuuuuguuuuuguuguuuugguagagacaggguuucaccauguucaccaugcugguaucgaacuccugaccucaagcaaucagccucccucggucucccaaagugaugggauuagugaugggauuacagaugugagccacugcuccuggccaauaauuuuauucuuaaaaaaaaaaaaaaaaggccgggcacuguggcucacaucuguaaucccagcacuuugggaggccaaggcggguggaucaggaggucaggagauggagaccauccuggugagcacagcgaaaccccgucucuacuaaaaauacaaaaaaauagccaggcguggcggcgggcgccuguagucccagcuacucgggaggcugagacaggagaauggcaugaaccugggaggcagagcuugcagugagccgggacugugccacugcacuucagccugggcgacacagcaagacuccgucucaaaaaauaaauuaaaaaaaaaaaaaaaaaaaaguuuggcgcaguggcucacaccuguaaucccagcacuuugggaggccaaggcaaguggaucaccugaggucaggaguucgagaccagccugaccaacauggagaaaccccgucucuacuuaaaauacaaaauuaguugggcgugguggcacaugccuguaaucccagcuacucaggaggcugaggcagaagaauugcuugaacccaggagguggagguugcggugagccgagaucgcgccauugcacugcagccuaaggcaacaagagcaaaacucugucucaaacaaaacaaaacaaacaaacaaacaaaaaacagaugggggucuugcuacauugcccaagcugguuuugaacuccugaugucaaguggucuuccuacuuuggccuccaaaaguguugggaucacauucaugagccaccuggcucagcuggauuagacaauuuuuuuuuuuuugagacagagucucgcucuuucgcccaggcuggagugcaguggcgcgaucucuccucacugcaagcucugccuccuggguucacgccauucuccugccucagccucccaaguagcugggauuacaggugccugccaccacgccuggcuaauuuuuuauauuuucaguagagacgggguuucacuguguuagccaggauggucucgaucuccugaccuugugauccaccugccucggccucccaaagugcugggauuacaggcgugagccaccgcgcccggccuagacaauuuuaaagaaacuuucuagacgcacaacaguuuaauucugaguaaugacgagguaugaguauuaaauguguuauuagccgaguuaaaaaguguguuauuagccaaguuuuagguuaaaaaaaaacacaaaauccuacuuacccuguuuacuguggaugcaagugccugaagaacggcuacuuuaucccuaaaaauaagaaccacaaguuaauccucaucagggcucuucauagccacaaaccgaacaagugauucuacucucaguguacuggccaauaacauagugcagaucucaucugaagcugguuaugucacaaggucacuagaauaaauuagaaauuaagaaaacugcugguucuuuccccuaguugguacauguuccucucuuugccuguccucucuggccuggugcauaaugccauaacccagggcuagugauuuccaucccgcccucauaaaacuaucuggccuacuuccucuacccacuuuccuauggauucuuacugcagcuuucgggacuacuguugccuuuacuauccuaauugguagcucuugauucaguuauaggagaauaaaccacaggcuucacucuggaccuauugcaucaaagccucccaagauccauggaggacugucacacacacucuuacugaauucccagauaauucugaugcaaccuccugguuuagaaccucucaaccauauauaacguuaugguaagaauugcaggccagcuguccacugcaccucugaguagagaccuuuacugaacuauuagaaaaggcuucacuggaauaaaugacagacaagauaauuugaucucaaauauauuugugcuccuauguuagauuuaauguguuuccuuuccaaaagggaauuauaccaagaguauuuuucuaaauaaaguuuaacauaacauucuuaagacuauaagucaucugagaaaaacaaaaguacaggaaauuuuauauuucaucaaaacuaauucccugauguacauaauauccacuaaauuuucuauccacguuuagaagucacauuuauguaauuucagcaagugugauaacgacacauucucucaucugucagcauuccuucagcagaucuuuuauugcccuauuuaagucuuaucaaguuagcaaacuuuccuaacauauugaacaaauggcagugaaaaaaugaugacauucagauuacucacuaauucucuuucuuuaaaggguuacuuuaaaagguaucauacauuaucuuaaaaaaauaaacuagaacauuacacguuaaccuaaagugucuggugucaucuugugaccccucuccacgaugaauuugguauuuguauuuccagaacuuuuaaagguauuuucacacauaaacaucucccuaaaaaacguauacacacugucauucugcaugugucuacauaaguuuggcugcacuauccauguuauuaaauauagagcuaauuaauuccuuucaauguaaaaaguuauuguaugauaaccuuuuaaaauuauccauucacuuuucaaugggcauucaggcuguuucaaccuguuacuauucccaaguaauaaagaacagucuuguccauguauauaugcaaauguuccuccaaaguggcuaaccaguaagguacgcacauuuccaauucugauucugccaaauuucccuccaaagagcuguuccaauuuacugucccauaaacaaacguauuucuucaaauccucucucugccaauacgguaaguuuuaauuugcacuucuuuuaugaucccaguuaccuaugcauugacaucacugggcucccuggccucccuaaaauaaucacacaguucagauuaauaaaguucuuaaaaaagucuuuuuaaaugaacccaagucuuuuuuuuuuuuugagauggagucuugcucugucgcccaggcuggagugcaguggcgcgaccucggcucacugcaagcuccgucucccggguucacgccauucuccugccucagccucccgaguagcugggacuacaggcgaccccccaccacauccggcuaauuuuuuuguauuuuuaguagagacgggguuucaccguguuagccaggauggucucaaucuccugaccucaucauccgcccgccucggccucccaaagugcugggauuacaggcguaagccaccgcgccuggcgaacccgagucuuuaggucacauaauuuuaagaccuagcuuuuugaggggccacuaaaugcguucaauaggacuacacuguaacaagcacuuuugugaaguuuuaauuccugcauauucaacaaauguugaauaaaugagaugaggcaauuuguucaaggauauauccagugaauaaaaaagcuaaauuuugcuguccacaccauuuacuuuauuuuuaccucauuagagauaauaaagacaguaacugucugcucuugaaucauaugagagaacuuccuugaaaaaaauuauucuaaugaugauguucauguauaaccauguauuauuaaccacguaaauaguaacccacacuaauucaaaaucucuuucaauuguucuuuuaaguaaaucucauugcucauucacucacuauucuccaccuuuccauuuuuuguccuuuaaacuccuagcuucuccccgcucagcuacucucuucaagaaugcucuccuauugcucuuccugucacugucuccuuaccuaacccuuacacuucucucauaguaagcacucaaccauuugcugaaugaacacugauagaauacuuaccaaguuuucuuuuuuggaauuacuacuucuucaaucccuaauguaaaaaagaaaacaugaaucaguuuccuaguacuacaauggaauccaacguguugauauaaaaauagaauucaauauauuuuaaaauauaccuguuacaucaguuccuucaaccuuugagaggguugcacuaccagaauaaaaucugcaaaaaaacaaaagccuuaaaucuaauagucauuaaugaaguacccagcucaccuccaccuauguguacuuugagcccaaauucuccaauuaucacggauuaaacuggauaacucaugucaaugaacgcugagaagacagucuguacacauguucaauaucauuaaggaauggauacaagauauggacaagacugucaaaacuuuuuuuuuuuuuuuuuuagagacagggucuugcuccauugccuagccuuuagugaaguagugcaauuauagcucacugaacccuugaacuccugggcucaagugacccuccugcuucagccuccugaguaacuaggacuacaggcauaugccaccaugcccggcuagacaaaaguuuuggaagcaagcaaucucauuacauaaauggcagagagggaggaaaguuuuuaauagcacuugaacaaucugguuugaaaugaagaacuuucaacuucaggaacccaaaacacuaugauguuuaaaagaacaauucagugagcucuugcuucuauacagauacugcccugaucagaaaggacuaccucacuuaaagcaauuacaacauagggaagaugacccauggcuucucauuccacuucuuucaacaaucaagaauguaccaaauacauaaggccugauuuagacuuggaauugcugauauuuucuauuuucagagguucaauaugaaauccuuuuuaaaccaaaauauagaaucauuggcccaugacugaguuuuuaaguguucuguuuaaguguucugaucacacuaaaaacacagucaacacaccacagauaaugugacgguuaguauuaucuuguguuuccccuuacuaaauggcaucaguaacauucagaaaauugucaagaugugauugcacagacagauacuuccuccaguaguaucugguuucagguaucauuuaaaacaagaauaccccucuacguuaaggacauuucagaaagagaucaacucuuucaaguuucugagaucaacucuuucaagucacacuauuuguuucucaugaccuuaaaacagagaucacaguuauuuugagaacggaugcugaggaagagauucugcuucaggcaaagaaaaugaguagaaaaaugcuaacgauggcuaccaggaaacggaggacuggcauugaauggcagcacaaagguuucugcaguaucagauggagugguuucucuuucuugaggggaacuaagggagaguacauauaaaaacauauuguaaauuacauaccccacuuauaccucacaaacuuuucggaugguuauuaccaacucuagucugcagaugaggaaaucugucuauuaucauccaauuaagugaauggcaaacacuaaaccuaaaauuaggcuuuuagcaaguuuucacuacaaauuacugccucucauauucccacaaugccacuguuuguacugagugaaaaaaaaauuacacagauaggucauacauguuccaagcuauaacuaucacagaucaaaagggcauagucagaucuuuuagacuuuucugcuuuuacgaaaaccugauaacuucuuuagccaaaguccccacgguggcgaccagagacugccuuuuauuugggaagaucuuguacguucuccucgcuccuccugauuggguuaaaaugaguaauggcggauaauuuuuaauuugggguaguguugcuaauagccacacucacuggaacgcaagcuucaugagagcaggguccuagcuuugcggaugguguuaacuacagaauauugcaagcaaccaauaaguauuucucuaaugaauaaaugcguugcgaauccuauuucaaagggccaccuccgcguaccuggucuuaagggcacgcgaccguuaagggcgcgcaugagcaaaccauuucaucgugccuacuuccacagccagcugggaaacauaggacuaaggugacuccgcggucuucuucgcggauacccuaagcgucucuuaccugcagcugcgugccuguucacacaaacccgcccgccgacccgucagcggcuggccaagccugcugcggaggcccagccagcgaacagcagauacaaccgccaucuuugauuucucugcagagcauguugggaaagcgugccucgaccuucaggaagguggggcgcagug

SEQ ID NO: 191626 - RNA, 35976 nt, Homo sapiens
cacugcgccccaccuuccugaaggucgaggcacgcuuucccaacaugcucugcagagaaaucaaagauggcgguuguaucugcuguucgcuggcugggccuccgcagcaggcuuggccagccgcugacgggucggcgggcggguuugugugaacaggcacgcagcugcagguaagagacgcuuaggguauccgcgaagaagaccgcggagucaccuuaguccuauguuucccagcuggcuguggaaguaggcacgaugaaaugguuugcucaugcgcgcccuuaacggucgcgugcccuuaagaccagguacgcggagguggcccuuugaaauaggauucgcaacgcauuuauucauuagagaaauacuuauugguugcuugcaauauucuguaguuaacaccauccgcaaagcuaggacccugcucucaugaagcuugcguuccagugaguguggcuauuagcaacacuaccccaaauuaaaaauuauccgccauuacucauuuuaacccaaucaggaggagcgaggagaacguacaagaucuucccaaauaaaaggcagucucuggucgccaccguggggacuuuggcuaaagaaguuaucagguuuucguaaaagcagaaaagucuaaaagaucugacuaugcccuuuugaucugugauaguuauagcuuggaacauguaugaccuaucuguguaauuuuuuuuucacucaguacaaacaguggcauugugggaauaugagaggcaguaauuuguagugaaaacuugcuaaaagccuaauuuuagguuuaguguuugccauucacuuaauuggaugauaauagacagauuuccucaucugcagacuagaguugguaauaaccauccgaaaaguuugugagguauaagugggguauguaauuuacaauauguuuuuauauguacucucccuuaguuccccucaagaaagagaaaccacuccaucugauacugcagaaaccuuugugcugccauucaaugccaguccuccguuuccugguagccaucguuagcauuuuucuacucauuuucuuugccugaagcagaaucucuuccucagcauccguucucaaaauaacugugaucucuguuuuaaggucaugagaaacaaauagugugacuugaaagaguugaucucagaaacuugaaagaguugaucucuuucugaaauguccuuaacguagagggguauucuuguuuuaaaugauaccugaaaccagauacuacuggaggaaguaucugucugugcaaucacaucuugacaauuuucugaauguuacugaugccauuuaguaaggggaaacacaagauaauacuaaccgucacauuaucugugguguguugacuguguuuuuagugugaucagaacacuuaaacagaacacuuaaaaacucagucaugggccaaugauucuauauuuugguuuaaaaaggauuucauauugaaccucugaaaauagaaaauaucagcaauuccaagucuaaaucaggccuuauguauuugguacauucuugauuguugaaagaaguggaaugagaagccaugggucaucuucccuauguuguaauugcuuuaagugagguaguccuuucugaucagggcaguaucuguauagaagcaagagcucacugaauuguucuuuuaaacaucauaguguuuuggguuccugaaguugaaaguucuucauuucaaaccagauuguucaagugcuauuaaaaacuuuccucccucucugccauuuauguaaugagauugcuugcuuccaaaacuuuugucuagccgggcaugguggcauaugccuguaguccuaguuacucaggaggcugaagcaggagggucacuugagcccaggaguucaaggguucagugagcuauaauugcacuacuucacuaaaggcuaggcaauggagcaagacccugucucuaaaaaaaaaaaaaaaaaaguuuugacagucuuguccauaucuuguauccauuccuuaaugauauugaacauguguacagacugucuucucagcguucauugacaugaguuauccaguuuaauccgugauaauuggagaauuugggcucaaaguacacauagguggaggugagcuggguacuucauuaaugacuauuagauuuaaggcuuuuguuuuuuugcagauuuuauucugguagugcaacccucucaaagguugaaggaacugauguaacagguauauuuuaaaauauauugaauucuauuuuuauaucaacacguuggauuccauuguaguacuaggaaacugauucauguuuucuuuuuuacauuagggauugaagaaguaguaauuccaaaaaagaaaacuugguaaguauucuaucaguguucauucagcaaaugguugagugcuuacuaugagagaaguguaaggguuagguaaggagacagugacaggaagagcaauaggagagcauucuugaagagaguagcugagcggggagaagcuaggaguuuaaaggacaaaaaauggaaagguggagaauagugagugaaugagcaaugagauuuacuuaaaagaacaauugaaagagauuuugaauuaguguggguuacuauuuacgugguuaauaauacaugguuauacaugaacaucaucauuagaauaauuuuuuucaaggaaguucucucauaugauucaagagcagacaguuacugucuuuauuaucucuaaugagguaaaaauaaaguaaaugguguggacagcaaaauuuagcuuuuuuauucacuggauauauccuugaacaaauugccucaucucauuuauucaacauuuguugaauaugcaggaauuaaaacuucacaaaagugcuuguuacaguguaguccuauugaacgcauuuaguggccccucaaaaagcuaggucuuaaaauuaugugaccuaaagacucggguucgccaggcgcgguggcuuacgccuguaaucccagcacuuugggaggccgaggcgggcggaugaugaggucaggagauugagaccauccuggcuaacacggugaaaccccgucucuacuaaaaauacaaaaaaauuagccggaugugguggggggucgccuguagucccagcuacucgggaggcugaggcaggagaauggcgugaacccgggagacggagcuugcagugagccgaggucgcgccacugcacuccagccugggcgacagagcaagacuccaucucaaaaaaaaaaaaagacuuggguucauuuaaaaagacuuuuuuaagaacuuuauuaaucugaacugugugauuauuuuagggaggccagggagcccagugaugucaaugcauagguaacugggaucauaaaagaagugcaaauuaaaacuuaccguauuggcagagagaggauuugaagaaauacguuuguuuaugggacaguaaauuggaacagcucuuuggagggaaauuuggcagaaucagaauuggaaaugugcguaccuuacugguuagccacuuuggaggaacauuugcauauauacauggacaagacuguucuuuauuacuugggaauaguaacagguugaaacagccugaaugcccauugaaaagugaauggauaauuuuaaaagguuaucauacaauaacuuuuuacauugaaaggaauuaauuagcucuauauuuaauaacauggauagugcagccaaacuuauguagacacaugcagaaugacaguguguauacguuuuuuagggagauguuuaugugugaaaauaccuuuaaaaguucuggaaauacaaauaccaaauucaucguggagaggggucacaagaugacaccagacacuuuagguuaacguguaauguucuaguuuauuuuuuuaagauaauguaugauaccuuuuaaaguaacccuuuaaagaaagagaauuagugaguaaucugaaugucaucauuuuuucacugccauuuguucaauauguuaggaaaguuugcuaacuugauaagacuuaaauagggcaauaaaagaucugcugaaggaaugcugacagaugagagaaugugucguuaucacacuugcugaaauuacauaaaugugacuucuaaacguggauagaaaauuuaguggauauuauguacaucagggaauuaguuuugaugaaauauaaaauuuccuguacuuuuguuuuucucagaugacuuauagucuuaagaauguuauguuaaacuuuauuuagaaaaauacucuugguauaauucccuuuuggaaaggaaacacauuaaaucuaacauaggagcacaaauauauuugagaucaaauuaucuugucugucauuuauuccagugaagccuuuucuaauaguucaguaaaggucucuacucagaggugcaguggacagcuggccugcaauucuuaccauaacguuauauaugguugagagguucuaaaccaggagguugcaucagaauuaucugggaauucaguaagagugugugugacaguccuccauggaucuugggaggcuuugaugcaauagguccagagugaagccugugguuuauucuccuauaacugaaucaagagcuaccaauuaggauaguaaaggcaacaguagucccgaaagcugcaguaagaauccauaggaaaguggguagaggaaguaggccagauaguuuuaugagggcgggauggaaaucacuagcccuggguuauggcauuaugcaccaggccagagaggacaggcaaagagaggaacauguaccaacuaggggaaagaaccagcaguuuucuuaauuucuaauuuauucuagugaccuugugacauaaccagcuucagaugagaucugcacuauguuauuggccaguacacugagaguagaaucacuuguucgguuuguggcuaugaagagcccugaugaggauuaacuugugguucuuauuuuuagggauaaaguagccguucuucaggcacuugcauccacaguaaacaggguaaguaggauuuuguguuuuuuuuuaaccuaaaacuuggcuaauaacacacuuuuuaacucggcuaauaacacauuuaauacucauaccucgucauuacucagaauuaaacuguugugcgucuagaaaguuucuuuaaaauugucuaggccgggcgcgguggcucacgccuguaaucccagcacuuugggaggccgaggcagguggaucacaaggucaggagaucgagaccauccuggcuaacacagugaaaccccgucucuacugaaaauauaaaaaauuagccaggcgugguggcaggcaccuguaaucccagcuacuugggaggcugaggcaggagaauggcgugaacccaggaggcagagcuugcagugaggagagaucgcgccacugcacuccagccugggcgaaagagcgagacucugucucaaaaaaaaaaaaauugucuaauccagcugagccagguggcucaugaaugugaucccaacacuuuuggaggccaaaguaggaagaccacuugacaucaggaguucaaaaccagcuugggcaauguagcaagacccccaucuguuuuuuguuuguuuguuuguuuuguuuuguuugagacagaguuuugcucuuguugccuuaggcugcagugcaauggcgcgaucucggcucaccgcaaccuccaccuccuggguucaagcaauucuucugccucagccuccugaguagcugggauuacaggcaugugccaccacgcccaacuaauuuuguauuuuaaguagagacgggguuucuccauguuggucaggcuggucucgaacuccugaccucaggugauccacuugccuuggccucccaaagugcugggauuacaggugugagccacugcgccaaacuuuuuuuuuuuuuuuuuuuuaauuuauuuuuugagacggagucuugcugugucgcccaggcugaagugcaguggcacagucccggcucacugcaagcucugccucccagguucaugccauucuccugucucagccucccgaguagcugggacuacaggcgcccgccgccacgccuggcuauuuuuuuguauuuuuaguagagacgggguuucgcugugcucaccaggauggucuccaucuccugaccuccugauccacccgccuuggccucccaaagugcugggauuacagaugugagccacagugcccggccuuuuuuuuuuuuuuuuaagaauaaaauuauuggccaggagcaguggcucacaucuguaaucccaucacuaaucccaucacuuugggagaccgagggaggcugauugcuugaggucaggaguucgauaccagcauggugaacauggugaaacccugucucuaccaaaacaacaaaaacaaaaauuacgaggcaugguggcaccuguaguccuaccuauucaggaggcugaggcaagagaaucucuugaaccugggaggcagaaguugcagugagccaagguccugccacugcauuccagccugggugaguuagugagacucugucucaaaaaaaaaaaaaaaaaaaaaaauuuaaaauaaaauuaucaaaucccuuuauuuggcaaaggaggaagcuaagguuuugaaaguggccaguggcugguuaggauguuaaaaccuuaauuaaaggcuuaauuucacgccuuuuaucucgaaaugcaguguuuuucuaccauaccagugaucuuuaaucccuggaagggcuuguugaaauguauguucuuaggggacgauuuggcuguaguauaccaacuuggagaaauaauguaccugucaugcugacaaucauguaaugauuaauaaucuggguccuggagccuacugguuuguuuuaauagccaagcaacuagcuuuaugaucuuagggaaguuacuuuaccucuugauacuucuguuuccugacuuauaaauuggggguuaauuauagcaccaaaccucaagguugcaguggaauuauuaacaaaugaauuaaguauacguaagauuuaggauagagucugggacaaaggaaauucuugguacauuguauuuuguuacugcuacuacuguauuguugauuucauugacaugaaauuuucucuguuggcaacucaagaguagaguuuguagucugguagauacacugaaacuuugguaaaugcaucagaaauggaacuuucugcuugguuguauuuuuuauuaaccaaaaacuuuuaauuucgucuguggggaaaagucuaaaauaauuaagucuuuuuuucugccacaguaucuguauggauauugauccuccuuaagucgauuauuacaaguacgcagaauuguucuucuauuguggauauuaaacuacaucuaaaaauggaacuacuaggcuggacauaguggcucaugccuguaaucccagcaguuugggaggucaaggcggguggauccugugagcucgggacuuugagaucagucugggcaacauggugaaacccugucucuacaaaaaaacacaaaaauuagcugagcgugguaguaugcgccuguagucccagcuacuugggaggcugaggugaggcucacuugauccugggagguggagguggagguugcggugagccaggaucgcaccacuguacuccacagagugagacccugucccccccgccacacacaaaaaaauuaaauauaaaauaaagauggagcuacuaaagauaguguugggucuaaugugcacugguguacucuaccaguuucugaaaaaggacuuuacuacaucucccuacuugcaaagcauugagauuuucaguagcucacuuauccauaaauaggcaccugaaauguaaacauagaaauggaccuccgagauauucucaacauuucaaugagaauggcccagggccacuuucaaaucaaagaaguuauagaauuguguguagaauugugacuuaucuggcccuuaaaauccaagaguuauucguuuauccauucauucagcaacaauauuuugugcccuuaugaugcuuaucaagcacugugcuggauauagaauuagacacagauauuguguaguucuagaggggaagacugagguagcacugagaagggguuguaucgccaagacugagaaaggaauucuuuuuuuucuuucuuuuuuuuuuuuuaaagagacggagucucccucugucacccaggcuggagugcaguggcgcaaucucagcucacugcaagcucugccuccugggcucacgccauucuccugccucagccuccugaguagcugggacuacaggcgcccccacccccacgcccggcuaauuuuuguauuuuuaguagagacggaguuucacuguguuagccaggauggggguaaaggaauucuaagcagacauuuuagaaaagagagcuauguggagaaugggaaagcuuuccacuugagagugugauaaagagcuuagcauauccaaaaccaaaccccauucccuccaaacauuccucacauauuucuuugccaucucauuaauggcaacuccauucuuauagcugcucaggccaaaauccugggaauuguuagcaaagccuuuguuuaucccuucaaaagauacgugugugugaggucuccgugaccacucccaggcuaagaguuaugacagcaagaagauacaaagcaaagucagcaaagagaaaaggcucauuggauaaagaccaaaagaaaucagucacaagcuuccaaaagaccucuccagaagauucaacacaggacaugcuuaauuccuccaucagugacuugugacaacacaugcaaagugucuaccaaagcucauuagagacccagugcccagaguuuuuaggggaggcuggccauguagaccacccacuggcuggcauauauuauaccaaguuuccauacucccagaagggaagcagguguuuggcacaaaacacguuguacaaacagguuaggcacagugaaccauucuuagcaguucuaggaauggugagaacccuuccaauauccagguucccagauggcagccaagggccagccuuggacgcagaccuuccuaaggauaaugguuucaggucuguuaacucuuuucugcaaaauaucaaaauuuuagaugccugauaucacuaccagucaccuugguuauugucgucuuacaagucuggauuaauugcagcagucucugucgucucccacugcaccucccugcacacugcucucaguucagcagcuguagugacccuggaucauaucacucuuaagaauucaacauuggcuuuccauuaguauaauucaaauaaaaacugaaguucacaacagggcugcuaaggugaggcucaagggaaagggguuuuugaaagggguagcagaaagcuagguccaaaauaaaacacugccuccagguuccagguaugagcagcuuuccguugagagcugcagggaagcuucugugcccccucccugaggaguccaggucaguaaaacagcauuaaggauauaggauaaguuuuugcuuuggaauaaaggcccaaguaaggcacucagacacagaagagaauaaagaaagcaauucuggggcauuucucaguggggccccuggugguauuggagaguugauuaugcucagguuuagggagcaauuuuaauggguaacaggacgugggagaagguucuguuguucauuccucagagggcacggugauaucuuccauuuggaggagggacucuuggugaaguugagcguggguggauagugaccuugcuuuggaggaaauccuauucugggauucugcuguuaggacuaguuaauucagaugauucuuaccuagaguuuaaaacaguccccagugguagcaaacuuaaauauuaaaaucagccauggggagggaggcuuaagccauugcuugccuugcauaauuaaaggcaagucuuguagagcugagaguacagugcagguguuugucuuuugucuuuuuucucuauauauacauguauauaugcccacacacguuugcgcauuuagguuacauacauaauuacaacuuacggaauuuuuguuuaucaaaacucacaagguccucuuaaaaauuuagcuagaaagacuugugggcuggauacaguggcucacgucuauaauccuagcccuuuguaaggcagaagugagagaacugcuugaggccaggaguuugagaccagcuugggugacacagcaagacacccucucugcaaaaaauuuugugaaauggccagcugugguggcacacaccuguagccuaggcuacuugggaggcugaggcaggagaaucccuugaguccaggagcuaaaaguuacagugagcugucuucaaaauaaauauagaaauuguauuaugucuuuuccacaggauaccacagcugugccuuauguguuucaagaugauccuuaccuuaugccagcaucaucuuuggaaucugugaguauuuucauauaauuuucuaguguuuuaucucucugguuugcguacaacaguacauaaauaauuuaguuguaauaaccugggaaagguuuacaaaugcugagaaauugauagacuaugugaauccuuuacuacuuucuucaaaaagauguacauaucgucaauggggaaaggauuuuugguuuugguuucuaauacuuagggcuuuuucacacuggagugacccacucaguuuaaauggcuugcuuuuuauauauuucaagcuguguauaagaugcuaacugaaauuauaucacaguagaaaaggugggauagucuauaauuucuaauugggauucugcguguuguugcauuuguuuuuuuuugugaggggggagaaauucuugcugagaguguaacuauaaucuugcuugaguuuaaauuacauguauuuaaaucuuuuucuuuauauagcguucauuuuuacuggcaaagaaauccggggagaauguggccaaguuuauuauuaauucauaccccaaauauuuucagaaggacauagcugaaccucauauaccgguaaggagagguaguuacauuauuuacauaauacuauuuuaaauguaaauuaaaccaggcuuucauggcuaauauuucaguagcuauuugaauacccucaauauuuggaugauaagccuuuuaaaguguggaguuagcuuugaucacaagacuaacuuuaaaauucuuucuguauuuauuugcucuucaucuuaauauuuuccccauuugauuuuugugacaccaugcucuuaggucuuuaauucuaugacugaaguuuccuucacuaccucucuauacacaucuuucucuuccuuuuuuuuuuuuuugaaacggcaucaugcugucacccaggcuggagugcaaugguacaaucauagcucauugcagccuggaaccccugggcucaagugauccucuugccucagccucacaaguagcuuggacuacaggggugugccaccaugccuggcugauuuuuuuuaauuuuuaguuuuuguagagaacagggucuugucucacugcacugcccaggcuggucucaaauuucugggcucaagcaaacacccuucucagccucugcaaucucugggauugcagguguaagccacugcugcuugcucuugauccgcuucuuuuuuuguuuguuuuuguuugagauggagucucacucuguugcccaggcuggagugcaguggcacgaucuuggcucacugcagccucugccgcccggguucaagcaauucuccugccucagccuccugagcagcugggauuacaggugccugccaccgcaccuggcuaauuuuuauaguuuuaguagagacgggguuuuaccaucuuggccaggcuggucuugaacuccugaccucgugauccacccgacuuggccucccaaaguccugggauuacaggugugagccaccguguccggccuugauccacuucuuaagcauggguaucuuucuuagauuuuuaugcucauuuucucuuuuuauuguguauacucuucuguuucagugacgcuuauaauccauuugguacucuuuuguauaucuagccuagaucccuuuacuuugaacuccacauuguauuuccagcucccucuuuguucuguaguuuuggagugaggauuuaugcagugugguggguauugugcuuagugcuuguccauacaguggugagcaaaacagaugcgccucugcccuccugaguuuguugguggaaguacuaaucucagacucaucauaucuaaacugcucccauaucccuacaucucucugcuucccaaagcucacagggaaacacacacuucuuguuuucauaguagaacuugcacauagaugaggaagccagugugauuguguaagucaaaauauuaaaauccuaaacuaagacagugucuuucuccauuagauugugagcacccugaagguagagaaugccuuucgucucuguauccccagugccaagcuuaaugucugggguaaaauaguaggcauucagaaaguauuugaauaaguuagugaaugagguaaaaucagcauaccuuggguaguauuaaauguuuagaugauacacagcauuagagaugaaagguuuaguucaauucccugugaagacagugauguuaaaaugaucaguaguaucuggugcaggaaacaugaauuggagcagugaaguuuuacuuugguauguuggugauaaaaguuuuguccuacucaguuauccuucccucaccuuuaccuguuuguaguaacuuuagucaucuuguuuuccuaguguuuaaugccugaguacuuugaaccucagaucaaagacauaagugaagccgcccugaaggaacgaauugagcucagaaaagucaaagccucuguggacauguuugaucagcuuuugcaagcaggugacugaguucgauuaaagccccucuaauaacaugggcuuugaagugggcccaaguuauaugauucauauauuuugaguaagaguuacagguccugcuguacuuacucugcuuugauggcugcgugcuuuauauuuuuaguaguuuauuucauuuuuagcuuuaguguuacuuaagaauuacaggcgaaguagaauugcagcuuuguugguuuauuguagcacugguagagaaauuguaucacccuucuaccuuagcuucuguuuuuaauguuagguagguaugcagugcucccagauuuccuguacccuuuuccuuuuuuuuuuuuuugagauggagucuugcucugucgcccaggcuggagugcaguggcgcaaucucggcugacugcaagcuccgccucccagguucaugccauucucccuccucagccuccugaguagcugggacuacaugcacccaccaccacgcccagcuaacuuuuuuguguuuuuaauagaggcgggguuucaccauguagccaggauggucucgaucuccugaccucgugauccacccaccucggccuccguaaguacugugauuacaggcgugagccaccgcgcccagcuuuccuagacucuuuaaggauguuuggaagauugggccacaacacacaagaaagaaauacgugaaaaggaaagcacacucaacuaggaucaggggcuuugaugcuggugccaucugugucacuaauuguucuuagcauucaaaaaguuacuuaauuucucaaaacuucuagcucuaaaauugugugguucucugaauuggagcuggauguaaacuugcggagcuacacacguaaauagcacagcugauaagucaacaugaaaaucuacauauagcaacaucagaagcagcuggcauuaaguuuuuagaaucuagagugcuauuuggugauuuagaauaaacauggaagugguggaaacuggacugaaucauuauacacuugaacacaagaaacauuugcagaaagcuauguuugagaauuuugguguguggcuugguacagcaucagauguauggcugagugauggcaauagauuguaauuuagugaggcgcuucccucugcuuguuaauaugaucggcaucuggugugagucugcauugaaguucuuagugcuaaggcuugucuuuuucuaguuuuacccccuuuauuggauaggugugugcaguccuucaguaaagacaggugucagacccauagcucaguaacaaagugagcuaacauaccagggaaaggauccuagaacauuucauugucaggccccuaauaagugcaaaacacugugcuagccauuucacauacuuaauucuacaauaccuuauucauugguguguuuuauaauaaucuuaugaagguaauuauuagguaauuuuuccagggucucauagcuuugagauagugugaaccaguugcuucuccauagccuguacccucugcccugcuuucucuucuggacuuuuuacauuuccugaugggcauuuuaaauuuaucaauguauuuuguuuagaaagauaauuuauuggcuaggcaugguggcucacaccuguaaucccagcacuuugggaggccaaaacaggaggauugcuugagcccaggaguucaagaccagccugggcaacauagcgagaccucaucucuacaaaaaauuuaaaaauuagccaggugcaguggcacauaccuguagucacagcugcucggaaggcugaggugagaggaucacuugagcccagaaguucaagguuguaguaagcugugauguccuugcacuccagccugggcgacagaaugagacccuaucucaaaacaaaaagauacauuuacuuuucuuauaagauagcagauuauaucucauacuugucuuccuccuauucccuuuuuagccuuuuuaaugagugucaagauggggacauaauguuuugaacaauuuuuaagagacuacuauaguucgacaauuaugcuaguauuucuaggcaaguuuucagugaguaucuggauccaaauggaauaauucuacuugcauuuguucaaaugcaccugggcugggggaacuaaguggggauaguuugcaguguguucaguuuggugaugauaauuaaaaccaugaaguaguuugaggauaaugaguacauaaaauaagugagcacaggcccaaacuucaucuuguguuccaaucuucuacgucaaauuacaugguuaauagggguuaugucccugucuacgucacuucagguguuuaaguugacguugagugcauaaaguaguggacaacauuaaguguguagcccugaagaccaccgcuaauauaaaaaaaugacacauuuuaaccuaacaggcuuuaguucuucauuguuucaagguuucuuuaucuuucugucucuuacccacaggaaccacugugucucuugaaacaacaaauagucucuuggauuuauuguguuacuauggugaccaggagcccucaacugauuaccauuuucaacaaacuggacagucagaagcauugguaauaacuguuggccuugauuuuuuuuuuuccuuaagcuucuuuuugaagaaauugcuuuuaaaaauaagauggguuguuuugccaugugucaggguaguagagauuuguacugagaugugugguacgauagccuugauaaaaagugguauaggaggaagagagauuuuaaacaguuacuucuguccuaguuuacuuuuuaacaauauguuguccucaccuacuucauauuaaggcaaagcguugaucagaaauguuugggcuggccugugccacuuagaguaaugacaugauguauucuggccagggaaagacuccguggccugggcccccucaaaaauucauacguggacuuagaggagagaacacacuaggcuggagacagaacaguagugugccggggcccgccuguaaguugagucauagccucucucucgacucgcgaauuuuacuucuagaacuaggucucaagaaauccuuuggaucagucaaauagagaugcucaugugacauuuuucaugaggagguauuuauacuugcaaaaauguugaaaacaaucuagauguccaacaguagaugaucaaaugaugauaaaaguuguguggccauugagcacauuagaguagauguguuuggguauggaaacauucauccaauaagugggaagcaggcuaucagcaguauauauuccauuuuuguaaaaauguuuuuacaaaugcauacaaaaaaaucauuuaaaaaguguuucugggugaugggauuauugguguuuuucuucguuucuaucuuuucuacucuuugcccaacuaaauguggauuucuuguuucccccucagagacagggucucacucugucaccuaggguggagugcagugaugcuaucauagcuuacugcagccuuuaacuccugagcucaaguguuccuccuuccucauucucccaaauagcugggaccacaagugugggccaccaugucuggcuaguuuuuuuugggguggggagggcggguagacauagggucuugcuguagugcccaggauggugucuucaacucuggggcucaggugauccuucagucuccuaaaguuuugggauuacugaccacugcaccuggccaaauguggauuauuuauguagagaacuuuacauuuuuaaaagugcauaggcaguagguugcaguuaaaccuugcuuuccagaguaucacuuccugaagcccugcucugguuggcccucugccucuccagccccagcucuugaggcagcaggcuacagagccaacacugaccucugcaaugccaaccaagccuguauugcucuacgucagccucaucccagaccuugguuuauaaauaaagacaagauuuauucuuguaagaagucuugccaggugcaguggcucauacuuguaaucccagcacuuugggaggccgaggcggguggaucaugaggucaggagaucgagaccauccuggcuaacauggugaaaucccgucccuacuaaaaaaaauacaaaaaauuagcugggcgugguggcacgcgccuguagucccagcuacuccggaggcugaggcaggagaauuccuugaacccaggagguggagguugcagugagccaagaccacgccacugcauuccaaccugggcgagagagcgagacucugucuuaaaaaaaaaaaaaaaaagaagucuuaguuugcuugggugaguguuaggcauuaacuauauguuguuuaucuugcuuucacccuaauuaugacaguuuaucuguauggaucaagccagauguagucucugagcaaauaggcuguguuguuugguuuuccucuuucugucugaggaccaggccauacagggaacuggcuucaucuugucuccacgcugucacuuguugcuuugagagucaacuuggccuuucaucugauuugcacuuaagaaauuaacuguauagguguaagcguaacugggcuuccucuuugccuucugcuggaucuauguuuccuuuauuuuucugaguucccuuugccuuucugauuuugaguagucugacugggaaaugcauuccauugccuuaacuuuuauuucuuuugaugauuauucauuucaggaagaggaaaaugaugagacaucuaggaggaaagcuggucaucaguuuggaguuacauggcgguaugucacacguaauuagaaccuugaauuacagugucuuacagugcauggaauaugccccaucacccugugaagauguuuucuugugauguucuaaaauaauugauuuuuauugugcaauauaaauuucacuauuuguauucauacacauuuagaccguuuuucaauaaggucuuuaucuccauucaacaacacaagaaucuguugagacuuugacccuuuuuuuucccucaucuguuuaacucagcauaacuuucauaugguaugguuccuuugguaguuucauuaacagugcuaccuuggaauauauaccucuaauucugaaagauuuaauacuuuuguuuacuaaaaauaucauggacacuagaguguacugcuaaauuaagaccacugacaacauguagacauacacagcaguuugaaugaaagguaauaacuuaauuauauuggagaauuagcugggugucuaaaaggaagacacuucaugugaaugucuggagagggaaagcuaccaugauuaucuaaaauuguuauugaagugaugaauuugauaggaugaaagauuaaauuccuugggguaggcuggacgcagugccucacaccuguaauccuggugccgugggaggccgaggcagguggaucacuugaggucagggguuugagaccagccuggccaacauggugaaaccucaucucuacuaaaaauacaacaauuagcuaggcgugguggcacgugccuguaauuccagcuacucgagagguggaggcaggagaaucacuuaaacccaggagguggagguuauggaaugagagaagaguuaaaaguacauaugcuagaauaugaccagaaggauccaaaagaaaccguuuugccucugggaaguaguaucugaagauugaagaaaggugaggaaacuuuacuagggacuuugucauacaguugcuucuuguuuuuaauagcacagauauuuauauacuuguuuauaaacuuuucauuuucaauuguaauucugccacuuaaccugcgaagcccugacaacacauuaagaucguuaagucuugauuuuccccauuuucaaaaugauaauaaccauaauacccuguaagaauugagauaauguauagaaaguacuuggcacauugccuagaacauaauaaaccgucaguaaauggugguagcucucauugguauuucuuauugccuggguucacauuuacucucuugugucuagagcaaaaaacaacgcugagagaaucuuuucucuaaugccagagaaaaaugaacauuccuauugcacaaugauccgaggaauggugaagguacauuuguuuuauuuauuuuugucuuucauuuccaccgaucaggguguuucagccucagaacuacuaacauuuugggucagguaauuuguuguggggucuguccugugcauuguaggauguuaguagcucccuggcuucuacccacuggaugugaguaguguacuccucccccacuuucaguugugacaaauaaaaauauguuuaggcauuaccaguggauagaaaaucccacugcacuagaguaugagcuucaugagaacaggagccugaucuauugagccugagcuauauuaccaaacucuaggacagaaaugugcaaggacuucuuaaguaaaugaauuugaugaugcuuaauuuuuccuuuuccagcaccgagcuuaugagcaggcauuaaacuuguacacugaguuacuaaacaacagacuccauggugaguuugagaacuccccucugucccuuucuccauuuccuucuuuuaauugucugugugaaggcuuuggaucgugccucagucauuggccuacacuuuaccuuuuccugaggcguagaugauugaagcaagaguagagauccagagaggagaguaguuuuccaguuuuguggacaugugauuagucaagggacacauaggaaugacugcuuugccuuaaacucagccauuuagggauuaaucuucaaccccaaauuuuaucauuuuauuauuuuacagcugauguauacacauuuaaugcauugauugaagcaacaguaugugcgauaaaugagaaauuugaggaaaaauggaguaaaauacugguaaggaggaauccucaguuuauuuuuuaauagggcuuaaauacucuuuaccagaaauacaugggcuggccaggugugguggcucaaaccuguaauaccagcacuuugggaggccgaggcgggcagaucaccugaggccaggaguuggagaccagccuggccaacauggugaaacccgucucuacuaaaaguacaaacaauuagcugggcgugguggugcacgccuguaaucccagcuacuugggaagcugaggcaagagaaucuauugaacccgggaggcggagguugcugugagcagagaucgcaccacugcacuccagccugggcaacagagcaagacuccgucucaaaaaaaaaaaaaagaaaaagaaacagaaguacaugggcuggagacagcauuuaugagcauguguauggcagucacuguguagcaguuaccuguucacuacccuuuccgcagcccugggacucagcugugucuggcacauaagaagaaaaaguugcuugaccgagaguauagagcuagaauucuggaccauuuuauucauuuauuuuucauaauaguuuuucuguuacaaaguaaugcauauuugcugucaaauccuaucagguguaauuucaaaaaguugaaaucacuggauugauucucgccuaguaacuuaagaauagaaacggcugggcacgguggcucaugccuauaaucccagcacuuugaggcugaggcggguggauuaccuuaggucaggaguuugugaccagccugacuaacauggugaaaccccgucucuacuacaaaaauacaaaaauuagccgggcauaguggugcucgccuguagucgcagcuacucaggaggcugaggcaggagaaucaccucagcccacgaggcagagguugcagugagccaagaucgcaccacugcacuccagccugggcaagaagagcgaaacuuugucucaaaaaaaaaaaaaaaccaaccacuuuuuuauaucauacuagucuauuauuuuugcgucuuuucuuggaaaacucuccuagguagaagacugaagacaguugaccaccucuaucaagugggguggguguuugaauuagcaggcuucuuuaaaaggcagaaucauggaaccugcuaauuaauaaacaguucuuaaaagagggauauaguuacuaaccugcuuuaaacauaagcaagaaagcuaaauucuuuacuuuguaugaaacauagauuauuggacagauuacccaggcaugaaagauacuucuuguuuuuuauucaccuaggagcugcuaagacacaugguugcacagaaggugaaaccaaaucuucagacuuuuaauaccauucugaaaugucuccgaagauuucauguguuugcaagaucgccagccuuacagguuuuacgugaaaugaaagccauuggaauaggugaggaugcgcccuugaguucucugaggacagagacugugccagccagagguuucagggcuacauaagcaaagagcuuuaaauuauucuugugcuuacauaauauguuggaaauuuucuuuccauguuuggcacauuuacuuacauguacuuauuauagugggagugccuuuaucaucuuaguguucauuaguauuuuagguacuuuguuuauggaucuguugaaucugaggagaagugauugcuuugaguuagcuaguuuuaaauucaugacauuuucccaacauaauuagguauuugaaccuaagugugugcuaguguauuguauauuuuucauuaauuacuuuauugaaaguugcuuugggaaucaauucacuucaauauauuuuacuguucucagugaagaaugugacuaauaaguauuuggacuuucaaaaagugauacagucuuugugauaguuuuuuaccuuuacauuaaugaguuggaaaauaacuuuguucaaaggaauagaaaugcauauuuugcuuaaauauuaacaauauguuuuuaauucagugugucucaguaaacuauguuuuggauugcuguguuuuuaccucauuguuuauuuuuucugucuaccugguaauuugagaacccucgcuugcaacauaucaccauauuauucgccuguuugaucaaccugguauguauggccuuaaauuguguuaauuuauauagaaaauugaccagcuuucuugaguuuaugugauuaauuguuguaguuaucuucucugcauaugaauuaagaagagagaauuuguaaauuaaccuguacagccugagcagaaaguugugguuuuuuuagauacaggaucuugcccauugcagccuugaacuccugggcucaaacaguccucccuccucagccuccugaguaguuaggauuacagaugcccaccagcaugccuagcugauuuuuuuuuuuuuuuuuuggacagggucuuacuaccuaaaauuauucuugaggguagcaaucuuguuuguggucuaaaacuugagcuggaggggagaggguuauggauuguacuggcagugauguuguacaaacaggaauuggguagaauauauuuugguugaaauuccuuuuguucucuggagcugugcuauuuaacaccauagccacuagccacauguggccaguuaauuaaaauuaaguaaaauaauaaauuauuuugucacauuggugcucaguagccaugugucuaguggcuaccaugugucgugaugcagauucagaacauuuccaucuuugccaaaaguuuguggacguuucugcuccagaggaaagguaaacuuauugugaagcguuuugggaggaccucaaggcuccaugcguuguccacuuuuaggucaguuccagugggagcucugcucuguaguagauggacuuugaagagagacacaccugagcugagauguccacucuaccauuuauuuaccagcuaugucaaagcgacuagauaccuaccugaggaauagcagcagggugugguaguuaaaugaguuccacacugugucugcuacugugcuuggagggcacauaugaggcacucaaaaucuuuugguucuuguccauuauccccagccugagaaauaacccuugaguucagaauugacaguucuagucauucuuucuuguggauagacuauaaaaauuacagaagggaaguuguuucucucugguuuggaggacuaauuuuguaaaauccauauccucaccuguauaggcaaauuuuaucuuuaggaaaaggaaccaguuaauugacuauaccuuggaaacagguaaacaguuuccauaauuguguccccuaaaauuuuacucaaccuuggugagauugugauggagcuaguauuucugacuccaaaguauauuccuuuccucuguaacucucaucacugguucaauugcuaaucaaagucagauguacuuacauuuccuaaguaacagccaggacugggggauggggguucugggggagcuguguugguuugucuuauguauauaaauuugccugucugcagcaguaguuuuggcuuacgccuguaaucccagcaauuuaggaagccaaggcaggaggauugcuugagcccaggaguuugaaaccaacauagagagaccuccaugucuacuaaacaugaaaaaaguagcugggcaugguggcgcaccccuguagucccagcuacucaggagugugaggcaggaggauugcuuguggccaggagguugaagcugcaguaagcugcguuugccccacugcacuccagccuaggugacagagcaagacccugucucaauaguaauaauaauuucuaggaauuuacccaaaagagagagccuaaaauaaccuagaaacaauacauugaaaagagaauauuauguaacuaauaaaauuaagaauauuagcaaagggaagcaugcuugaguaaauugugaaacucuaucuguacugucauuacagcuuuacuaccacaaacauacaaaacagguagggaaaggaguguagagaaauauuugacugggaauauugcagaugauuuucugaccuauuagugcucaguucauguuauauuuaagaacugcccuguccauuaauucuaguuuacuuuuucuugaccucauucugauuauauuuaaagggaacacaaaugauuacuagcaaaaaacauuuuuagccgggugcaguggcucaugccuguagucccagcacuuugggaggccgaggcgggcagaucacgaggucaggaguucaagaccagccugaccaacauggggaaaccccuccucuacuaaaaauacaaaaaauuagccaggcgugguggcgagggcguuagucccagcugcucggaaggcugaggcaggagaaucgcuugaacccgggaggcggagguugcagugagccgagauugugccaucgcacuccagccagggcaauaaugcaagacuccaucucaaaaaaaaaaaaauuuuguuuuucuaaguaugcugguuuggugagggaguguguguuacugucugccgccuacuucaguaagucaggcuucaugugaagagacuaaaggaaggagaaagucucaguggagcacaugaacagagaccugugauuauuccagauuuuacagagaauugcucucugcaggguauagugguuccuuuagcaagcauuggccuccacccagaucuaugcgaggacuuaggcuggagguggaggaaggagaaaugugucccuuuguauuagguacagugaguuugguggugguaaaggaaguggauuaaacacauuugcuuucuuguucugcaggagacccuuuaaagagaucauccuucaucauuuaugauauaaugaaugaauuaaugggaaagagauuuucuccaaaggacccggaugauggcauguauagaaaucacuuguguuuuccuccucuaaagacagagggccgguuuaccugaguaccaguuagaggccuugugaucccuauagcuuagaaguauuuuuuuuuuuuuuuaaauaaauuugaguacauaguagguguauauagcuuaguaauauuugccauggucuuucugagaaagccaaaauugugguacauuccugccucucuuaaguuuuuauguucuuagcuuuaucuugcauguuaccaguuuuguuggcaggauuuuuguuaauguuacugacuugaaaauauauuuuauccauuguaaccaaagcucuugugaacuuugauuuucagauaaguuuuuucagucagccaugagcauaguaaguaucauuucuuuauuaauuugcuauccauuuccuaaauuuaucuguaacuggaggguucucccugguucuuuucacuuucuaacucuucuguucaugucuuugcuucuguuuuuucuucuuucucuaaaaucuauaauuuuuuuuuucuuugagauggagguucacugugucccccaugcuggagugcaguggcucaccgcaaccucugccuccuggguucaagcgauucuccugccucagccucccgaauagcugggacuacaggugugcgccaccacaccuggcuaauuuuuguauuuuuugugguagagauguaguuucaccauguugaccagacuggucuugaacuccugaccaccucccaaagugcugggauuacaggccugagccaacgcgccuggccuaaaaucuguacuuuucaaucacauacuaucccuacccuuuguuuauuguuuacauugacauuuuucaugccccugaacagauaagcuuccauaauauuucagauuugccuauuaguaaguuaaaauugauaaugguuuuuauuuuaguuuauguaaucaugcuuaucauaggaaaaauuucaggcaguuuuaggaugaaccuuguucccuaaggguaauuuaauugcuuuacuauuagauuggugcaaaaguaauuguggccuuugccauuacuuuccauggcaaaaaccgcaauuacaaaagccgcuacuuucaauagcaaaaaccacaauuacuuuugcaccaaccuaguauuuaguauggauccucacaagguuuuuacucuggguacucaagcguauguauauccaggcauacuuucaggguguuuuauuuguuggcagcaaccaguauuucauaguaagaaccauaacuuaacuuuccuguggguagauuuuggaguuauuucauggagauuuuuacuaguccagacucugcagugcaggugucuuuugugcacuugaccagguguuguuacaggauuaauuuuuaaugguauaauugcuuaauuaaaauaauauuguaauaaauuucacagaacuugggauuugucucccccccauuucuuauaacuuacuugcugucaaccaauaauauguugaaucaacauuauuuucacaagacacucuacuguuguuauuuauuugugaaccacuggcugacaggguaucagagugauacuuacuacuugcauauuuucagugcucaucucucagagaucuagaacuugccuaccaaguacauggccuuuuaaaaaccggagacaacuggaaauucauuggaccugaucaacaucguaauuucuauuaguaaguguguuggaaacauauccuuuugcaugaguuaccagauucugcaagugggaggcuguugaugucccuucauaccucaccucugguuucaggcaacaugccaaugaucuaauaggacauguuaauugagcacuuaggaauuaaagcagugguaaaacugccagauuugaaagacuaguuuguguccuuuaaggguuuuuuuuuuuuuuuuuuugcaacacuguaaaauccacauaucuuuuuccucuacccccucucauuuuacauuuucaaauuguuauagcagggugagcccugaagauuuccuuucaccucccuugcuuuuguauucaaagaugaagauacuggaaccuagagauacucccuaaauggguuugcuuuuaggcagauaagaacaugaauuuaagaaggcagcauguuaacagaugugugagaauuguuuucuguguauccaaauccuuguuucacauugaauguuuuuaaaaugaauuugaaauucaguaucuauucaccaugaccuaagaguauacagaggaaacaguuagaaaugaccaguugaggguaggguguuuaauugagaagucagcacacacuggcagcucuuaaaccaaauauuggcucguuuaacuugaaacuguaaguauuuugaaauucuuuguaacauauaauaugcuauaauuucaacccuuauuuccccuguuguuagacauagggacuuuagacuaaacauacuuuuugccuucaucacaguuccaaguucuucgauuugauuugucuaauggaacaaauugauguuaccuugaagugguaugaggaccugauaccuucaguaagaugguucauuacuuguuauuuaucauucuagaugaauuggguuucugcagauuaaugcuuuaaaaauguguuucucuuaaucaggccuacuuuccccacucccaaacaaugauacaucuucuccaagcauuggauguggccaaucggcuagaagugauuccuaaaauuuggaaaggucaguuuuacuuuuuauguguccaggugcaucucaccucaauauccucuacuuugauaaugaaugugcuaacauuacuguuagggaugaaaacuuccauuuugacugaaccaaauguguuaguugagauguacuucaaggucaugugcucauguugcauguuggcuaucaggagaaaauuuuguugaaaaugacuuaagucagucccuucgugacauaggaaugagcugaguuuugugcaccuguugcgggauaugacccaaagaaaauaaaugcuaauggcguggcagacccuaaaucugaauaaaggucuuugacccggaagccuguguaauuccucugugccaguguugccucacuucacuaaccacagucagugaugauucuguuuccaaguaauagccaugagcaucacgcaucacgggugugugugucuuauguguauaacuuggcugcaaaaugaaauagauauucuguaucuuucacuaggugacuacuguaucauaaagucaguaggcucuagucccgcccuccugcuucacacgacugcucuaaugagugauaaaaguauaucaaauucccaagugcuauaaaacaacgucuuaaccacguggagcugguggcugcucccauguagugcacaugccgugaugaacacgucacuggagcaaggcccaggcauuggcuuuuacauuuguuccacugugaauccugguggguuucuggaauccugggauaagccuagaauaaauaacagcaacuuauuuuuaccuaccaaaaaauagguugacagugaacaaaaguguguugguuuuacauaacaaugaucacuccuuguuccuuucuuguuucaagauaguaaagaauauggucauacuuuccgcagugaccugagagaagagauccugaugcucauggcaagggacaagcacccaccagagguaggccugaaacucaccagccaguauauccucccauacugaggucuucuuaaggcuagcuucccugguuuuaucugccauuuuggagaguucugcuacccaaacccauauuugagugaugauacaucuaaacauaucuugcccuuagcagaaaucuguucuuaaaguuacccucuuuccuguaguccaaagcaagcaacaugaaauuagcuucugucuucagcuugcuuuuuuaaaaaucuccaucuacaaaggaaaugcauagcugaauuugaaaguuguggcuaaucaaaauacuuaggacaggguccuuuuuuuauuaaauuacuugugugcuauacacauaauauauucaaaugguaaaaugcauugcucagauuuuaaggauccuguguuagucuccugaacugaaauucucauaaaaucaguuaggcaguucugcugacuccuaagcuucucagcuucagguggcauuugcugacugugcugcugauaucaaaucugcguaugaaagccaacccaucagacagacugcucaggauuggccagccaccucucucaacuguauagcuauccucuuuuuaagggcugggagaacucaggaagccuggugaguacaguaccacaaguauacacuuuagaagcuuuuguauuugaaucuaaaacauuggcccacgcugguagagguucuuucauuuggccacauaacacguauuugauucgggaacuugcaaauaccaacuaaaaagcaaacuuuuggaagaagacaguaugcaugauguaguugagauaaggcauaguucucucaaaccauacgcugagaauuaucuuucuacuuucugugucuauggacaaguaagucacuuaaccucauuauuccacuuaaaugaacuaaagaucaaagaaauauaugaucaaagaaacguaguuuugaaaaugguuuggucauuuggguuauugaaguauuuuuggaugcuucucccaucccacucuccagcuuaaaaugugggcuguguacuuagacuucuggaagcuggcauuuacgcacauuaacuaaacuuggccuugaccacaacccguccuugauuggugccacuguguucugguuauguuuuuaucagcacuucauucacauacuaauuuuuaguguuugugaaugggaaccuuaugcauauucauguuuccaaaaaugagcaaaaggaucuuuuguagggguagugacaggugguuuuccuguauuuuguuuuguauauaaauguguguucuaaaagucauuaguggggggugcuugugcauggcuccuuguacaagaaaguagcuuuauuugaacaucugauugcuagucagcuaucuccaggaaaagaugaugaaggcuugucuuugagguguggcucacacgugucucucuagcaacuaugcugcuagugacagagacguaugacauuugcauuugguuguuagcgcaggcaguuuggcacacacuugauacaaccaggcugugaugauuggcgcagggguacggaccucagcugagucaugggagcugaauguauguguuucuccuuuguccugcauguggcaggcugauggggagcacuuacaugagacuguugccucaaucugagccugcacuucauaacagaauucuaagacagacugaaccccugcuguacuuuaagagagggaaacagcagguucuguucuaugccucuuuuccagcugugcacaggauggauucccuccuuagaaggacaguggugauccucuacaagaggacaaauacaguuggaguaucccuuuuccaaaaugcuuaagaccagaaguguaugggguuuuagauuuuggagcauuuuuggauuaggaauauucaaccuguaccagcaaaucuugacauuggcagcauaucagauuuaccugugaaaacugcaguguagauucguuuggggaguuuaagcaccugcggugauucucauguacacacagggcugggagcuaguagagcccacagaugugugucuuugggagcuuacaguauaguuaagaaaagggcauuuagucucugauuucagagagaagacagcuauagugucugauugccuuguuuuucuaauaguauucauaaucuuuuuccuuucuugagcaggaaaauguuggggcuuuucaggaagcauaauaagauuccuagguaaguugaaaucagccagcucucuuuggguacagccuggaaguagccacauuuggaauuucuucaccagccuuagccaccacauuugggcacucuucuguuaggcaagcauaccgucaacucccuacuauccagggcauccugaggcaagcaguuuuuuaucuguguugacggaucaucauacauuggggcuacauugaauagaucaucaugaagucauacugaaugaauguugauaauccauuuggcccuuuagacuuucuaaccucacuggaaacaaguaaaaauaaauguuagacuucaucuuugucuccagaaauacuguugggaauucuguuacugaacuuacacuggaucuugccuauaaauguuuuacugaaggggcuggagaaaguucacacuuugccuuucuuuuacagaagugaguugcugaaugagcuuauggacagugcaaaagugucuaacagcccuucccaggccauugaaguaguagagcuggcaagugccuucagcuuaccuauuugugagggccucacccagagaguaaugagugauuuugcaaucaaccaggaacaaaaguaaguggucaccaugaagcauaguuuguaaaauggagaccuuucauccaucugcccauucaaaauguucauagcuuucuaucccuucuauuuccuuucaaaaagucagaauguaguaauuuaaugacuauuucauuugucaugcaagucaggaaagccuauagauuugacuguuagaagcuuuuuguuucuaauauaguuuaaugcaacugcagggucccuuuuucugauuucaaaacugacaggcuauaggugagugucagagacaccgagaaccccagcacccaguugaauugcaguguaauccuccauuuucuuuucuuaacagggaagcccuaaguaaucuaacugcauugaccagugacagugauacugacagcagcagugacagcgacagugacaccagugaaggcaaaugaaaguggagauucaggagcagcaaugggucucaccauagcugcuggaaucacaccugagaacugagauauaccaauauuuaacauuguuacaaagaagaaaagauacagauuuggugaauuuguuacugugagguacagucaguacacagcugacuuauguagauuuaagcugcuaauaugcuacuuaaccaucuauuaaugcaccauuaaaggcuuagcauuuaaguagcaacauugcgguuuucagacacauggugagguccauggcucuugucaucaggauaagccugcacaccuagagugucggugagcugaccucacgaugcuguccucgugcgauugcccucuccugcugcuggacuucugccuuuguuggccugaugugcugcugugaugcugguccuucaucuuagguguucaugcaguucuaacacaguugggguugggucaauaguuucccaauuucaggauauuucgaugucagaaauaacgcaucuuaggaaugacuaaacaagauaauggcaguuuaggcugcacaacugguaaaaugacuguagauaaauguuguaauuaguguacacguuuguauuuuuguuaauauagccgcugccauaguuuucuaacuugaacagccaugaauguuucaugucucccuuuuuuuuugucuauagcuguuaccuauuuuagugguugaaaugagagcuagugaugacagaaggauguggaaugucuucuugacaucauuguguauugcugguaaucaaguugguaacgacuacuucuagcagcucuuaccacuaugacuuaagugguccuggaaggcaguaaguggagguuugcagcauuccugccuucaugagggcuucuaccacugaccacuuugcacguaccuggcucccagauuuacuuagguaccccacgaguuguccacauaagcagcuucaucuuuaccuugccagaguugacaauuaugggauacucuagucuacuuauacuuguguucccaucugucugccauccucugaaggccgggacccagucauacauccuuagaaaccaaaguaugguuuuuguuuucucuuggaaugucaggucuuaaggcauuuaauugagggacaaaaaaaaaaaaagccgauauaguagcuagcuacuuaagcauccauggguauugcuccauaucaaagcagauuugcaggacagagagaguaaauuagccuucagucuugguuuacagcuuccaaggagagccuuggccaccugaaauguuaacucggucccuuccugucucuaguucaucagcaccugcagaugccugacucuuguuagccuuacuauucaauacaguccuuagauucacgguaugccucuuccuauccaggcaccuauucugaaucaccauguugcucugcagcuagaguugauaggagaaaauccauuuggguagauggccuaugaauuuguaguagacuuucaaaaugagugauuuguuagcuugguacuuuuaaguuugugguacagauccuccaaacccauacucugagcaauuaacugccuugaacauagagaaaaauuaaggccucacaggaugagucuccauucucuguaaaugcuuauuuuaucauagucuuuagccucuacuaugaguaaaauguucucuucggccggguguggugacucacaccuguaaccucagcacuuugggaggcagaggugggaggaucacuuagguccaggaguucgagacuagccugggcaacauagugagacaccggaucuacaaaaaaauaaaaagccagacuggugguauguaucugugucccagcuaauugggagggugaguugggaggauuguuugagccuaggagagggagguugcagugagccgugauugcaccacugcacuccagccugggcaacagagcaagacccugucuuggagaaaccagaauuuuggaagagcaaauggggcugagugcaguggcucaugccuguaaucccagcacuuagggugccaauguggauuaccugagcccaggaguuugagaccagccuggguaacagugagaccccccucccuacaaaagauuuuaauaauuaguugggcguaguggugcaugccuguaaucccagcuacucuggagacagguggaggggauugcuugagccugggaagcugaggcugcaguagccaugacugcaccacugcauuccagccugguugacagagugacccuugucuccaagaaaaaaaaaaagcaaaugggauuaaggacucauggaaugggaaggggaaggggagucuuacuauauguggaauaaacuugcucaguguugccacagaguuacauuaccaauguguagaagucagaaacuagacuucuaguuugguucaacauuugaggguuguuuuauagccaucaaaguauucaagagguuggauggcacucaaaagauucuacaugucuagaaucaaacucaaaucuggcacguaggugcuucuuaguaaaugcuuaaugaaugccaccaacucugcaaaguauucauugauuuugagaccuuagucauguugcuacuaaaaguagggcauaugaccgccuaagaaacagaacuucgagaaguccuaacguaaccacaguaaagcagacuccccuuucagcaaccucaaagcaaaaaaaaaaaaaaaaaaaccaguuagcugcuauauaaacacuauaccaagcacuaggcuuagaggaaaagaugucagauuguacugucacuggcuauguacccauauucucuaagacaggguagcauuugucuuucaaacugcaggguuugaaaucaguuuuugugggugauugcaauuuuuuaaugaaaugcauuagaacaucuaagcacgucaccuacaguuuugugauggugcauuuuugcauugcaguauagaucugugcauagauauaugcauuaaguguagcaaaucgugauguaaauuuuuuacugcuggucauggucaaaaaguaagauacgcuaggaaauugagucacuaggagcauggauguauaaggcagguuuuauacaaccauuuagauucaacauuaaugguagaguggcauuuuaccaaaaaaauggguguauuugauuugggugcuguaaggcaauuugcuaggacaugggauaaucagauuacacaaaaucuaggcagugaacaagucuucauccuggcccaggaaauagccuauuaaaaaaugcuguccaggccaggcacaguggcucacaccuguaaucccaggacuucgggaggcugaggcuggaggauugcuugaguucaagaccagccugagcaacacagugaaaacccaucucaaaaaaaaaaaaaaaaaaccaaaaaaacuguccagcuguggacuuucaggauucaggacugcuggggaucaagcccaaggauguuuuucagagcucugugauuuaagaugcucgaaaagaguguccaagaggaguaaaggucaugacagaauuuacucccaggacaaucuaaguucugccacaaguacccguggugucuguucccacaacaauggcccuuucacaagcucuugccucacaaccccugcagaaguccuucaacaaaacuaauaauagacuagugaaaccuacuccucacauggguaagaguugcagugggcaggugacccuccucccugcccccauccuuugcuuccucaagcucccugccaaccucuggauacaucaaugggaaggaaaccagggaagcauagaccuauaguacaacagggguguagugaccacuggaccugaugaagcgaaucugccugaaauuuaauacgccuuuuuauuucccuucuguguuaaaucaaaugaucuguucugcacugagccaagcaaguuacuuuuaaaacugguggcaccacucauuugggacuuggagacugcuuuuauccagaaccuguuaagagaacaggggauuuaaauacaaaggaauaugaagguggugugccuuaaagacagucuaaaauuagguuuuaguuuguuacauuauuuugaaauauuaaacaugaaaauguuaaaucaggaugugugaguuuuaagauguugaacacuguccuacaucagugaggagggaggcaauaaaguaauuucagaguaaaacagauugaggaugaaaccaagacagaagugaugauuuggcuuuuuaugauuuuugcuguggaaauggcagucgugugacuuuucacuugcaguuuaaaugaaagggugaagagaagccuaccugcccuaauggcucagggcuauauccaccucccggauaacccuggcccuugggacuccaucaucuccuugaaguagcacugagaauccaagaagaggcuccgcugcuuuuugcacauguuacugaguuacaucucaggaagauuuuuaagcacgaggaaggaaaauacaggccuggccaagcaggguccccuuuucgguaucaucuuuguuccuaauaagcaaucaagggggguggguguguuggcugguaaaggaacuacuaagauucagaagcuuguagucuucauuauuuuguuuuacagguuaaaauaaaccacuugacuggg

SEQ ID NO: 191627 - RNA, 79828 nt, Homo sapiens
auuggcugaagcggaagaagacgaaagcaaucauaaaaugggagguugcaagcucaugguuugaaagacuucgucacggaagcuaaaagcucuauacacccgauuugccucggaggaauuuuccuaaaugauuauuuugaugucuuauauaucuuugauuguuuucaaaacaaaagagcgagcagagagucguacaacuauuuguuccccccccauguagaagugaucucauccacguaaaugucguuccugcgaccgcuuccgcgcgcaagcgcacguugaaucgcguggugacuccgggcuugagguugaauuaagaauagucagguggugaguggaacgucucuuggggugucggaauucaaaacggaccuggaggauguugaucuccaagaacaugcccuggcggcggcugcagggcauuuccuucgggauguauucggcugaagagcucaaguaaggaguuggucggguagcgugcccagccuggaucuugaggucggcgcccuaaacuacgauucccagaagcgcuuuugcccagucuauccucuugaguccaggcuugucuggcgcuuguccugcugggagccguaguucugggaacguuccugggccggcguggacugccuggauaagaggccgguggugcugggggaaagaguuugcgcugagguaggggaauauaaggguggggaggguccuggucugcagcguuaucaucugccagucuccucguuaacuaacaagcauuuguggaauuaaccauaguguaccugacaugguuaauuaggcacguaguaaguuuccucuuguuuguaaaaugauuguccuucaagugucaguucaggcguuaacuucucuuugcuaggacccugcuauauucucggucugguuguuaaaucaagggaacucucuuuagucuucauuuugaucaagguagcauuugacauucuccaaugcacucucuugaaacuuuccuuucuuccagaaccuuauuugucuucaaguucuccuauuuuuaugacaaauacuucuaccucccucucuuccucuaucgaucuauaaccucacaaacauuuauugagcauccaguuuuuuccaggcaccaagcuaggcguuaaugacacauuggugagcaaggucuguaccucauuuuacuccuuaaauguugauguucuucaagauucuauucuaguaauguuuucuucaugguaaauauugucccuagacaaucucaccacuuucaugauuuauagucucaaauuuaaauccccaacgcaaauuuauuucccugauuuucagacccauuuguucagcugucuguacaucuuuaauugaauuucacacagagaucuuaaaugcauaucaaaaacucaacauggccuaaaugcauaucagaaacucaacauggccgggcacgguggcucacgccuguaaucccagcacuuugggaggccgaggccggcggaucacgaggucgggagaucgagaccaucccuggccaacauggugaaaccccgucucuacuaaaaauacaaaaauuagcugggcgugguggcgggcaccuguagucccaguuacucgggaggcugaggcaggagaaucgcuugaacccaggaggcggagguugcagugagccgagauugugccacugcacuccagccuggcgacagagcaauacucugucucaaaaaaaaaaaaaaaaaaacucaacacggcaucccucuucaaagggagggguuacuuaccccuccaaaaugguguacguagugcaaaauagucacuagaaacuggaaaauuauucuagaucucuccugacauauaacuuauuuauugggcucuuacuuugugucaccuacaugucuauuuguucuuagucuccuuuuucucccaauugcuacuguguugccucuggcccuuaucucauauuugaauugucuuuuccuuccacccuccccuuacaccucucaagugcaugcuccacacugcugucaaaauuauucuugcaaagugcaaauguagucaugcuacugucacccuuaaaacccuccaaauguucuccauuucccucagauaaaguauauuuucuuagcauagccugcaaagucucccaugaucagaccaaugcugauuuuagcuauaacaucaucccuucuucagcccuauuaaaccaccugcauauuccagaaaccgccaucauauuucaacaucugggccuuucuuuaagcuauucccucugcaugcaguguccuuucagccaaaaggagguacuucccucuguccccuacccaacauacacaccugaaagcucaguucaccucccuuguuuugugaggucauuuugcacaugauacaguugucugucauggugcuuuagugacuuuuugugcuuauguauauuugucuuccuccacuauccuugagcuucuuauaugugucacucuugucuuuuauccucaagucugaauaaauggaugaauaaacuccugagccacagcucugguaucauugguaacagugugcuagcccagaaauuccaauuauaucaucacugccauaaguggauacgauuucauccaaaagcagaaguguuuuaaguugccugaauuuuuaaaaagauaauuguggaguuuucaaacaaguuuagaguugagacauuucaauaauacugccaccuuuuauugugccagguucuaauagcuucccaucucacucagaguaaaaaccaagucuuuacaaauggccuggaggggucauuucagucuccuguuaccucucugaucucaccucuauucuggcuacccugaccuccuugcugcauccagagcaccacgggcacacauccaccucaggaccuuugcacucccugcuucuuccuccuguaaaacccucugcccaggugacuguauggccugcucccucaacuccuucagccuuugcccaaguuccuccuuagugggcuucuaggaccacuugccuacucugcucuucccuuucccugcauuauuuuucgucauagcccuuucugccgucuaacagacuauacauuuugugucuguucccguuccuccaauagaauguaaggccuguaagcauagcaguucuugucuguuuccuuagcacuuaacacugucuggcacacagugagcacucuggguauuuguugaguguaugaauagauggauagaggagcuagcugcucagugcuuggcacuuucaguccuuaacgacacccauucucaguucuuaacaacaccauuugugguggcaccuccaguaaaaaauucaggcccagagaacaaaaugucucucuaggaaguggcaaaggucaucuucaaaccuaagucuauugaucucaaacucuacugacugguggaauccuugcuaguugccccuacucuucaucccacuccuguaauggugggagggacuuucuccucuacaaagagagaggaacuuuguuugacacuguauuuucuguauguuaucuucuaaucaucccaauagagcugcugugaugcccagacuucaggugagaaaaaaauuagguaguuaucaaaggauacagucagcagagugaaagggcaacccauggaaugggggaaaauauuuguaaauuauauaucugaugagagauugauaucuagaacauaaaaagaacuccuacaacucaacaacaacacaaaauucaauuuuaaaauggacaaaggacuuaaacagacauuuuuccaaagaagacauacagauggccagugaguaugugaaaagauguugaacaucaccaauuuuagggaaaugcaaauaaaaagcuccucaaauccaguagggugcuacuaucagaaaaacagaaaguaguaaguguuggcaaggguguggagaaaguggaagcuuuuuguacaccauuagugugaauguaaaauggugcaaccacuauggaaaacaguaggguggauucucaaaaaacuaaagacaaaauuaccaugugauccagcaauucuacuucuggauguguauccaaggaauugaaaguagggucucaaagagauauuuguauaccuauguucauagcagcauuauucacaauagugaaaaaguggaaacuacccaagugucuaucaauggauggguugauacauaaaaugugguauauacaugcaaugggauauuguucagcccuaaaaaaggaaaaaaguucaacacauccuauaacauggaugaaccuugagggcacggugcuaagugaaauaagccagucacaaaaggacaaguacggugugauuccacuuaauauaagguaccuagaguagucagauuaaucaaaacagaaaguaaaaugaugguagcagaggagaugaagaauuacuguauaauggguacaggguuucaauuuuacaagaugaaaaaggguucugcagauggagaguggugaugguagcacaaugcaaauguacuuaauaccacugaacuguacuaauugaaacaguuaugaugaauuuauauauauuuuauuacaguuucaaaaauuaagauuaaagaacaaaagguaaguaauuuguucaauguuacccaguucaggguugcagguggacucuagauuugugggaagagaccacacgcacaacuuuugaguuagaucaaguuucucaugaaauuagcuuacuggcagcaaggugaccauauagacaagagccacagcagcagaucugccucccugucgccuuggcccuuagagugacacuggccaugcaacauagaaucuucuagagcugagcagcuuaguuccugauagacuaacauuguuuuacacucagaacaugucaccacucaugaaaacuugacacuauuuuugugcuuuauuaaagggaguguuuacaucauuaggggacucucguuucagccuucggauuuccucuaggcugucagauugggaugguuucuuugucuuuauuuucuaaaucagaaaggagaaaauuguaaaagcaaaguuagccuacuaaacauaguuguguccuaugggagcaccuuucaaaccaaacauaaaaugugaugaaaccuuuuuuaagguuugacuaaauguguuuaauguugucaaauuuacuauuucugcauacagggauuguugcaucacauucccuucauugaacugggugggcuuuggaguuaagucuauuccauauccugccucccccacauucuguuuguauuugugucaccuggauucaaucaccuaacuucccugagccuugguuucguccucugaaaaguacauguagugaugaguauuucagaggauuaagaucaggacuaaauaaugcggccaggcaugguggcuuacuccuguaaucccagcacuuugggaggcugaggcaggcggaucucuagagcucaggaguucaagaccagccuggguaacauggcuaaauccugucucuacaaaaaaauauuaaucgaaaaauuguuugggcauauugacacacaucuguggucccagcuacucgggaggcugaggugggaggaucacuggagcccaggaguuugaggcugcagugagucgagguugcaccacuacacucuagccugggcaacaggagugagaccuuguuaaaaaaaaaaaaaaaaagacagaauaaugcugccugugaagcagucaguguauaguagaugcuuaacuccuuuuuaugaacaguuuaccaguguacuuagugcaaguuuuguucuaaaucuguuuuuaagaaguuaccacucauucauuuagcacauauguauuuuaugacuuauucauuuagcacauauguauuuauuaacuauuggguaccaacucugcacuuaguguugggguacacuagugagaaagacagauugugcccuccagagcuaucaagcaggcauuaaauaaucacuuaacuauagguuugugcuggaaaggaaacaucagagagguugguaacuuuagcuuuccucuuggucuuuuuuauccccuuaggaaauuaaguguuaaauccauuacgaacccucgauaccuggacagccuggggaacccaucggcaaacggccuguacgauuuagcuuugggcccugcagauuccaaagaggugugcuccaccugcgugcaggacuucagcaacuguucugggcaccugggccacauugagcucccacucacaguguauaacccucuccucuucgauguaagugcugccuuaguugugugggucuccgggcugcuggugggauuugugagugcugccucucucccacaagaguggucuaaggagguuaagccccaggcacuccaaugaaagcauucuguagaaugagauuuugaaguuuugagccaaauacaauaacuucaacuuacccuguggcccuaaauaaaugaauaucaguuugauuccaguugaauagagccacagccugauuccguuugcguggagggucggggagaguucagauucauucccuacaccuuuuguugcaggggcuuugugcucuucagaaaucucaguggcaccugccugguaauagagagaacuucaguguucucagggucucccugagcccuucaggugucucuauaggcacuugugugguggcaggagaagcaaagccccagaaagcccaacagugaggucagaaugaagcuccuguuuagagucaugcugguacauuuucagcuuuuuauuucagcuaaccucaccuccaggauuuuuuuuuuuaagcuacacauauguugguauacauggacaugauuuuugucuguuaaucguguuaaagagaagugucuuuuuuuuuuuuuuuuaagacagugucucauuccgucucccaggcuggagugcaguggcacgaucuuggcucacuguaaccucugccuccuggauucaagugauucuugugccucagccucccuaguagcugggauuacaggcacgcaccaccaugcccagcuaauuuuuguauuuuuacaaaaauuacgggagacagguucaucauguuggccaggcuggucucaaacuccuggccucaaguaacuggccucaagugaucugcccaccuuggccucccaaaaugcugggauuacgggcaugagccaccgcaccuggcugagaagucucuuaauuaaaucuuggaauaaaauaaagauauuuuucuaccucagguuguacgcccaaaguaaauuucaaaucuaaauggauuaaaauaaaaccuuaaaagaaaauagaggguaauauuuaucugguucuuaagauaacaaaggccuuucuaagcauguaggcugaaguagaguuuuuaaaggaauagacugacuacauaaagaaacuugugaguauaccgaaaaucaccauggcuacugugucucuuucuaauauccuguuuguuuuuauucccucucuucagaagcuguaccugcugcuucggggcucuuguuuaaacugccacaugcugacuuguccccgggccgugauucaccucuuacucugccagcugaggguucuggaagucggggcccuacaagcagucuacgagcuugagagaauucugaacaggguagguggguagugguggucacagaaaucagaaaaggcaaagugguguggggaacaagagaugcuuguauguuguccuaguuaccaugccgauagucaucagaacguuugaucuuuauaucuuauaacuggauaccaauagcugagugugaaaacaggaagcuauaagaauaauaaaagaaauguucauagaaacaauagugaaauaccauuuaauccauuuaugagcuuuugcugauuuucuggaccaaggauucaaucaagguuuauucaaucaaaagacauugcuuuugauuguuacaucucuuugaucugucuuaaaguagaacauuguaauguagaaaauucuuuuucaugauaccaacuuuuuuggagacucaaagccaguugucuuauaggauuucuuacauuuuagauuguccgauuauuucuuguaauuagauucacauuuuggcaagaauacaaccuacaugauacaggguacuuuguauugcaucauuuuaggaggcauaugucagguuguucaccuauugguaaugcuuacuuuguuuacuucuuguauuugguuuuuuuggucuuuuuuuguauuaacacauaauauuuacacauauuuuaugggguacauagugauggugugauacagacaguguauagugaucagaucaggauaauuagcauaucaguucucucaaacauuuaucauuucuuuguguugcgaacaugcaauauucuccuucuagcuguuugaaacuauauuauuguuagcuauggucauccuauaaugguguagaacacuagaauuuauuccuccugucuaauuguaauuuuaucuccuuuaacaaaucucuuccuguuccccuccuuucccuacccuacucagccucuaguauucucuauucuacuuuuacuucuaugagaucaacuuuauuuuuggcuuccacauaugaguaggaacuugcaguguuuaacuuucuguuccuggcuuauuucacguaauguccuccaguuccaucuauguuguugcaaaugacaggauuucaugcuuuauuauggccaaauaguauuccauuauguauauauaccacauuugcuuuaucccuuuaucuauuguuggacaucuagguugguuccauaucuuggcuauugugaauagugcugcaauaaccaugggggugcagguaucucuuugauauaccaauuucuuuuccuuuggauaaaugccuaauagugggaugcuggaucauauggaaguuguauuuguaguuauuugaggaaccuucauauguuucccguaguggcuauacuaguuuacauucccaccaacaguguauaagaguucccuuuucuccacauccucaccagcauuugcuuuuuuuuuuuuuuuuuuuuuuuuuuuugucuuuuggggauagccauccuaaugggaugagaugaaaccuuauugugguuuugauuuguguuuuuguguuuucucaaugacuagugauguugaacauuuuuucauauauuuguuggccauuuguauguguuuugagaaauguuuguucagaucauuugcccauuuuuuaaucgaauuguuugggauuuuugcuguugagauguuugaguuccuuacauauucuggauauuaagccucugucccuaagaugaauaguuugcaaauauuuucuccuauuccguagguugucuuuucacucuguugacugacuacuuuguugugcagaagcuuaguuugauaaaaucucauuuguuuauuuuggcuuuuguugccugugcuuugaggucugauucauaaaauauuuuuccagaccuuauauuuaggucauugaucaauuuugaguugacuuuuguagaggggagcaguggagaucuaguuucauucuucugcauauggauaucuaguuuucccagcaucauuuauuaaaggcacuguccuuuuccccaguguauguucuuggcaccuuuugcaaaaaucaguuggcuguagauaugcagauuaauuuuuggguucccuguuuucauuggccuuuguuucuguuuucaugccaguauccuacuguuuugguuacuacagcuuuguaguauauuuugaauucugguagugugaugccuccagcuuuguucuuuuuacucaagauugcuuuggccauucagggucuuuuaugguucuauacaaauguuacaauuuuuuuuuuucuguuucugcaaagaaugucauugguauuuugauagggauuguacugaaucuguaaauugcuuuggguaguguaguaauuuuaacaauauuaauuauucugaucuauaaguaugggauguuuuuccauuuguauccucuccaguuucuuucgucacuguuuugcaguuuuccaagagucuuucacauccuugguuaaauuuauuccuagguauuuuuuugguagcuauuauaaacgggauugccuucuugauuucuuuuucagcuaauucauuguuuguguauaaaagugcuacugauuuuuuuuauccugcaacuuuacugaguuuguuuaugaguucuaagagguuuuugguagagucuagguuuuucuauauaugagauuaugucggcugggugcaguggcucacaccuguaaucccagcacuuugggaggccgaggcagguggaucacaaggucaggagaucgagaccauccuagcuaacacgaagaaaccccaucucuacuaaaaauacaaaaaaauuagcugggggugguggcaggcgccuguagucccagcuacuccggaggcugaggcaggagaauggcgugaacccaggaggcagagcuugcagugagccaagaucgcgccacugcacuccagccuggguaacagagcaagacuccaucucaaaaaaaaaaaaaaagaaaagaauauguaaucuguaaacagggacauuuuuacauccuucuuuucaguuuggaugccuuuucuuucucuugccuaauuucucuggcugguuacuuuuggauaaaguggggaugaccagaucucuauuguaaagagauacuuuuucauaguuaauauuuacauuagaauuucuggugcuauuaaaaauaccuuauuuaaaauuucauuuuguuuguugauauguaaaaauguuauugauuauuuuugaagcaacguggcaaaauugucucaucaauucugacaguuuaucuguagauauuuuuagauuuucaauacaauccuaucugcaaauacuggccuuuuuguuccuuuccaagccuuguauguuuucuuuugauggcuaggaucuacauuacuguguugaagugguaguggguaucuuugucuuauuucuugucacauagaaaaguuguuccccuuuccucuucuccucccucuucuuggaugcuucagucccgaagacauuaggugggcagagcaagcugggauuccccaaagagacauggccuaguauguggugucugagccacagcagagugagcaaagcuucgugggaagggugucccugcacagggacucagccagagcagagugagaggggaucccugcacaugugggcagcccugugcggaauaccagagcucgaauaggguaaggaggauguucauuuggagauaaaggcacagcuuagagugugagagcccaaaucaggugagagggugccugugcagggugacccagcaugggauguaugagcccaaauaugauaaggagggguccacaaggagggugggcucauguggagcuugagcccaauuugggugagggcuccacaccgaggaggggaugacaguggcaguggugggagagugguuacauacggggagagagagagauguugaugaauaaguacuuaauugaucgaauacauacuuaaggauaaugggggccagguuuuaacuaucagagaagagaguuacaaauauaugaaagagagaagacagaauuaauccuguauuguuaaaauggaauuaaaaguucggguguaaaguguguguacacauguauuuuccccuggcccugucccugaaagggcucagaggagugauagcaccuagcacccccuucuuguuuucuaaauaccauucuccacuaaaaaagcuucuuggagaaauagcugaucuagagcugggacagagaaaguacaagaccagccuggaaugucacaugccagaaaggaaguaugugcucaaagaacgauuggacauguccaaagggcacaaaagccugugugaagggcccacacuggccaaaucuaggacaguuugagcaucauaauaaaugaugauacuaagugauuauaacccauugaauaaaguaggaauccaugaaccuacuuuuauguugauauaaaugaaagaaugaauugagugacugaaaguuuaacaggcuacuaacgcacuuucaaaguacccucccucccauacacacacauagucuuuuuuaauuacaaaggucagagagagagaauaacuuuaccauggaaaagacuucuugccuggcagucaccccuuuauucaagugaucaaagugaagcauaccugaugggaccaguugaaagaacacaacaucgcuucuggauauuccugccaaagauguguuagccgaaucugaucaugaggaaacaucagacaugcccgcaaucgagggauauucuauaaaacuugccuuuaaucuucaaaacugcuaaugacuaaaguuaaagacuaaggaacuauucuaaacaaaggagacuaaaaaguguaacagauggcucuaaacuggauacuuuugcuguaaaggacauuaguauuauuuugagacagagucuggcccuguuauccaaguuagaguacaguggcacuaucucggcucucugcaaccucugccuccgggguucaagcgaucucccaccucagccucacgaguagcuggaacuacaggcaugcaccaccacacccggcuaauuuuuguauuuuuuuagucaagaugggguuuugcuguuuuggccgggcuggccuugaacuccugaccucaagcgauccaccuggcucagccucccagagugcugggauuacaggcaugagccaucacucccagccuguaaaggauauuauuaaaggaguuggcaaaauuugaauguuguuugaggauuagaagguaauaauuuaucagugcuaaguuaccauuuuuugaugaucguaucacggucauauuugugaguguccauguuuauagaaaauguucaccaaaguauuugggguuguugguauaucagaucagcaguguacugucaaaugguucaagaaagauagauuucuggaaauacuuggaauuuuucuauaaauuugagauuguuucaaaauauaaauaaauuauacccuuaaaauagggaacccuuucgacauuucacuauuaaguaugguguuuacugagcuuuuaaucggauuaaggaagcuccuuuguauuccuauuuugcugugguggcuaaauauuacauuuuaucaaauaccuuuucaauauauacugaaauuuucagauaauuuggcuccuuuuaaaccagcuaacauggugaaugacuccauuccuuuccuaauguuaaauuaaccugggauuccugggauaaacccaaauuguuuaugauauauuaccuuuuuaauauguuguuggauuugauuucuuaauauuuuacuugggauuuuugccucuguaaucaugagugagauugguuuacauuuccuuucuccuauugucuuuuuggguuuugguaucuagauuaugucagccucauaaaauaaguaacauaauucuuucuuuuuuuuugagagagagucucacucuguugcccaagcuggagugcagcagcacaaucuuggcucgcugcagccuccaccucccggguucaagugauucuggugccucagcuucccaaguagcugggauuauaggcauaugcuaccacgcccagcuaauuuuuguauuuuuaguagagacaggguuucaccauguuggccaggcuggucuugaaauccuggccucaagugauccacccaccuuggccucccaaagugcugggauuacaggcaugagccacugugcccagccgaguuagauaauucucucuuuaaaacgcccuggaggagauuggagacauaguaugccagcagggcagugucacacauuucucuucagcagguguccucacagggacuaguugucuuuggcuccccacaugacagacgacugcucaaacgcaaaggaacgagaucacaucagcggcuaugggagccccccuggccuagaggccccaucucccagaaaggaaucaauaucguuucuaacaguuccaugggcugugcuuccagggaccguaggauaugcccagcuaggacccagggaagcucagagcuguagucuuuccaguccagauguagccuaaccaauuggggucauuuuuaccaucaguaguguugccuaauaacacaacugacauuuccacuuuuauuuauuuauuuuuauuuauuuauuuuuugagacagagucuugcucuguuacccaggcuggagugcaguggcacagucuuggcucacugcaaccucugccucccaggcuaaagcgauucuccugccucggccuccuugaguagcugggacuacaggcaaacgccaccaugcccagcuaauuuuuuguauuuuuaguagagauggggugucaccauguuggccaggcuggucuuggacuccugaccucaggugaucugccugccuuggccucacaaagugcugggauuacaggugugagccaccgugcccggccuauuucuacuuuuauugcauuuaugagggaacagagcuaaaaaguuaacucauggucaaauuuguccgaaagacagauugagagagagaaagaaaggauuuucuuaaaccagcgcucacaguaaguuacauguuucuaggaauuuccccauuucauuuaaaguuucagauuuauuggcauaaaauuauucauggugccuacuauuauaccuuaaacuuuuuuuuguaaaauauauacagaaaugcauuaauuauauguacaguccaauacaaaguaacuaucacccuuacaguccaguucaaugucagcauauuguuuauguccccaaaaacccucccuccuuucccuguccccuuguguauuuauuuuugacaguuugucugucauugaccuuuaaaaauucuuuguuggggcuggacacaguggauaaugccuguaauccuagcacuuugggaggcugaggugggaggauugcuugggcccaggaguuaaagagcagccugggcaacauaacaagaugcuaucucuaguuuucuaauaauuauaaaaauaaauguaaaaauaaaaauuauuuaugggaauaauuugagggcuaggaugacgcugccuucuccagagaagauucucauugcuucugcugugugcauggcacugaugccaacuugggacugucauuauccagguucaacgcuuaaagcucccuggauggccugagugauuguacaagggcugguaguuccugagaguauaguccuuuguguuccggcuuacuauguuuauguguuggggggugaagaaugauggcuuccuguuagauuucuaaccuuauacuaaaaaagcuuuagguuuuuaaauuuguucuuuuuaaaggcaggaucucacuguguggcuuaggcaagcaguggaguagugcaguggcaauucacagguacgaucauagcgcacugcagccucaaacaccugggcucaagcgagccccugccucagcaucuggaguagcugggacuacagaggcaccacugugcccagcuuagguuaagacuuucauuucuguuuccuacaucauuugagaguuugugaauaaaaaguucaaaauugcugcauuggaaaaugcacucaaggccagggcuccuggggagcaucauaggcauauucccuggggcacaugaguauaccaagugauguccugcuucagcacagcaccaaagcccugcaucagcgcauguggcugcaugcucuuucaucuugcuagauuccuaguuccccuuuaguuugcucugguuauuuauuccucacuguccugucggcucuucagaacauuaagguuuuaaaaauauuuuaaccuaucuuggcucuuugcagucuuagguuuggucuggggaaucuagcccaccauuauuggacguaggauguucucauuugauuuuuuuuuuuuuuuuuuuuuugagauggugucuggcucuguacccaggcuggagugcaguggugcaaucuuggcucacugcaacauuccccucccagcgaucuccucacaucauccuaccaaguagcugggaccacaaguggaugccaccacaccuggcuaaguuuuuguacuuuugguagagacaggauuucaccauguugcucaggcuggucucaaacuccugagcucuagugauccgccugccucugccucccaaagugcugggauuacaggugugagccaccacgccugaccuuguuugauuuuuuucaacagcgaugcugucucacucuuuugaaagugcaacacaguagccauaguuucuuuuucucccuucaaaugaaucuuuuccacccuuggagagguuggucccaguugugcugcucaucagagguguacauuacugugauaauggaguuuuccucuuuguuuuccaguuucuggaagaaaaucccgaucccucugccucugaaauucgggaggaauuagaacaauacacaacugaaauugugcagaacaaccuccuggggucccagggcgcacaugugaguuaacacugucuuucucccaugcuguuuugggcaucauuuuaucacuuucccucuguguuguccuuugcauauacuucuggcuucccaaaguagaccugaguuugcaucugagcucugucucuugugagaccugcaaccucacaaauuacacaacugucccugaguguccacuaucuaaucucuaaugccugccugcaggaccaaugagaggauuaugugacauaugauuucgguauagcauccagcaagccucuucuuaaaaaauggcagcaggucuuuuuuuccuucuccaacacuucucucuaacccacugcuaccuuauucuccccuucauauacugccuaaguauuaauuuguucaacgaaugaaugaauggguagauaauucaccugugauacuagucuuggaaucugcuucacuucaugccuugguuucacaccagagaugcugauuuaauuggucugggguaggguccaaguggaguuacaaaagcucccagaugauucccaucugcugccaggugcagagccacucauguggcuggacuguggaugugccuuccuuagaacccugagguccuucugaggcaggccagcugcauccagagggcuuccuuuuacaagugaaaguaacuagcacuuauugaguacuggcuguauuucaagcccccacugcauucaugauucuuugucuuaguaagagcuuacugaggugguuacuauucuuauucccauauuauaauugagaaacugaaggcuuaaagaagucacucaguaauugucagagcucaaguguauuaggguucuauggaagauuuuguuuaagaaaguggugguggggguguuuccgcugguuaaaaauaaaaggugaaaaccauaaaguaaauauauuggauucucuucaaaauggcacuccaagguucucugacuuuuuuuaaaaaaacagguaaagaacgugugugagagcaagagcaagcucauugcucucuucuggaaggcacauaugaaugcuaagcgcuguccccacugcaaguaaguaucagggcccuugcgccaggugagacgucucugggcagucacucauugcuauuauuaaauaucuuacuggguuuuuucucucuucaaucacaacuguccuccugcacaggaccgggcgauccguuguccgaaaggaacacaacagcaaguugacuaucacguuuccagccauggugcacaggacagcuggccagaaggacucugagccccugggugagcaggcugggucuggagaggagcuccaugugaggccagcagauguguccuaaacccugggaauaccugguucuccucaccacguguuucucugcugcauuugggaggggccagcagaggcacagugugcaggccucucaggccugaggggacccuggcaagcgcccagcucaggccucucacaugggagagcugaugggaggggcuguuuuaugaggcagugccccacaggcgccucuugccuuagguggucguuuuucugaaagguuuuucaggaagaaauuaagaaauuuaccugacaaauauuuugaaacauuuuacuguaaaacaaguguggaucuauuuuggaauaaaauguaggcgaauaauuuuuaagaaaaacugcaagaauucagcaaaacaugagcgccuccugcaggcuacuccuggcuguccacccagauccccccagguagaauucuuuccucagcucugcccuacccaagcucugcuugggaaaaauuuugagauaacuuaauacucccacuuuuuaauuuuuauagucauaggcuuauuuaaaaauguuuuuugguuuuuauucugaaguggucagaagauuaaauagaguauuccaagagaagcacugagagcgguaccugcuguguaauaugugcuauguaaauguuaacuguucauuucuuauuaugucaucaguguuccaggguagaaaaugcauaaccuggcugggcacgguagcucacaccuguaaucccaguacuuugggaggcugaggcaggcagaucacuugaggucuggaguucaagaccggccuggccaacguggugaaaccccaucucugcuaaaaacacaaaaauuagccaggcgugguggcgggcaccuguaaucucagcuacucaggaggcuagggcaggagaaucgcuugaacccaggaggcgcacucugcagugagcugagaucgugccaccgcacuccagucugggugacagagcaagacuccgucucagaaaaagaaagaaaaagcacaaccugcaauugucacuuggcucugccacuuuuucugaguggcagauagaaggcuguuuugaggcguuuccauuucuaacucuauauaauggcauuccuaaagccucuugccuagaauugaggaaguuacaugcauggcaguccauagcagauacuguuacuaaaccuuucaccaggguuugagaauaugggauaagcauggaaauaagauccccuccuggagaugcaugauguauguuuuacauugaacacucuggcauggccuggacuaaaugaaaaaccuguuuaauauuuuuuuaaaauguuauaguuuaggauaauuuuuagacuuaauagaagaguaguaaacauaguacagagaauuccuuaauacuguuuacuucauuugcccuacuguauaacauaguagauuaccauggugcauuugucaaaacugaguuuaacauuggugcaacacuauuaucuaaacuacagacuuuuuaaauuuugcugguuuuccaguaauuuccuuuuuaugcuccaggauccaacccaggauaccacacugcauuuagaaagccuuuuuaauuuuguuucaugguugguaguuaacacuguaagaguggauuuuccuacacuuaaccauuaaauugcccucaaaacaauuuucuuguauuaccaguugggaauugcuucuguagcccuuaggaugccuuauaaaauguucauagauugagaacaaagauggucagaauucuuucuagaagauaguuuucguggggcaaauguccggcagguaaguagccuuucaaugccuucaccaaacccauucuucuaaagucaucuuucauugcagccacgcaaauaugauggugcaaccaaaagucugugcauuagaaacaaguagaccauagucuucuacagcuccaggcuuggguauucaguauuuagcacacauuuauuuguugggugcucagcauuaugccaaggaccauguuugugaugagcacaaugccaggacacagaccagaccauguggucucugcucucugaaggggcugcaagugacacagaucaguaacccuggggagcaggugauguggaggaaagugagcagccucagcgugggucugaccauguuccugguaucagagggaaucaaaaagugagggcuaggcugggagugguggcucacgccuguaauccgagcacuucgggaggccgagucaggcggaucaucugaagucaggaggcaggcagaucaucugaggucaggaguucaagaccagccugaccaacauggugaaacccugucucuacuaaaaaaaaaaaaaauuagccgggugugguggcgcacgccuguaaucccagcuacucaggaggcugagacaggagaaucgcuugaacccaggaggcggagguugcagugagccgagauugugccauugcacuccagccugggcaacaagagcgaaaccccaucucaaagaaaaaaaaaaaagugagggcugugccugaguaguccccauggacuggugaucccacaaggagcgcugucagcuugugaaaugccacacgugcugcuccagugcgcucccugugcuccaugugccccccugagccccacaaggcacauuaacauuuaaaaugagaauucauauagccaagacacuuccagccauugugaucccagguuauuugaccucugaaucccuuuuuccuauggcaccucuuacagcugaaagaaagacacauucaagaugcucugaaaucccagcuaggcagaaggcauuguugcaagcugcagaaguucuuguuaggaggggaugcagcgcaugugaggagaugggcuuccacagcucucuucugacuuuaagauccugugauugaagaacagccucugccuucacggugacuaaacugcagugggggcauugcugggacaggagcugaggagauucgaccgaucuucuucagcauuuccaaccuauuuaguagaagagaaaguucagacacucauuuucagaaaugcccacaaaaugcagguuaauggggucuguuuucucccacugaacauauguagcuuucuaaugcugugguuaucccugaaggucaaggccauucuucauugcauacccaugcuuccuucaguugcguuaacucauugaaauauucugcuuuuaucgacaucaaaacuuuaaacaugcagacuccuugacuuagcaguucugcuuugaugacuuuauccuaaggaauuagaauacucacaguguuguuugaauaguguauaacuggacaugggccgggcacgguggcuuacacuuguaaucccagcgcuuugggaggcugaggcgggcggauugcaagaucaguagauccagaccauccuggcuaacacggugaaaccccgucucuacuaaaaauacaaaaaauuagcugggcguggugguggaugccuguagucccagcuacucgggaggcugaggcaggagaauggcgugaacccaggaggcagagcuugcagugagcgaagaucgugccacugcacuccagccuggucgacagagcaagucucugucucagaaaaaaagaaaauacuggacaugacuuaaauaccuauuaacagagacuacuuaaauuauggugcauuuguuaauuguucuccaaguuagggauuucucuaaaaacuuaugaugacauauccucugcagauuuuaaagaaacuagcuggagaauuggagguggaaugaagcuaguuuuuaaaaauggaggaggcugagguaggagaaucgcaugaaccugggaggcggagguugcagugagcugagaucgugccgcugcacuccagccugggugacgagcaagacuccgucuugaaaaaaaaaaaaaaaaaaaggaaaaggcaagagugguguuuuuaaguguagacuaucuuaggcuauuuuauauuugagccguauacucuuaacuuagaauuugcugugagcuagacacccugucaaguguuaggaacacagacaaggcauagugccuguccugauaugugaauaaaaaaggaacauugaguaaugcuuaguuucaguggauguauccagaaaagcuuuuugggguuuuuguuuuguuuuguuuuguguuuuuuuuuuugagacagggucucacuuugucauccaggcuggagugcagcgauacgaucucggcucccuacagccucugccucucagguucaagcgauucuccugucucagccucccuaguagcugggauuacagucauguccaguauuuucuuuuuuucugagacggagucucgcucuguugcccaggcuggagugcaguggcacaaucuccgcucacugcaagcuccgccuccuggguucacgccauucuccugccucagccucccgaguaggugggacuacaggcguccaccaccaugcccggcuaauuuuuguauuuuucauagggacacgguuucccuguguuggccaggcuggucucaaacuccucaggugaucugccugccuuggccucccaaagugcccagaaaguuuugaaccugaaagacacacuacuuacuugucuuagguaaucaucuuaaaugccuggucccuaccuccugaauggcagucccaagccucguuuucucauguaaccuggguauugcugguagauggcaucccagagugaucuugcuuagugugagaaaccaagcccaaucuauuccucacacaccaguaugauauuuguaaaaagaagucaguauauauuuaccuauaaaaauacuuauuuauccauaauucaacuuauaugaacuuuucugguaaaaaacagguagauaaagauauuuauuauaauguuacuuauaauagcaaaauauggaaaucaauccagauguccaauuaugagaauaugguuaagugaauuaggaaucauccuuaauggaauaucacauagccaugaaaaauggugaucaggcaaaagcuacauagcaacaugcagacaugcugaugagaugauacuaaaagggcaaaguagugugcaaaauaaauccacacugaagauuacaguuguguaaaauacguguauagacaaaaaggccuggaaaacaauauauaaaagugauaggaguuguuaaugugaugggauuauggguaauguuuucuuuuacuuugcuuuuuuuuuuuuuuagguuuuauacaauagccauaugguuuuuauuacuauagaaaugagauuaagggccagagggaauccaggccugauaauaugcuacccuugagauugauuuuuguggucaaguugcaggcuuggggauaaagaauugauaaaucccauugcagaaagaguaccuguuucugauuuauugcacuuugauucuccuccuuggcuccaggaauugaggaagcucagauaggaaaacgaggauacuuaacacccaccagugcccgcgaacaccuuucugcccuguggaagaaugaaggugcuguaucaggcuaaagaaauagccuugaucuucucuaggcuuuuauuuccuggacucauuaacccugccuuauuacuucuuuuaaguuguagugauuguagcuuccuccuggaacugauccagagguuuggggcagucuucagggcacauugacauugagucauagagcaggagaggucauacccagcaccaaaaacuugacaauuaucgcagcugagccugguuaugaaaugacaacugcaggugggccucacuuaauacagguuggcauauuuuuagaagguucaguguaacuuauuuuaaaugcccguaaguaaaaugcuuuguccuucugugaaucaaagaaugaacucugucuuauuuaaauugggacuuuacuauaagggaaauccuucuuuccuuuugaguguauaacaaaaccuacgcaguauauucaagcccuugugagaguauguuguggaacgcugacuauaaccucuguguaauaagcgcuuacaaaugaacauguuguuaaagagguaucagaaaaaaaaaaaagcacuggaguuaguaugauugcuucuguggcaggcccuaguacauuuuaaucuuuuucucuaggcauuuuuuaaaguaaccagaaaccugaaauaaagcuuugauccacagaagauccuuucuuggcaguaacuguuaggggugggaggaggcuaacuuaaaaaaaaauuuuuuuauucaacauauuuuuuaugaagaucaaaguaaugaugugugugcugucuguguuuuaauaguccaggagggugauuaaaaacaagugaaguuucuuccccauccuugcccaucucagucccugguuuaagagcuauugucccuguaguacccauuuuuaugcuaucauauccccugcauacaaacugucauguacacaggggcuauuuuuuguuuuuauaaagaaaaaugaggccaggcacguuggcucaugccuccaaucacagcaauaugggaggcugaggcagguggaucaauugagcccaggaguucgagaccagccugggcaaccaagcaaaaccucaucucuuaaaaaaaaaaauacaaaaauuagcuggacaugauagcacgcaccuguagucccaacuacuuggaaggcugagguggcaggauugccuaagccugggagaucaaggcugcagugagucaugaucgcaccacugcacagcagccugggcgacaggagugagaccuuuucucaaaaaagaaaacugugaccuuaacucuacauauuaucuuguauucuguuuuuuccucacucaguaauauuuuuaugguuguccucccaugcccuuagugauagauuuaaauggucuucuugguuuauuucuuuccaacgcaggauucuuucugaacuaccuuuuuucgggaauggaugaugaugguauggaauccagauucaaucccaguguguucuuucuagauuucuugguggugccgcccucaagguaauacccuuuaauuaacuuauuucaccugaaaaaaagcguacuaaggaacugaaaugugaccucuaggagaggugaaagggccaagggcacugagagacaaagcugcaguuccgcuccaggugcagguggugggagggcuugcuuuccuucccguuuguugugaacgcaauaggaauguugguuguuuuuguuuguuuguuuugaaguggagucuugcacugucucccaggcuggagugcaguggcaugaccuugacuuacugcaaccucugccuccuggguucaagugauucuccuaccucagccuccugaguagcugggauuacaggcacgcaccaccacacccaaauaauuuuuguauuuuacauagagaugggguuucaccauguuggccaggcuggucucgaacuccugaccuccagugauccaccugccauggcuucccaaaguacugggauuacaggcuuaagccaccacacccagccggaauguugguuaggaagguugguuguuuugagcaugguggggugugcucccuacaguaggcaugggugagaggcugaagaacaugacccuuuccucacacuaaacauucauuuauuccguaugucccccugcagguaucgcccagucagucgccuaggagaccagauguuuacuaauggccagacggugaacuugcaggcugucaugaaggauguaguucugauucgaaaacuucuggcauugauggcccaagaacagaaguugccagaggaaguggccacacccacuacagaugaggucagggcugcucuguugcugaugugaugagcacacaugcuuagugcuaacucugugagcuguggauguagacacugggucugggagaugcuuccugggauguucugugcagcuggcagcagccuuagugugagcucugggcuuagggggcaccuaggaacauuagggggacacacaugggucugagcauggaaagguguggguucuggucuagcuucuacaccgaacgaccaugccaggugacccuaguugagucacuuccuuauacuagugucugcuauaaagugcaugugauuuguggugagauuucacaccuaggcuguuccgggcuaccagcucucgcagcucuagaaagaauagccuacuucccucaggcuuuaagagugucccuuuugggucacaguacuagagcucauguugccagcucuauuuuggacacguuaaugucuccagcauuggggucaggaaggcaguauugcagaguggaaauuccucucagaauaggacaguuucaacuaacauuuccugagccccaucugugugccggguuaauuaguagguguucaguggguacaaaggugaauugggcacccaggaagcuugcugaggucaucaagauccuucccagcucuaaaguacucucuggaugcaaauaggcagccuuggguagacaguccggguucucagacuccagccgcugcgacagucccgcugucugccaggcccaucacaagguggcgccacugucucuuggacacuuauggugcagguuacacuuggggcuuucugugguuuugcuuguuuccugaucggcccgcauuggugugcuuuuaaaaacuccuuaguguaaaagacaucagccaugugcaugccuuagugcaguuuccaagaaaagaccaugggauaacuguacccagugaccaggguugaugucccuuaaaaaucgggcagccuggccaggcaugauagcucaagccuguaaucccagcacuuugggaggcugaggcaggagguucacuugagcccaggaguuuuagaccaggugggcaacauggcgaaacccugucucuaccaaaaauacaaaaaauagcugggcauggugguucaugccuauggugccagcuacucagggggcugaggugggaggaucacuggagccagggaagucgaggcugcagagagcugugaucgcaccacugcccuccagccuggguaacagaguuagaccccaucucaauaauuaaaaaaaaaagaaaaauuggucguccccuuugucaaacaaaugcuucgccucugaggggcaaauagcauccucugauuccuaugucccacugcccucuuuccuugugauugacaggauguguuuuuucuccccccuuacucucuguguuccauccucauggcagcccuugccagucaccgucuaggcauuggggauacuccagugagacaaguucucacucauuucacaaucacuggucuugagccagguaaugccaugagcagugaguugggcuaacagggcccggucaucaugcaggugaucguaucucccucugggacuccagccagaaggggacccugaguguuuuauguagaauacaucuauuuucccuagagcuaaagaagauuccuguguuccucagguuugaugacaagcccacuucaucacuacuggguuuucauaacauucucguuuacugaaucuucacccacccucacccucccaccucaagacacugacagguuucuucucuuaucugcccacacuggaagacgugggaccaucugucuccuugugucauacccagucgauugggccaguagguggccagacaguaucaauagguggugcucuaagccagcugaaggcuucuguguauuucuguccccuggguagggagugggagagaggaggagacagggcuaggggcaaaaauauuaaaaaaggauugguuaaauauuccaaugagacuuggcaaucagccacuaacuugauauagcucagcuggagacccacaucuuaguugaugacauagaauaucguauggcaaaccuaguuccuuuuaagaaauuguuccaccugcauguuuguaauugguuuggaucaaguuuuucaaagccauaaauaaaacugaaacugcaugugagaauugguuaucuggcaagauaacagaacuucauaagaaauguacugaugugggaaggacuucuuaguuuucuuuaggaauugcauauuaagggauuucagcaaaaaugccuuaagaaagaagcaugcuuauaaauuuugaguucaucuuacuacuagaaagagacaggcugguaaauauauaauagugcugauaugucuuauugacauguacuuacaagauugauuuauuagcauguuugucucugaucugucagguucagaggagauaaacuccagagugcauaguugucagauccaggguaagaaagaaaaauuaaaucaagccaggccuuuuggagcuuuuuuccaucaucccuguuuucuugguuucaucuuccaggaaaaagacucuuugauugcuauugaccgauccuuuuugaguacacuuccaggccagucccucauagacaaacuuuacaacauuuggauucgccuucagagccacgucaauauuguguuugauagcgagauggacaaacuaaugauggacaaguacccaggcauuaggcaggugagcaaaaaacuggauucccauugcuagcuacagaagauaaauaauaaacauuguguauugaaacaagaaacuaauaagccuacuggaauucuuguugaauguuuuuuaugaccuuuuuucuccauaaagauccuggagaagaaagaaggccuguuccgaaaacacaugaugggaaagcgaguggacuacgcugcgcgcucagucaucugcccagacauguacaucaacaccaacgaaauuggaauucccauggugugugugugugugugugugugugugugugugugugugugugugugcgcgcgcgcgugcagggcucauuugcuccccguggguggcagaugagaaugccgcagaggacuggggacaggaugugcagcagauuauucuggcuugggcggaacuagcuucugccucuuccuggacagcccacaaggaggugacuggaagcugcaugauggcauugcugucacuccuugcuaggcuuacagacaccuccuaccaacaagucagcaccagggagcugacugcaggguguuccacauccccgccggcauagcuuccuccugcccacuucagccuagucuuuugaccuuccucaccaaauugaauacaugacaggggagaggaagagggcauggggcauaucaguuaucaguccuguguacuuuccaggcaucagaaauguguaccccagguuacugggaagaggaaagggagugagucccggagagaggcgugugcauguugcccagguccuguuucgcuucucagggucagcagcuugcuguucaccuguuagugcucuccccccgacccccuccgggagcuagcuucgucuucucacauccuuagcacuucaugcuguggugcucagcagcagcagccuuuaaucggcuuccuccuuaaugggccggccucuaugucaguaaugugaaggugguuuaauuucccuccguggagagccucauuuccuugcacgccacccccuccaccccucucuggggacuggugaugagcagcgcugaaguguucuuucugaucauccuguguccccauggccucaucucuuuguggcacacuuggguuuccuggacaaaggcgugaugugucaggagacagcagucugagaaggcccaguccuguacccacugccucuugggaaccauaguccuugcauucaaaggcuggaucauguggugaggaccagcuuugcaaaguccaguggugacauucccaaaucugaggucccgaggagacauguagcaacuuuugguugcccucucuggacagggcaggggccacccuuguuggccuugacuucauagugccuacaguguccccagcucugugagagaccuuuugugcugccuuuucuaucuucuaggugcuggguucucuuucuuagaucuggguuuguuugguaguggcuugucccuggaggagagaccccgaagucacuucucugcccaccugcagacugcugcaagucucagggccaugguggccuggggcguagguauuccucacaggauagcugggaagauuagaguggauagaacugccucuggccccuuggaucacacacuucccauagagcacuguugacaggugccacaggagcaaggagcuggagaccagcagugaagcacagacuaaugugcucccauauaaagcaguguccagggguggagacagacaguaaauagauagacaaguauauguaugcucuguugaacggugaugggugguaagugcaucagcaacaguagagcaggcucaggcugaggaacgcagaggcugggguagccccaggagccuucugagaaaguguugcugcgcgggaccuguacaaagcuagacaaguuccuuuauguaggacaucucagagccucugguguauuuguguacauuuggaagcauuagagguuuauaauauucaguagcucaaaaacucauuuaacagggaacuuguuuuacuuggagcguaucccaggcccagcuuuaaacacagcacacugcauuuucuuagguaucagaggaaugcgucaguuucaucucaaguaccaccuugauuguaauggcugccagaacuguggaguugagauauuccgaugccaugucugggcucagggacagcaccaugaugcauuagugaugucugccaggguagaugagggaugucaggguauuugaggacaggcauuugccaccugucucaaggaagugccccaugccaccuuugggaacuuugaauuuauuggcagauaagaaaaugaaguuuuagacugggugaaaaaauuggcugggcgcgguggcucacgccuguaaucccagcacuuugggaggccgaggcgggcagaucagcugagguugggaguuugcuaccagccugaccagcauggagaaacccugucucuacuaaaaauacaaaauuagccaggugugguagugugugccuguaaucccaguuacucgggaggcugaggcaggagaauugcuugaacccaggaggcggagauuguggugagccgagaucgcgccauugcacuccagccugggcaacaagagcgaaacuccaucucaaagaaaaaaaaauuauauaaacugcugcgcuuaaauuauucuccucagacuaacugguagaaaaggaggccuagucucuauaccauuaagggaguagcagaagacaggcaggauguuacuuugcucacuggaagaccuucuuggccaagucaaacagcuccuccacaucuugggugaaaagacagccuguugagacagauuugggguccaucagaccuuuuuuuaucccugcccugaauuucuaccuccauuccucauuuccagguguuugccacaaaacugaccuacccacagccaguuaccccauggaauguucaggaacuuaggcaagcggucaucaacggcccuaaugugcacccaggagccuccauggucaucaaugaggacggcagccgcacagcccugagcgcuguggacaugacccagcgagaggccguggccaagcagcuucugaccccagccacgggggcaccuaagccccaggggacaaaaauugugaguaagggcagcuuuggucagggacccauccggcuccuguucggauucuggugauugguggccaucagguguggcuccggugcgcacugacacaggagcccaucccuaggaggaagcuccccgacacguggguggcuuuuuagauucaccuuguagucuccgggcagaagaauggcugcccuuaaacaggacuacucaaagggcaguccccagaccagcaucagcagcagcccuggagcuugugagcaaugcacauccccccaccucuacugaauuugaaucucugagaauagaguucagaaucuuucuuuaccgugcuuuccaggggguucuucugcaugcugauguuugagagccacucuuaggaagggagugcucugugccagugauaaccaacaaauaacagguuauaacuaauguuuccauuuugggcaauugcuaaugcuagcccauagugcugugguagggaauccugaggcucuaucagguuccacuggaaggagcacaugaucgauuaacaauguugcugagugcaugaaaucagcaggugacagcucuguggcucugucacauaauagccauuccugcugggaggggaguagcagaugaccccuaacuaggcaacaguggcagcaguuguuggagggaaauggauucgacuuggauguaacccacaagugacuaccggagucaauaggugacugccuggauuuuccucacccaccugcacagagggccucuccuugcccucugcccacccauacccauggcugaccugcccuucuuuaacacugaguucaccucugcaaaguugcaucagccuugaaggaacuuuggaggaaccgagaggaaaaggaaaugcuccuggccuugcggcggugcccaucacugcucaucacaggccuucuugcuuccucucguucucaccgccguccugaggggcagcaguaauacacugccuguauuacuguauucuccuuuggugacagggcacaugcaaacauagaucaagucaccucuuuuguucuucucuagugcacgaaguaagguuuguauucagguucguagaaucggucugccuuuccuaagugccugguguuucgcuaggcacugugugagcaaugcaaaaagaagcaagguguguuucacuucacuuacauuuaacucaggucaaacaugugaaacagacucacaauaggaaaggaugagaaagagacuaggagaaggggugagggaugaggcaguacugaugcccccugcaugcuagcacuuugcagucccugcagacggauccucgccacccuggaguugacagcauggugggggaaccacuaggaaguaagcauauaaauguauugcuguugcggaggggugugguagacaccauagggaacagcagugacagacagugacuuuaagcacauaauguccaagaagaaacaaguuugaggggaaugugcagggcaagugggcagggagaguuuggggucaucaggaggcaacugugagccaggugcuggggccagccucagggcuaaagaggggacugaaggcagcgaauucuugcugcucucucaggccuuagcaagcccucauuccucuggggucagauaguaaauauuucugugguccugggccaugcaggcucugcuguagcugcucagcucugccaccuaauaccaaagcagccacagguaguacacaaacaaauaggcauggcuguguuccaaucaaacuuuauuuacagaagcagguggccagccugaggacuguagucugcuacccaccaaaaccugucauuuuuuuuuuuuuuauuuuauuuuuuuuugagacaaggucucgcucugucucccaggcuaaagugcagugguauaaucacagcuugcuucagccuccaccuccugggcucaggugauccuucugacucagccucccgaguagcugggaccacagguguggcuaguuuguguauuuucuguagacaugggguuucaccauguugccaaggaugguuuccaacuccuaggcccaagagaucugcccuccucagccucccgaaguucugggauuacaggcaugagccacugcuccuggccuguaauuuuugaagacuuugguuaauguguugcauaugggucagggcaaggcugaaggggcugugugagguugaugggaaggaaacacugaggucucguccggggaggaaccacaggcuaggugaggaggggaaaggccaaaaggacccauuuccucuaugaaguaugaaagcucugccccauccccugggccuuguaaauaaaagaggaaauggcccggagagccaaggcucauugcccugcucagcagccugccagaagcaggccuuuggcuccgagccugccucugaaaauucugacccuggggcacuggggcacgcuaauuuucacugcaguauuuauuuagagacaagagaaaggaagggccuuggguuuggguuggcaaggggaauacccugugcuccagggcuucuguuuggauuggccggugccuaccagacuggccuguguaccuucccagcuguggcgaguuugcuuacgcuggaggaugucucaaauuugcaagacucaaauccuaggcccagccuggcuuauugggcuugggccacaggucuaggcaguuucucccuugagaggcuaaagcaagaagaccucagcuuguaugacgcagucagacagcagccagugcccugggcagaugcucaugggaacccucagaguuuaggucuccuuggaaacaugggacuuggcaauggggaggggaagguuugaauuccuucgggagcaaaaagacggacuccaugcuagguacuuuuaagauugcuuuguagcacuugaggguuuugcucccugcuucucugagcuagagagagaaaacuuuuaaccucacugaacaggaaucggggagagaguuuuggggaguaucucuuaauuacuucuagccucucucuuuaaugaacuuucuaaugcaguuucauaaaugugggcaacauaagaagaaacuagacuuccaauaauuuguuguuuucuccugccugcuaucuguugugauuuagaggagauuugggguggcagagauuucaccaagucuucauaauuccuuuguacuacuuagaggagcccuucaggaugcaugggguggcaguuaccuucauacauuugucuuuuaaggugucacuuuauguucaguguuuaggaggcccaguaguuaauauaauuaaagauaagggugguaagugucuuaauaggcgguacaggaaagucagcuuugugagagagaugucugucagaaggacaugaccagccagauauuuauaaggggggaaaaguaugagcagugguuaucuuagagggguacaauuacuugugauuuuuaaauucuuaucuuuaaauuguauuuucuguuuucccucuagcaaugagcauagcacuuguucaauauuucuuucuuuaaaaauaagugaagaccuuuuuuaaaauuuacagaagcaucacauacucauuauaggaagaacgaugcuaagauguaggaaaguagcugaguguggugacucaugccuguaauuccagcacuuugggaggccaaggcgggaagaucguuugaggcuagaagguugaagcugcagugagccaugauuguaccacuauacuccagccuggcaacagagagagacccugucucagaaaaauaguacagccuagugaggauccaaccaccccuuucccauagacacacacacacacacacacacacacacacacaugcacacggagagagagagaagcuggguugguuuuuaaauuguuuuuuuuuuucaucaugucacaugccaccuggguuuuuuuuuucuuugcuguaauacauuauugcuaucacuuuaggccuuguauacauuuaccuuauccuuguucaucacugcauaauauuccauaguguggauacacuauugccccuucuauggggcagucagguuauuucuaguuuuugccgcuguaaaugcugcuacacaaacauacauacucaucuaaccuugugugggugcuuuuuuuuuucuugaagagccaacagaaaauguguuuuaaguguuuuaauugcuauuuucaaacucuguucccaaaagacuaugacaauuuacagcucuuaauuuuugaagugcaauaaaguguucucugagggcauugaacuaacuaagaacccuuuucuggcucugcuauaugaagcugggcaaacuuuuugugaaauguagaauuucuguuuagaauaauguacucacaugugaucacggcgggggggggauucgaaagucugccaaugccuuucaaacccagugguuuuaugguuaugucuucauuuuguuaugguuauaucuucaggaguuguauccauuucuuucuuuggauuaguuuucagaguaauccagaaaccugggacggcuaugcaucucugaagaagacaaagaccuguggucuuauuuguuccuuauacuucugagccuagagccaggaucaggguuguaaagggccaggaccagaagggccuaggacguauuucucagagauuuccaggguuuugcuccagaugaaaaauuccccuugcauuuaguuaacuagaacgugagacaaaagccacaccuuggucaagcugaggugagcacuuggaaagagccguggugauacugacguuugcacugaucacccaccuguccacucuguucccaggugugccggcaugugaagaauggggacauucugcuacugaaccgacagcccacacugcacagacccuccauccaggcccaccgugcccgcauccugccugaagagaaagugcugcggcuccacuaugccaacugcaaggccuauaaugccgacuuugauggagacgagaugaaugcccauuucccccagagugagcugggccgggccgaggccuacguccuggccugcacugaucagcaguaccuuguucccaagguaggucuggccuugaggcuguuccguggucaucgucagcaugacuuagcacuuuuaaguugggcccugccagccccuggggucauugggcagcuccaggacaggggcgccuggaauggaggguccugguuucucccagguggggcuuuuagcccaucuaguggcuuagaggcugggaaauguuucuguuuugcugcguuguaaaauguaaaucaggacagaaauugugauagccaucccagaaagccaaccuuaauaacugugugauaggucuuguguucagcacuuaaauuuggauucugcaacuuaguagcccccggcuagcauuagcaucccaacacuguaaugguucucaugguccacugaugacuuugauccuuuguucugacaaacaugaguuuuaagaagcagccuaaccccaagggcccagaagagaucccgcagcagcccgugaaggcaucuucuguccccuuugaauccuuuccuucuuucuccaaguucacuccucaagggcaaccccuuguggucacagcuguccagagggacacgagggaaggauagaacuuccucccccgucuccuuagcagcugacucuuggccaggaguggcaggggccugaguuagcaugugcucaugggagggacagagcggggaaagaggcaggcugcaggaaagaagacagaguguguuccagugccuccuucacccucaccacccacccaaaggucugaguccuccuaaauuauaagccauuugcgccacaaugauucauaguuauacaucauucauuuggauugugguggaguaugaagaauaaucguaacgucaaaccaaggcucccauuucccaaguacuuuuucagugccauacacugugcagagagcacuuuagaggcuccucauuucacccuccccacaguccuuggagguaggugcuauucauguccacauuuuacacuugaaggauucguguaacuuguccaaggacacucagcugagaagcagcaggaaggacaaggaguuccuggaucuuccuaggguuugugcuaccacagagauggagaccucugugcacagggagugccaggggcugcucagagaugccuagugucaaucagcauccucugcuccuuggagcuucucuauucccaucagccgucugccacgaaggaaucaggcagguggccaggagcccggcaucccggacccuuuucccaccagaugcaccacuguggcuucacaagggucccgguuguuugaguuggccuuucccuucucugcccaccuuuguuggcuguggauuagcaaagggacuaaauguaggaagaaguggugaagggccuacccagauuacuuggaaauuaaaaaaaauacauuugcuaauuugaaaaguggcuuuuuauguuuucauuuaaauaauaauguggcucuguggugguggcaguaaaagcugccauuuauuaagugggucacaggccuuaggcacugcuguaagcaguuugcagacauucccuuccuuaugagguuggugugauuuucagacaaggaaacaccaagugaguaauaugucagccagcaaugaggccaagacuugaacccagcagcuuuggacgacacccgccccccccccccgcccaugugcuuggcugugcguguucuuagccccacucgacagccaaggcugggacuaagggaaggcaggugacaggaaguggcugccagaacugugugggucucugacucuauagcagccgagucauauuucaccagaggggacacuaccggggagcagcagaugguuuuuugcuggcagagugaccugaggcauuagcuauguggggaguugaggugcucugaaguccucagaccagugaccuugaaugugcugugcuugauuuugauugaauacggugcaaagccauaggagacuucaugcuuacauuguguccugcagugggcugacauauaaauccaaguggaccucaucacaugcuaauaugccuaugaguuuuagguugggcguacacuuaagggaggcaggagaacacagguaaauaaacuuaaugucaauaaauuaauuuauugaaaaaagcuuaugggagauggcuugaagauucacuguacuuucauucacuuucuuuugucggagguaaagagcuuuugauucuugauaaauuuuauuuaguccuugguguaaaugccaagaaguggaauccuuauauuugcuaaugguuauaaaaaugcaacaugucuuuauuggcagaguccuaaaaggacaagagcugauuugguuaaacuaggaaaaccaguauuuugagguaauuuuucuuagcauaucuuuauuucccuuaguuuccauauuucuuuauuuauaauucaauuucuucucuauuaccagguuaucuuccuuaaguaaccauaauacugaauuaaaguacauuuugucguugguuuuauguacuuaguagaguuuuguggcgucuuuuuacuuaaaauaggaguugaauggaacucauuucuuuuccaugaaaacaguuaaacuuuucauuuauguguuacuuuuuggacuaauuuuuuuuccuucuguuuauuuauugagggcccauacuuuguggaaaguuuuuaagcaaggcuucagauauguuuccugacuucuacuuagucagcuagaaaauucaaguuacagggauacccuauucacaaagcauccuaaccagagacauuaauuguaaugucauuuugcuauuaaggagaauaguaaagcugacaauugucugggguuuugauucagagguguucuuucugauccuaagcaggaguuaggaaauuuagaauuauaaguagaccuuuaguaauugcuuuaaucagcauucugccauagaauuugugaugauugcauugaaaaugauuuagccaucaaaguaauugucuagucauggaaaaaucuggacagagagaggaaaaggcacugaauagaucacagaaccuguaauuauguucuuuaaggaaaaaaacaaaaggaaaaaucaguaucugccccccaaagacugugagaugagucaaaugcauaauacugguuuggguuuuucccccaagcaaaauaagaccaucuaggcaacaagagguagaguauaauuuuuuuauguacauuauuaagugaaagccuucauaagaggggcugugugcuccaucugaucuugccuuaggucugugccaccuuuccagcccaucuguaaucguuaucuuugaguuuacauagagcccaucacuguaguguuuagaccauuugacaaggauccuuuuuuagccuuugaguuaguacauaugguuaaauuucuggugcuucucccagacugcauuugugaguucccuuagccuuaguuauaaaacaugaccauacuguuggcuaguauuuaacaaauaaucaaaugauuaauaaucuuuauauccaaggcacagguuuuucucaaauuccuauaaacauugaaaaguuuacaaaaucuacaucuuaaagaacgucagugagcauagcuauuuuuacuucagcgugcguuauguugccgugaacacagacccgacagauaagguucaggagacuggggaucagaauggcugugaaagugucaaaugaaauuaaugcacucaccaaaucucaggcuuuucauaaaagccuuucuuuuuggcaucugguagauaacagccuuuauuaagggcccaccaugaacccugugcuguguugugaagagauaacuaauaauggcuauucucccuucugcagucaugcacaucaggcccacucacagcucucuugaggaaccugugccggaaccccuuccucccaacacuggccagcucaccccucaggccucaacugugaaacugcccuucggagaggcuauuucugaccaucccccucaccucaagucuauauuaugacccacccuguuauuuuccucuuuggcauuuaaaacacuuugugauauuguauuuauccaaucauuuguuuacugucuaguucuucuucaucauaaaggaccaugucuguuugguccccuggaguagggaaaagccuacccagugccuaggcauucaggaggcuccugauaaauauuuguugagugcaugacugauuuacagaagagccaggccagaaacgugugaaaaauacuaaagcauaaaaccaaaguauaaaaacaagaacacagcugacagcagccagaccaaauuuaggcauaaaugccaaaaauaugcuggaguaacuagaaccagaugggauuaaacagagaaggccgggggaacgggaugaguuugaagcagucuugauauaggauagugggcaaauggcaaacguagaagccagugcuaaacccuggucaugugcuuugggaagcaguuggcucccaagcaagaacauagugaggaugugggcaagacaagacagggauauaagaagggcucuugauagaaaguggcuuccaggcaggcgauuagggauuagaguuugacuuaagauuuauuuucauucuucuuguguugucuguuuuggcuuauaggauggccaaccauuggcgggacugauccaggaucacaugguuucaggggcaagcaugacuacucgggguugcuuuuucacccgggagcacuauauggagcugguguaccgaggacucacggacaaaguggggcgcgugaagcuccuuucuccuuccauccugaagcccuuuccgcuguggacaggaaaacagguaauugggagagaacagccaguguauguaacaaaaggaaauaggccacucauguaaaagguuuuauucucagaagaguccagaccagagacagagaaauggcuaagccagcaauagucugacuuucuuuccccuuuguuugggguuccugagucuggguggcuucaagggagugucuagcaagaguagacugcauaguagccuggugcaguggcucacaccuguaaucccaacacuuuaggagacugaggcgggcagaucaccugaggucuggaguuugagaccagccuggcuaacauggugaaacccuaucucuacuaaaaguacaaaauuagcugggcgugggauuagugccuguaaucucagcuaccgggaggcugaggcaagagaaucgccucagccugaggcaagagaaucgcuugaacccaggagguggagguuguagugagucaggaucagccacugcacuccugccugggcaacagagugagacuccgucuccacaaaaaaaaaaaaaguagacugcauaguuucuguccuuugcuucuaacuuaaauuugguguccucauaauacaaauauggugguaauaggcaguggugcugguggaguaauaguaauauuuguugggaaguuccauauguuugcugagugcuuuagacacauuaucugauuuaauacucacgacuaaucugcaaugcagacaccauuauuaucuccauuuaggagaugauaaauuacaugcccaagacuacaggagacagaucaaacccaggacuuuucaaccccagaagcaucauaccauacuuccucucaaaguaaccaaauuacaugauauguggcgaccaaauaaugaaaaacaguaaaauauguucuucugcuguugccugaguauccaaguucagccuuaaggaucaacuucuaauuggcuaugugaucuuagcccugugugucucaguuccucaucauuuccugggacaguagaaauuaacuugcuaagcuaaguucugauucuaaacaugguuuuucucuuugaaaccagacuaacccacaaacaaauucuugcauaguguagucacucuugcccuuuucaccuguuggcaaaaaaaaagcccguaccaaccuuuagagacacacuaaaaaaucucacccgugacagaagcaaaaccuggaccuauuuccuaauuuuauuugguacagaggauuuuaaaaggauucaagauguggccucugggcauaauggaauuuggaaaucagcaaccaagauauuuggaaaagcccucaauauuuguacuucuaaauaacguacuucuuaaauagcucaugggucaaaagaaucuaaagggaaauuagaaagcauucugaaguagaugaaaugaaaacacaacaaaauuugugggaugccacugaagcagaacuuaagggggaaauuuauacauaaaaugccuagguugaaaagaagaaaaagggucccaaaucaaugacuucagcuucaaguucaugaucucuaaggucucuuccugcucuccaguucuuagucuguggaccuggaacuugauuuuccuuuuuaagccaaccuugcauuccuggauaaaccuuccuuggucgugagguauuauccuuuuuauauauuauugaauucaauuugcuaauauuuugucuagaauuuuuuuacuucuguguuugugauagauauuggucuguaguuuuauuuucuuauaauauguuuguuugguuuugguaucaggguaauccuggccucacagaaugagguguuaggagguauuuccucugguuuucuguaagaguuuguguaguacaguauucauauuauuuauuccuuaaauguguuguagaauucaccagugaaggcaucugggccuagaguuucuuuguggcaagguuuucuuucuuuuuuuuuuuuuuuuuuuuuuuuuuugagauggaguuuugcucuugcugcccaggcuggaaugcaauggugugauccuggcucaccgcaaccuccaccucccagauucaagcaauucuccugccucagccucccaaguagcugggauuacaagcaugcgccaccaugcccggcuaauuuuguauuuuuaguagagaugggguuucuccauguuggucaggcugggcucgaacucccaaccucaggugauccaccaaccuuggccucccaaagugcugggacuacaggccugagccaccgcgcccaaccugugggaagauuuucaauuaaaauuucuauuucuuuaguagacauagagcuauuuuugguuaucuacuucuugaaugagcuuuaauuguuuguguuuuucagggaauuuguccauuucaucuaaguuacugaauuuauaggcacaaaguuguucauaaugcuccuuuguugaccuuuucuaucuguauugccuguaguggugucacuucucucauuccugacauugauaauuugugucuucucuuuuuuccugaucaguuugccuagagguuuaucaguuuuauucucaaaaaaaagucuuugguuuuauugacuuuauuuuucuguuuucuguuucguugauuugaacuuuaucacucccuuucuucuguuuacuuugguuuaauuugcucuuuuuuuuuuccuaguucuuuaaguucuuuaagucaauuugagaccccuuuucuucuuucaauguaggcauuuuauguauaaauuucccccuuaaguucugcuuaaguagcaucccacaaauuaauauguuguguuuucauuucaucuacuucagaauacuuucuaauuucccuuuugauuuuuuuuuucaauccaugaguuauuuagaaguauguuguucaguuauuuagaaguacaaauauugagggcuuuuccaaauaucucgauuguugauuuccgguuuaauuucauugugccuagagacugcaccuuggauccuuuucaaauccuuuguaccaaauaaaauugggaaauaggcccagguuuugcuucugucaugggugaaguuuuucauuguaucucuaaagguugguacaggcuuuuuuauuuugcaaauaggugaaaagggcaagagugacuacacuacacaagaauuuguucaugguucagccuggugcuacagagaaaaaccauguuuagaaucagaagauaaggaacuuagcuuaggaaguuuauuucuacugcccugggaaaugaagucuuagaguguuucuccaggucauuucauacagccucuugauugauuuucuauuuacaaaccgaaggucucucauuauuuguucaaagagcaugcaaagaaagagauuugccugucauugcaaaucucgaguuuauaacucagugcacauucacaaagugaauacaucuuugcaaacucucacccagaucagaaaguagcauaucaccagcacccccagaagaccccuccacggccccucccaguuucuaccccucgucaaagguaauuacuaacuugacuuccaacacuauaaacaaguuuugucuuuccuugaaguuuauuuaaaugaaaucuaucuuuguguguuacccauguuauuguauauaguagcaguuuauuuuuuauugcuuuauaauguucuauuaugugaauaugccaucauguauuuauccauuuuucuauugauacacauuugaguugucuucacuuaccuucauuugacuguuacaaauggggcuacugugaacacuugucguguguaucuuuuguugaacacauauauacauuucaguggguaacuauugaggcauggaauuacuaggucauaagauauguguuuaacuuuaauagauaguuuccuaaaguuuuccaaaaugcuuguaauaauacacacuucuaccaggauggagugcaguugugccaucuuggcucacugcaaccucugccucccagguucaagucauucucuugccucagccucucgaguagcugggauuacagaugugcuccaccacaccuagcaaauuuuuguauuuuuaguagagacagcguuuuuccauguuagacaggcuggucucaaacuccugaccuuaggugaucuacccaccucagccucccaaagugcugggauuacaagcaugagccaccucgcccagcuguuguuguuguuuucuuuuucugguuuauuuguuuaauuuuagcuguucaggugaguauguagugguaucuuacuguuuuaauuaucauguccuuaaugacaagagagguugagcaccucuucauaugcuuauuggccauuuggauaucaucuuuugugaugugccuuuucaaaucuuuugccuauuucuaugucauuuucuuauugacagaugagagguuuuuaaacuauaauuugguauaaguccauuagcagauauauacauugcaaauaccuucuacuugguggcuagccuuuucaccuaauacuguuuucuaaugaucagaaguuucuaauuuauagccaaucuuggcuuuuugugacuaguccuguaggagcucuuugccugcccugaggucuuguagguauuccccucuguuaucgucuaguagcuauauuguuuuaccuuucacacuugggucugcuaucugccuagggaugauuuuuguggaugugcaugaagugagguaggggucaagagucauauuuucccauauggauuuccuagccagugaaugcaacaucauuuguugaaaaguccacugcucuacugcuaguacuccugugucacaaaccaaguaguaauauaugaguggguauguuucuggacccuguuuguuuccauugcaccaacagcacacugucuuaauuacuguggguuuauacuaaaucuugacuucugauaguaaaagucuacagcuuuguucuucaagacugccuugauaggcuuuaauuacaucucaauauaccuuuaaaaaaaaaagacugucaacuauuuugggguguuuguauuuccauauaaauuuuaaagucagcuuguaaacuuucacacugugcacacaaauaccugcuagaauuuuucauugggauugcauugccucuguaggucacuuuagggagaaucaacguauuuacacuauugagucaucuaaauuaugaacauaguauguccuucaauuauguaaaagccuuauacaucuuuucauuagauucacuccuggauacugcuaugguagaugauacugucuauuaaauuuucuaauuguuuaugauuggugucuagaaauacaauuaauuuuguauauuguccuuauauucgacaagcuuuaugaauucaguuauuagaucucuguccuucaaguucuuuuaaacuauaaaaguaaacaaguuuauugauaaagauaaaaggaaaaacucccucccuccccaaccccacucuccauauacacacauacucucauagaaaauaaauaagaaugaggccaggcaugguggauuaugccuauuaucccagcacuuugggaggccaagguggguggaucacaugaggcuagaaguuugacaccagccuggccaauauggcaaaaccccgucucuacuaaaaauauaaaaauuagccaggggugguaguguacauuuguaaucccagcuacucagaaggcugaggcacgaaaaucacuugaacgugggaggcagagguugcauugagcugagauugcaccacugcacuccagccugggcgacagaacgagacucuguuucaaaaaaaauaaaagaaauaauaaaaucauaucauaccuucccugggacuguucaggagaaccaugaaccacaauuaaaucugacauucaaccaccugauaaaucugauauuuacaaccaccuguuugaccaugacauccugguaccugaagcaugcauuuuccugauggccaggcacauggaccucagauuuggcuggucuuuaagauggcuuacucugaacgagccaccaaguccuccaaagggaacuccauuauaucagacagucugcuuuuucauugggaccacacuaacacacucuaaauauggcaagaaguucauuuaaauguuuucauaggcuaugcugacaaauguuuuuguaauugucuugugacugauuucauucacuggauguacugggggcucauucugugucuguacauguagaucugccucguucuuuuuaaccccuccuguguuguauucagugauauggguauaccacagaugacuuaacugucccucuauuaguggauguuccgauuauuaccugguuuuuacuauucuaaacagugcuguggugaacacccauuucuguauauguuaguguacuuucauugacuuaucuuuuauuauuauuauuauuauuauuguagagcugguguuucacuguguugcacuggcuggucucgaaccccuggccucaagugauccuccagcuucagccucccaaagugcugagauuacaggcaugauccaccaugccuggccaaguauaucuguuagauaaauucuuaaaguacaauugcugggucaaaggauauagacauuucaauacauuuuuuuaaauccauuuuauuuuuaagacuuuuuuuaagguuaauacaggcuuaguauaaauaauaauucccauagauauugcugcccuucuugguuuaagaaaacauugcagauuuuuucucccuagcauaguuuaugaccagaaaguaaauuauacauuucuagaauguuagugcaagaggagacuucaguuccucuugucuggguccuuuauguuuuuuuuuuuuucauuaagauauaauucauauucaacauaaaauuuaccauuuuaugagguaggaggauugcuugaggcuaggaauucaagaccagccuggcaacacagugagacccccaucucuauuuaaaaaaaaaaaaaaaaaaaaaaggcugggugagguggcucacaccuguaaucccagcacuuugggaggccaaggcggccggaucacgacaucaggaguuugagaccagccugaccaaccuggugaaacccugucucuacuaaaaauacaaaaauuauccaggcaugguggcacaugccuguaaucccagcuacucaggagguugaggcaaaagaaucacuugaacccaggagguggagcuugcagugagccaagaucgugccauugcacuccagccugggcgacagagcgagacuccaucucaauaaaugaauagaguagaguagaguagagagaguagaguagaguagcugggcaugguggcacacaccuauagcccuagcuacuugggaggcugaguaugaggcugcagugagcuaugauugugccacagcacucuagccuaggugacagagcaagacccugucucucuuuuuuuuuuaaaggaccauuucaaaguguauaaguagguuuuuaguguauucacuauguugugcaaccaucaccacacuguaaugccagaacauuuccaucacuccaaaaagaugacauguaccuaauagguacagcagucagucccaauuccuccuuccuucucauccccugacaacuacuuuuuaccuguaugaauuagccuguuuuggacauuucauauaaguuguaucaaacaauauguagccuuuuaugacuuauuucuuuuacuuaauguuuuccaguuccauccauuuuuuaguauguaauaguacuuuauuccucuuuauggaugaauaacauuccauuguuuccucuguauccauuugucaguugauaaauggauaauuuggauuguuuccauuuuuuggauacuacaaauaaaccugcaaugaacauuuguguaccaguuuuuguaugaacguguguuuucaguuuuccuggguauauaccuagaaguagaauugcugcaucauauaguaauucuauauucaacuuuucugaggaacuugcaaacuauuuuucaaaucagguguguuauuuacauuuccacuaacaauguaugaaggucucaguuacuccacauuuucaccaacacuuauuuuuuguucuuuuuuuuccuuuauagauucuucuaauucuaguucuauuucuacuacugcugccauuacuuccuccacugaagucuugacccucugaaagucauacuuaaggguuggaaucaacuuguuccaaacuccuguuaauacugauguuccucccaugaaucacaaauuuuuuaaugacaucuagaauggugaaucauuuccagaagguuuuccauuuacuuugcccauaugcaucagaagaaucacuaucuauggcagcuacagccuuaaugaaauguauuucuuaaauaauaaggcuugaaagucaaaauaacuccuuuauccgugggcugcagaauggauauuguguuagcagacaugaaaacagcauuaauuuccuugcauaucuucagagcucuugggugaccagaugcauugucaaugaacaguaguaauauuuugaaggaaccuuuuuuucagagcaguaggucucaacagguacuugaaauagucagcaaaacaugcuguaaacagaugugcagucacccacgcuuuguuccacuuauaggcacaggcagagucgauuuagcauaauucuuaagggcccuaggauuuuucacaaugguaaauguucacugguuucaacuuaaagucaccagcugcauuagccccuaacaggagagccagacuguccuuugaagcugugaagccagacuucucgcuagcugugaaaguccuauauguggcaucuucuuccaauagaaggcucuuuuaucuacauugcaaaucuauuguuuagugcggcaaccuucaucagugaucuuagcuagaucuucucgcuuagcacuaccuucuuuuuuuuuuuuucuuuuugagauggaguaucgcucugucacccaggcuggaguguaguggcgcaaucucggcucacugcaaccuccaauucccugguuaaagcaauucuccugccucagccucccgaguagcugggauaacaggcacccgccaccaugcccagcuaauuuuuguauuuuuaguagagacgggauuucaccauguuggccagguuggucucaaacucccgaccuuaagugauccgccugccuuggccucucaaagugcugggauuacaggugugagccaccacaccuggccggaacuuuuucuuaauuucauuuucagauuguucauugcuaauauagagaaagagaauuaauuuuuauauguugaccuuguauccuucagcuuugaauaagucauuuacaagcucuaauaauuuguuuuguuggcacuuaaggguuuucucucuauaauaucaugucaucugcaaaugugguuguacuucuuucucucuaaucuggaugucuuuuauuuauuuucuugccuaacugcccuggcuagaaccucuaguacauuguugaauagaaauggcaagcguagacauccuugucuugguccugacuuuaggcagaaggcauccagucuucuaucauugagcauguuaguaguagguuuuucauaggugccucccuuuauuagguuggugacagucuguuccuagucuguugaguauuuuuauccugaaaggguguuggaguuuaucaaaugcucuucugccccauugauuuuacagaugaaguggcaggucauauuucccugcccuuggauggguguguuucuguuaccuuucacaccaaguuccagucuugacuaugccuagccuggggguccccacugugcauguggcaccuugguugaggugcagcuugaaguaggcaccccaggacgugucacucuccugccuuugcucccucaccccacucaccgcacagugcuggccuucuauggaguugaggcauggagagugugggucauaaccuuucuggucaucuucugcugagaaaacagaauauuuucugcucucuuuaauaaugcuguuguccauuguccccugcuccuggugcacgugggugaaaaggcagcugcucuuauaacugcccugucccauugcccacucucuuuuuuuucuugagacagaguuccacucucucacccaggcuggagugcagugaugugaucuuggcuaacugcaaucucugccuucuggauucaagcgguuaucgugccucagccuccugaguagcuggaaguauaggugcacgccaccaugcccggcuaaauuuuguauuuuuaguagagaugggguuucaccauguuggccaggauggucucgaucucuugaccucaugauccacccgucucagccucccaaagugaugggauuacaggcgugagccaccgcgcccucguugcacacaucuaaagacacuacuuuguggggccugcugcaggcacacuaagcgcuguugauggcaguuagucucccagcccuggagccugucacaccugccggucugccccugcccugcuucaucucugggaaugugugcaccugcauucggcccuucuguagccaacucugguuaucuccagauaaagcugucucccuuugagcucucugcagagcagccgcuugagaaagcgcuucucuuggcuuccuguuagcagugcuuguuggguggaugaccccucugagggauccaacuggggccagggaaagauuccuuggcuuuucaguagcuauaauuaauuccagucauaguaaagaaauaucugaguauguggcauaaaaugaaaacaauuuacuuuuuccucuccuuccuuuggucuauuuaggaauuuaauucaagucuaggggauuauucacuuuaagaacuauuuuagggaguaaaaaucccagugaaguucuuuuuuguuuucauuccucauugguuuaaauaaaaccugaaaucaccuuguccuauggagguggaccugucuguuuuucuugccauaccugagaucaucagaaauggcauugcaagggcaggagguccuaaaagggaaguucuuaacucuucuuuuugccaucaguuuguccucauuuugccaucacuuuucuuuuugccaucaguuuguccucuuuuucuuugcagguugugucaacgcugcucauaaauauaaucccagaggaccacaucccacugaacuuaucuggaaaggcgaaaaucacugggaaagccugggugaaggaaacuccucgauccguuccuggcuuuaacccugacucgaugugcgagucccagguauggcuguccagcuguguggaguggagacuucuagugccgggguuagacagauugguuuaaaauggagacagaaauggaggcacauucacagaagcagguacugugccucagaagagaaggcguugugccugaguuguugucagcuuuuguuucggaaggguucaggguugaucuccagcauuugacccucaguauaaaacucacaagcaguuuaggaaagcuucuccugcaaaaaggcugaaauugauuaugcaaagcuuggcaaugcagaguccuguuuuccugcaagacugcugaguggcuucagauaaucaaacugguauaaggcuccacacccauaacucugagccuuaggaaccaggccacaaaaggacaggcccagggcagagagagcuguccacacugaagauuuccaaggccucugcauguucccaguggagaagucuuuccaggcccccagugcacaacgcguuaucacagagucuuaauggacaguccauucaccccgaaacugccagguuucuuuuccuuuauagaccauaugcuucaugggugcuacauuacgcagcuagaaaugcuuuucuguucauuagcuucuaaugcuuuaacccagcuuugagaaaguacacauucaggccuuagaggauguuaggaagauuuuguuguuacucccaggguucaagggaggaaguaccuaggccagaggcacaguuacgagguugaagcucgccacuucaggaagaccuuguaacuagaagcucccauguccggucacaggucuuugucaaggauacuugaccucaagucagcguggguggguguggggaguaggggauauaaaacacauggagagagagugugaguguguguguaugucucugugguauagucccugaagggaagaaaaaaaacugcuggucuguauaugcuugccucuguuauauuaaaaaauaauaauaauauauauagagagaaaauacuaguuucacauaugcccuacuuuuuuccaugaaggauucuaggcgggucacaguagagggacuugcacaacgagggucacacauggaguagagggugggugacucccacaggaggcaucacccgcagcccggcauugguggccuugcccucugcaggugaucaucagggaaggggagcugcucugcggagugcuggacaaggcgcacuaugggagcuccgccuacggccugguccacugcugcuaugagaucuauggaggcgagaccagcggcaagguucuaaccugccuggcccgccucuucaccgccuaccugcagcucuacagaggcuucaccuuggguaagugccgggcucgcugcccuggggcagugacccgucagcgcagccgccuggccaucucccaggcccaggacagagagagccguccacacugaagauuuccaaggcuucuguguguucccaguggagaagucuuuccagguccccagugcaccacgcuuuauuacagggucuuaacagauaguccauucacccccaaaacugccagguuucuuuuccuuuguagaccauaugcuucaugugugcuacauuacacagcuagaaauucuuuucuguguccucucgggaaggagcugggaaguaaccaggcuccuccuacaaaggcgcccucacuuggccaccccucuccuccacagccagugcuuauucccguucacagugcagaauggcacccucgugcccauuuccauucuguuucuuuccuaaccccucccuuuacagguuucuguccucggacugauuucucauacucuuacaaccccauucccugcuacacaagugcccuuucagaauucucagggcccaucccacuccacagagggguuucccuuuugucagaacugcccacugccggcugggugcaguggaucacaccuguaaucccagcacuuugggaggccaagguggguggaucacuugagcccaggaguucgagaccagccuggccaacauggagaaaccccgucucuacuaaaaauacaaaaauuagccaggugucguggcaagcaccuguaaucccagcuacucaggaggcugaggcgggagaauugcuugaacccaggaggcagagguugcagugagccgagauugugccauugcacuccagccugggugauggagccaaagaacugcccacgccuucccacugcgguggggccaucagcgcucuuggaaacacuaugcugggcaaaccugucggggugauccuaagacacgaagaggaacuaccuuguuugcaccccagaaaugagugcacgcuguuuuaggaaaauggcuuugauaaagaggcuucaccuugggugagugcugggcucacugcccuggggcuccccugaagcagucaccuggccccuuuuagugugggcuugagaucagaucuguccaaaggcucagccccuggccaggcuuauggaggacacugcaccuccauguacacagagcaggguccagcccuuccacgcuguucgcguuagggggacgcgagaugcugcgugucaggcaugcaccgcagugugcauaggcguugucugguucaugguggaaguaaggcuccuuugcuucacagacccacucgugugcagacagagugggagucucagcguagggccuguggaccugcagcugcugcagcuggaguuuguucauuggcccacacuggggccugcauuauacauuuuauucuauuuuaauuguaucauauauuuaaucauggaaagguuaaaaaaaaaaaagcauacaugaagauaauuuaaaaucacccagcaugcauuugucagagauaaccacuaauaguaauuugauguuuguuuuucuagacuuuucuaguacaaauacauuuggaaaaagugggauccuacgcuacauacucuacuucccuuacccacccacccaccaaauguccaaauguauuuauaaauguccuuugggaucagcuaauacaagucuacauccucaugucugguaauuacagauuauuccauucuuauggauauauuguaguuuauuuaaccaguuccuauaauuaaacauuuaggcugcguccagauuuucacauuauugcugggaugagcauccuugaacaaacaucuuggcuuauaugucccauuauuuuaccaggauaaggauuauaaguuaagucuguuuggcagcugaaacucaccuucccccaucuuaauuccacuaagagaccugagccacuucugggcucaagguccaaggucacccacuuccaguugggaaccagacuagaguaccuuccaggauaaccaaagaaagugaagcaugaugacuacaccucaugaaauguauauuucaguuucaaauggugaccuagaauaagcacaaggauuucugcuaacuagaaaaaaucagagcgcuuuugaaacgaaaauagaggaagaucccacacccagcucaugaugaggaacaaacuuaacaaaggugccaggcuuuagcucugcuuagugcaugguacaaagagcaguuggucccuugagugugaagaugauccagaggcucagggcugcagaaggaagcagggccaagcugggaguggggcuacaagggggaacaggcgagagauugacuucacuccagcccgucucagcuagcgggguccauaaagggcacagcuaguuggccuguagcugaacccaugggaaugcccacuuucacgguguggccugcuuacagaggaacuguuucuuuccccuucuguucacacauguucuuagaagcccuccaggaccuugcguugggaauuccaaauauuucagccccaucuuuugaacaguacaccugcuguuuucuuucccacucagaucuuggcugagggacucuugaguccaguagcacuuacaguugcagaaaagaacuaguuuuggccaggugcaguggcucacuccugcaaucccagcacuuugggaggccgaggcagguggaucaugaggucaagagaucgagaccauccuggccaacguggugaaacccugucuguacuaaaaauacaaaaauuagcugggugugguggcgugcaccuguagucccagcuacuggagaggcugaggcaggagaaucacuugaaccugggaggcagcgguugcagugagccgagaucacaccacugcacuccagccugggcaacagagcaagacucagucucaaaaaacaaaaacaaaaaaaaaaacacuaguuugaucaagaguugauguggaaagaccuacugcugcccaggaugaggaauuccucaacccuuugagccagaagggcaggcuucacugaagugacccaggcugucauccuccugaagcaaugcugagggaccugugguggugguccuugucacccaggcucgggugugucugugugugugccuacacagguauacucagcuauauaggguggccccugugacaugugacuucugggaccccagacugagauguucucucucucuuuuucccugagcuuaucuuuucauccaaaaccucuucuucaccuucagccuauucauccaacacaugucuauggaguggagauaguauagcugguggcuaagaacaugaauuugggacccaggccuggguuuacuuucuacccauacgaccaugggaaaguagcccaauuuugagccugaguuuugucauuuguaaaauggggauuauaagguuugggcucugguaagcaccuaagagaugguggcaaucuguuaauaaugauguuaauaucaucuuccuuacucagguauuuccugcaucuguggcacuggacucugugcucuggccuuacugaguuuagucuggugggagaaaucaggccugaggucgccuacaagcuugucuguuucacuucacaggcguggaagacauuuuggugaagccaaaggcagaugucaagaggcaacguaucauugaagaauccacccacugcgggccccagguaaggagggacuucgaggccguggccugcccuagaggggugaagugugugcugagucaaaacccacacucucgucguuuggccucagccuccgcuguguuucuguucucauucuaggcugucagggcugcauuaaaccugccagaagccgcaucauaugaugagguccgaggaaaauggcaggaugcccaucugggcaaggaccagagggauuuuaacaugauugaucugaaguucaaggaggaagugaaccauuacagcaaugagauuaacaagguuagcccagcauugcaugcauuuauccccaccacuaugaaugcugauuuuuaaaaaaauuacauuuugauucucaccugggcccuacagagcaccuuggcuguugaacagcugacuaggugagaugcgaggugggauggguagaacucguuguuuugaagggcccagggcuuuguucccugccccaguuagggucuauacaggccucagaauagugccaagagagaaugcuuugugcuguuuuucuuuauaaauguuuuuauuuuggggugacugcauuaaaggggcugaauggggccaccaggggugaauaagcagggugagggacccggaucgcccuggcugcucaugcagcggagccaggagugaaggcucagguuccaguccuggcucugccuugaacuugcugugugaccuugggcaagugagauaaccagucccugccuugguuuccucaccuggaaguggggcugugaggggcaccaccucacagggcugcagagaggcuucaggagcuacuaguacacaaugccaagccaguuccugggcaguugagaaaggagaggggaaaucucugcaugagcugaaaccacagccugcuuuucucugccuuucugccccagagccaggguucuccauccugcugcuuggaggagcuggccuggcccucacccugccuccugggcccuggggcccagccugaggaguggggaggaggaggcaaugccaacacucaucaaaagucaaaguucgucuguagugcucucuugccuggcuuuuagcaucccuuaggcugcugagaagaccgacuucucauggggacagguuccauccuugagggguuuuguugacaggagcuuuccuagcaccucccugagaaccaggaagcucagcuucuagggcugacuggggaugcuaggaguagggaaguugucuucagaugcaucucagaaugguuucuugucccuccaguugcccucuucccaccaccuccgcccacccaggcucugccucuccuguguugggccaagucuguggaauuccaggcacaggcuagaagccccagacucagagcccccuucucagcaucuccccaggaucccccugaaggggcaugcuugguucugcuggcucuugagccaagacagagcuuccuacauggggcuuggguggcauguucguaaaugugacaugaugcggauguugguauucacgcugggagaggacccaggccaggcucugcugggcgaaucaagggcaucaccuuaaauuuuauucuucuccagcuucuuuuuagaaucacgaacuggaucugccagccccucuacuucuccuuuuccuucucccuuuuugcugcucuuuggccaaugaaugaaaccucggggauccuggcagaggaaguccagcgagugcagggcagggagcaccuguuugaccucucagggguuccagggaaggauuaaugcugaaugaggcuuucucuuaccucgagugggauuugguacuuaggucugaauaaauauucuggcuguauugcuucugcuuccuggauuuacauccugauucugggauuuuuaaagaaggugaagucacugaccacugugcugauuuaaucugcaggcaugcaugccuuuuggccuacacagacaguucccagagaacagccugcagaugauggugcagucgggagccaaagguucaacugugaacacgaugcagguaugugcagaggcggguuggcagcuuuacaggugucagcaaaggcaggugggggauagcaggaggugguuucaguuuguucccuauaaaacaugacaaguaaaaagaggaaagcguguagaaaucacuacaggagcuaaccacuguuaacaugccaauguuaaaggcagauguaguuaugaauaugcagaugggauauguauaacguagauauauauuacaaauuuacaaacuguacuauuacauauauucacguuauauagauaaauuauguauacucacacaauuuuuacguaauuuugcaugauuguuucuuucuuucuuucguuuuuuuucgagaugaagucuugcucugucaccgggcuggagugcaguggcgcaaucuuggcucacugcaaccucugccucccagguuccagagauucuccugccucucgggauuacaggcaugcgccaccaugccuggcuaauuuuuguauuuuuaguagagacgggguuucaccauguuggccaggaugcuuucaaucucuugaccucgugaucugcccaccucgaccucccaaagugcugggauuacaggcaugagccaccgcaccuggccgaucuuuucauaauauuaaauuauaaacauaaacauuguccuagagauuucuuaaccuuaaaccuuggugaccuugagagggucuaaaggcccaccccauugucuguugagugugacaacagaaaggccgaaagccguuaggaaauccccugacuacaucgaaaccuagauauacugcucuccuccaacacgccaagaguauuaacaggcagcuuucuaagcaaauagcucaauagcuugaguucccauuuuguuguuguuguuguuguguuuuguuuuguuuuguuuuuaauugaaaauaagacagagucucccuguauugcccaggguggucucaaacuucugggcucaagggauccuccugccucagccccgcaaagugcuaagauuguagaugugagccaccacacccggcccugaguucccuuuuggcucuagaaugugaggaucgcaauaaauggcuguuuccugcaggccucucuuuccccaucaggacccuccaguccuuuacagguauaacaugagaugguucugagacauggcucuuuuuauagagagcacccauuuucaacugaccccaaaugugaaaauccagaucagucaaccaaaggaagguauuuuuuuuuucuuaaaaugaaggcuuccugguuuguuuagaaauguagguuagccuucaagaacucgguuuccaugcagcuuuucuucaaggucagauuauacuuucccugcugggacaaagcacuguuaaacacacauguggaucuucaguuuccuguggauuuccuguccuccagaucucgugccugcugggccagauugaacuggaaggucggagacccccgcugauggcgucuggcaagucacugcccugcuuugagccuuaugaguucacccccagggcugguggcuuugucacuggcagguuccucaccggcaucaaaccuccuguauguauuuugguuuuuccauuuagcuuuuucccucauuucuaggcuuaauuguaggugaacuaugacugcccuacaggguagggcagaagacacugggggcuauuguagcugucgaggucaaaaaguccuaggagaucagggaagggaguggccugucuggucaggaaaggcugcuggagguguuggccugagcccuucaggaagcgcacuguccucacugucaccuuugggaccugggucccauucucugcaggaguucuucuuccacugcauggcaggacgagagggccugguggacacugcugugaaaaccagccgcucaggcuaucuccaaagguaaaauguaucugccgugccccuugagguagagugccagggcccuuccugccaucaucuuucacauuauaucagcagcucauuuaagauuccuuggaugaaaaaacuuuuggaaaguuuccaugaauggccugagacagaaagcagcaaacacuguuccccuucgcaggaucgguagagcaugagcucagaggcuuauaccaagggcucuguguucugagggucugccauucccugggggaagcuauggcugugggagaaggucuugggcaguggcaagcuuaucuugcuuccuagaaggcucagcugccaagacaguagugacuaacauugagcucuguccccacagcuugggguggagggacagugacugcugggaagcccacuguuaggguggcaggaggggaaaccuaggcagaguguccggagagguaagcaaaggggcuaggaccagggcagagagcagaagaaguugagauaaaacugaggagaaaggccgccaguggagggauucacaucagcaugugguucccaauaccccuuaguguccuuggcaaucccugggcugaccaaguuugagaauccuugacagcuccccugcuucgcccgucuuuugguucuaaggacacuggucucuggggagcucugcauugugggagaguguaggggcagacagucaucucagcagcuggggcuagaugggagcccaggucuagggguggcagccaagcugcucaguaacauggcugcagccuccuccuccuagaaaaccaucaggaaaugcagccccuggcugggggacacuggagcaagcccagaccccggggcauuggaucuagccuguucugaagucuuguuugccugcagaacaggagccccccuuucccuccccuccacugcccccaacccucaucagaggcugcccuggggaggugaugggccggcggggacugagccgaugguguccuuacaggugcaucaucaagcaccuagaggggcuggucgugcaguaugaucucacgguccgugacagugacggcaguguggugcaguuccuguauggggaggauggccuggacauccccaagacacaguuccugcagcccaagcaguuccccuuccuggccagcaacuacgagguagugugcuagaucccggagccugggggccgagcaguaggccucccccaccgagguuagagaacuggaaugcgcugagcuuugcaacccaguccaaguggccauuggaaaguagagugggaaggguuuauaagacaccggucagugcccugaaacacuugacaauuucaaagccugugaacuuucaucacuugagguggcuggagggcacgagcaccucuggaauaauaccuacucuuuggggccauuugccgugugcugggcccucagcuaaagcacacuaucaauacuauccguuuuccuccucacugcaacccagggaaguaggcauuacucugccgauuuugcagcugaggcaacugaguaucaaagcauaaguaaacagucggugaguggcagagccagcauuugaacaugggcccgucagacacaaacucaugauuuucauuguauaccuuaaugcccuuguagugaccaucacuguugacugggcagucaccccauuugcagauagggaaacugaaaccgaugugaccugucuaaggucaucaagcugaugguagaauugaggguugugcucuggugcugaguccuuuccauccugguuccuaucccugagcuuggccaucacucuuccccucuuccuuucuucccagaaacucccuugugcuccuggaggggcucugagugugcugcuuucuuuccugugucucccucugcucccaagaccauugguucccaaaucugguuugcacaaagugagggcccugauuaacaauggaugcucagccucucugagaguggugcucggccccaucaugagggcuccacaccagccaccuggguccccugaauuugugcuccauggcccucuugucacgcccucaucucuuugaucucaugugugugauuuguuuguuuguuuuuuuguuuguuuguuuaggugauaaugaaaucacagcaucuccaugaaguuuuauccagagcagaucccaaaaaagcucuccaccacuucagagcuaucaaaaaauggcaaagcaagcaccccaacacccugcugagaagaggcgccuucuugaguuauucccagaaaauucaggaagcugugaaagcccugaaacuugagagugaaaaccgcaauggccgcagcccugggacucaggaggugaugcagggaggugguguccuuaauguccagcacguccaggcuuagucagugggugagggaugaggggcuguuuuccuaagagaagguagaaucaugaacuccagcuuuguucaccgucagucagaacagaauggcucucaaaugggaauguaagguggggacucuuaacaaggguguaggcaggguuuggggggacuaacuggggccugugacuucgggguuccccgcgaucccaggugugaaggaauggggagcagucaugagaaacggagaggacgacuaugugcuagggccacuggacagagcccuggguagagacccacuagagggggguugaggauaaauaccaggauccccuuccuccugccuuucccucugcugcuggugccucccaucagccaagcacaccugggagcuggaagcaggggaucucuuugaagcagucacuuugggacagccuugagggcacagagcgugugaaagagccuggauccagaaauaaccauggauccagcacagugacugcauccuagcuggccugagacagucguggcuuugccucuuguccuagccuaaucauaacagucuccuguuucacucuaaaagaagcccaguuugcucaguaaauuacaugcuugcccucccugggcuugaaugggccaggaugaagagcugcuaggcuuauagucaagcagggugcccuaggacagguugaagucucuccccauuuuaaauggggagaugguuucucauugcaaucagguuucuuucugucucccuuuauucucauuggaagccaaugcuuuugaucccucuuaugcuacuggguaucccucccacauagcugagacccauccuucuguucagaugcugaggaugugguaugaguuggaugaggaaagccgaaggaaauaccagaagaaggcggccgcuuguccugaccccagucugucugucuggcguccugacaucuacuuugcaucagugucagaaacauuugaaacaaagguugaugacuacagucaagagugggcagcucaaacagagaagaguuaugagaaaucagagcuuucucucgacagguauugacagugauuuguugcacaacaugugcaggagaaucugccuccuagccccugccuccuagccccugcccuacucacuccggaagagggcugccuccuggguuugagacuucagcuagagggagggcaguaagacagccaggggcaacgcacaagccccaagggcccaggagugaacaagugcaagggaggcaggaguggacacccccaucugggccaagauagggauaguggucugcugggaggcuugcaggaaagucugcucucuuggguuuggugugguggguggggcugacugagagucagggaaucuggucacuguucaccugcugccaaccgugugacccagggcaggucauucaugcccagggacaccaggucuuaacuucucaugaggccuuggauccgauuacuccaguaauccuuugagcuuuggguucccauuugaaggccucagcuuggacuaggacagacacacacacacacacacacacagacacuguagcucagcgcgcgcgcgcacacacacacacaccuuugagcuuuggguucccauuugaaggccucagcuuggacuaggacagacacacacacacacacacagacacuguagaucagcacacacacacacacacacacagacacuguagcucagcacacacacacacacacacagacacuguagcucagcgcgcacacacacacacacacacacacacacacacacacacacacaguguagcucagcgcuccuaguggcuguucuuaacagggucaggcuucauaggaaaaaugguuaguaaauuacagaaucgugcggcaugaauacuucugauguggucugcagccauuugcacuaacuaaaaauauaaacacucucaucacccccauccccauaauggccuagugaaccucuuucuaauuuuuauagcaggagguuuaaacugucuccaaauugucauaauugagaagaaagaauggauaaaggaaaaagugaauaaugaacccagaaauucuccugcuuagggggcuugugguaacagucccagaguggauaugugacauucugggggcaaacaugaggaguccaagcaugaaugucuagagcuucagccacccagcugggaucugugcuguguaauuugaggacaucucagggucacuggugggaauuugaagauuagagggaucuuuugccuaggaaaaacgaguccagaaagagguagagguuucaguuuucugguuucgggcagcauugacagucuguggugucugcuccugaccccugccacaacccccacccugaccccccaccaccgucucuagguugaggaccuugcugcagcugaaguggcagcgcucacugugugagccgggcgaggcugugggccugcuggcugcccagagcaucggagagcccuccacccagaugacccucaacaccuuccacuuugcaggcagaggcgagaugaacgucacccugggcauuccaagguguggggcacaagggagcacaggguggggucuguccuagccucuccuggagaaggggccauuuaaugagagggggugagugagugugugugaaugagagagugugucugugugagagagggacagggucucauuaaaguggggaucaggguuagaauuuccagagcccagcugguuucuuuggugcccaggccugguaggaucuccauuuauuccucugccaacuccugcauccacguuccuggggaugccugugagacugcacacugcugggggaaggacucaggaacguacauuguuaacaagccccacacaaggugccugguugcccaacuccaggggagccauucacauagaacgugcccccacguggcccugggcccuggcccuucagguaaauauaugugcuggacaaggggaaugaguguggggucagacccaucugcauucagucccuggcccugccuuuuucuagcagaaagacucuggacagguaccucacuuuccaaaccucaggggguccuucuguggaaggccagaggcugggacccacuauacauccaggcagugagggcuggcugagcucagcaggagcacugugggugcuaguugccuucccugcaucgcuuguucauucaguaagcgucagcaggcaccuguuguuugcaaggcacaggugauaggaaacaagaaucagacaaagcccugagcacaaggagugggcccuccagggaggaaacugacaggggagucccuuacuguugcacacgaggccagagcugggauucucugaucuagcauauuaucccugugagauccccaggccucucucagauuccaaaagaacucugacaucauuaggagaagcugcacccaaacagaaggucugguugccacucaugauuggaugugcccuuauucugugacagguugcgggagauucucaugguggccagcgccaacaucaagacacccaugaugagcgugcccgugcucaacaccaagaaagcccugaagagagugaaaagccugaagaagcaacucaccagggugugcuugggggagguaacgucucuccuucccagguugcagacggggugaaggcauguuccuauauccuccccaugugugaagaacaggcuuugcuuacugcucugacccuaggcucagauucccaccaaugagagauaagcugucucugccaggugcugagcagagauggaucaggaagcuuuuaagagagucauuaguuccacagcauccuccugugccugaaaaauaaaccauuuccugaguuugccuacccgcucugcugaggccacuccuaggagguucaggccacucucuggaggugacugcaggcugugggccccccagcagauccacaccaguauagcucaccaggguuucuuugggguuuggccuguggucucagcugcuaucucuguaaacccuugggucucguaacccacucacauugcgcagucaccuaggaccugaacaagucaaguucucucuguccgucugguuccagguguugcagaaaauugacguccaggaguccuucuguauggaagaaaaacagaacaaauuccagguguaccagcugcgguuucaguuccugccacaugcauauuaccagcaggagaagugccugagacccgaggacauccugcgcuucauggaaacaaggucagggcucaggcugugauugucauugaccuugacccagagaaugcgcuugaacuggggcaggaagcaccuagccacaaggcuccuagagauugagugccuuugcccaaaugagcccuucaagggaaguguuuaggaagcagagggccuugcagccugaucuggaaaccugaccacagucuggcuuguggguaugacuuucuuagccacacgucacucccugagcccauuucuucucuuggguugacgucaggauuguugucuucuggggcuugcaggcauuaagacauggaaaugugggugugguaaagagaagggagcaccaucaaagcggugcuucuguggugucggagcagcacaugcuguuaauguuugcuaggguguuacugcaggcaguauaaugugguuccugaugcauuuagauucugugaauaaugaacaaugugcggguggcacgcugcuguuagaucuccauucuauaaccaggauugccuccagagaaauucgaguuccugucccgaguuccuguccaguagggaaaaggaacuuuugucucaaguucaaguuacuguuagauauuugaaaagcagaggccacaaugcugaguuccggggagcaggaggaugggcuuuuuggggacuggggcaagacuggaagagcccacgaagcauuuuugacucaccagcuaacccuagacggugaagugugaacacaaaaaggcugcauagcccagcaggugacaggccagugaagcaggcuuggaggcccccggcagacugaagaguguggaaccugucucaaggggcaccuguuacuaugcaggaauggaggcccggggggccacaucuuuugauuuaaaaagaaagaaaacaagcuucccacccccuacguuuuuuucuuucuugggucacuuguuuacuugccuuugcuuuuauauaauugaggucuccugacuuuuaaacaucagcaacuaauucauguguuuuuaaaagcccaguaaggcccagaugguucucaucuguugcaggaucuggccacaggccacugaccacugccucuaaucuagaccaguucuuggucuucugggagcugcucagauagagaagcaaugacagagcagaagcagaaagcucccugcacucagccaucccacaaacacauacugagccaugcccauucgucgcugagucacgggggcaggcgugggcaacacaguacgacuuuucugcccucagcccucugcccucucaccuuauggggccuggccucgagccagcccucugugcagguggcauuugggauggugggucuugggguggaggagcuuggaugugaacucaguccuuuggacgggggucacuggccaggugcuuccugccccaguucacgagcccugggugaaguuguuguuggcugggccucaggagcaccugcguuggugccagccugggcugagaacauuccuucugucgagugguccucugugcuaucugggcacugggcagaguggcaggggagugcugugugcacccgccugccagcuccuuaauuaacagcgaggaacauaacuaccaagugcagggggcguuugugcuggccuggcagugguuuucugggaaaugggaauucagauuucauggccucuagagaauaacuaaggguggacggaguuagauguuuugccccaguucuguucacaggaggcccaggccagcccagcagguaggucggcaugaggcuggcgccagcccaugcugggguucuuuuuacuuauauuaccucauggaauugaaaauaggaaaucacuuuuuaagacuucuuccugaugagggacagcccuggcuuguucccagccgugaaguacuuuuucaacuccucccuguguuuugcuugugaacuugaaaaucugugauaaauaaagccaugcgcaguagcuuuugguggagguggccucaaggacucagcagaauggggcugagggguuaggcagagcuaaaagauggggcaguggaugagcugggugcggucuggacucccuuugucaggccccaggcagcagagcagcuguguucaggccucuggccgcccacaggaaaugggaggaagugugagugcacuuucaaaagagcagccaacccccaagaagcuuuuucuccuuccuuucucccaucccucccccuuccuuccucucugccacccucuuuuucuuucucuuugcccccacccucccuucucccagcuguggagucaugagacccuugacagagccuggagaaaaacagcacgagacagaugguucccuagguagagauauacaagcguagaaggccccccagaucucugcacuggcacccaucacaugggcuguuuguguaaauugucuggcagguggcaggggagaugaaguggaaagagcacugagcuaggaguuaggggcuguaaguuuuggccuccgguccccagccaugaaaagacccagcugacagucuguaauuguagcuucugugaaucugacuuuccaaacagcaggugguggagcuguugccaggcgcguucagaaaccgccaggggucaugugcucuguuuguaauuauuuacgugggacgggaggcuucucugccccugccccuccuguucccuuucuguugcuacauucaggugagcugcacaaccuugagaaggcagucacugugggccguuaguuccccugcucuuggcaaaaccauagaagggcaaauugcaccuccaggaaaacuggcacacuggucacaugccuaccacuuacucaccagccauucauucugccuucucaccuccuucccuccuacguucuccacaaguccuggucaccaaaagaggcagggaaggcagaaggcauccccaacugggggaaucagggagggcuucuuggaggaguuacagcugcugaggccuggccuugaaggaugaguacagcuucaguagguagauauuggccagggaaguuacuggcagagugagccgcucaagcaaaggcccaaagggugcacaggguggagggagcagaugggcaguuagaguugaggccagaugugaaaugcugggggcaaaagcaucagagccgugacauugccacaaguugagacaggcuggggcgcccagcugagggaagcagcccuguguguggcagcagcugagccccgcacccccacuccgccucauuccaucuccucugcucugcacaguagccucgggugcagagugagagugaucccauguugcagaugagaucaaggcccuccucuccagucuguggcaggucaggacuuuaaccugaaccuguccuuacagaaacaucucucccacccccucuuuccagugggauuguaucuuucuaaagucaagcccggccuucucucaucuggcuauccuguuccuguccccagugccugguaaacaagcucuucucuggauuaauggaugagggggcuuuuuuuucugccaagggcaaaccacguacaccuuuaaaaaguuaaaaaauaauauuggggucugggugcaguggcuuacccuuguaauuccagcacuuugggaggccaaggcagguggaucaccugaggucaggaguccacaaucagccuggccaacauggugaaaccccguuucuacuaaaaauagaaaaauuagucgggcaugguggugcaugccuguaaucccagcuacucagaaggcugaggcaugagaaucguuugaauccgggaggcggagguugcagugagccgaggucgcaccacugcacuccagccugggggauagagagacuccaucucgggacgguggggggaacuaauaauaauaauauuagggaagaugaguggcauucuuuuguuuuuaaugagcaaaauaguauacauuugaccugccuacuuuuucaaaugaagacucuaagcuccuugagggccuggagucugucuuuucguccuugcuuugccaccagggcuggcacaugcugggcacaguauaggcgcucagagaaagugggacggcuggcuggaugugugagggacccgauucucacagucacaagcagcccuuuuuggugugcuauucuggccuguuggaaaagacaggcaggggguuacaugaggaaagaagugguauggaggggacaggguggauccuaagaggcccuaaaaauagauggcucuggaggaaguggcagggggccagguucugagcuucagguugguucuuuuaaauuggugugguucuaacuuguugacacgauucauugccacaagcuaaguuaucucugcccuucgaaauuuugaugagcccuuccgaaguccucguucuuucgucacauugccggggcucccacaccaagggaguucucuggccagagcaacaccaccuucuggagaugcugcagguugugggcaggggaagguccuaguccugggugggguuccccucuccuacaguagauucugccuuccuuguuagaggacgaccacagcggcaccuacaacuguccuucaccaagcacgcacucugccaggcgcugugagaggaaucagacauaggguuguuucucaucauuagcaaacaagauugcagaauacguaguaauucccauauuuucuagacaauggggcuuaaagcugaggaagcugccuguccuacucauaccccgggaguggcagugcaccuauugagaccaggccuguuggacuguggaaccgguguuccugauacgccagagacgguuccaaaacagcggguagggacaagugaguggcuaggagaggcugggccuccaucucgugcacugauccccugugggaaucccucagcguccuaucccccaaaugaggguagggcuggacaugcugguacugcacagggcuuuuuggcuuucuucuuguuuuagauucuuuaaacuucugauggaauccaucaaaaagaagaauaauaaagcaucagcuuucaggaacguaaacacucgaagagcuacacagcgggaucuggacaacgcuggggaguuggggaggagucgggugagugaguccccgggggucacuagaguugcacagggacagcccccagacugggcaggcucugugccuauucucugugcuccuccagccccauccuggugcuggcccaucuccuaccuaucucagcuuuuaccugcuguucugagagcccagaagcagcauucacuucuuggccugaugggccaggcaagcgaggcugccaggcagcaugguguagccagccccggggcaggccuccgcaucauagcucugcucuccaagagcccgcuguaaguggucuucauccugaggagggacucgaggucauggcgugcgcugagccuuugaaaguucuuuuuccgguuuccuuuggcucugccuucgacuugcccaggcaagaugaacugaggcccaccagggcacuggcagggaccagagagguaucuggaagcagagaaguugggcugcagugacaaaaaggggaagagggaaaaaaccaguaggagcaaaauaguccaggaauaaauaaucagauaucugccaggagacccaggagcaggccagaccugaggguggugugggagcaggucccugggugccaucugagccagcagccagccugcuuggguuggggaugauguggacugggacuacccccaaccagcucuguggucucaguugugucacccuucucugggucugucuucucaccccuaaaaugaggggcuggccuacaccagggaaaaugcuaggucucuccugcuccgugaguucaccugcuagcucacucaagcacaagcggguguggacuaucuuuagaaugcugccuggucuugauucuuaauucacccagaaggagaguauaaaaaacuaggagccaaguucaggaggagaaaggaagagauacucaguauucuacaagauaacccuuccuucucauccccaccugcaacuggguuugaucaaaaauauuuggaacaauauuugacaccaucuucuucuaagaaagcaaguccuggcacuuuuuuuuuuaauuuuugggaaugaaacuuugcaaguaaguggugcauguaaagaugaagacugaagggaaggaggccuggguucugggacuggacagaguagaugccaguagacggguuggguuggguggcaguggauggagggugguggcuggaugggagaagggguuagaaggguggggcauggauggauggauggguugguggguggauggauggauucacugagcacuagauauuggaguuaaucuuuuucuuccuugcccacaaaccacagggagagcaggagggugaugaggaagaggaggggcacauuguggaugcugaagcugaggagggggacgccgaugccucugaugccaaacgcaaggagaagcaggaggaggaggugagagacccuguguggggugaaggagcuguggucccagcccccuucccuguuaaccuggagggauuaucucccggcacccaggccacaccucugugucaugaacccacaaggaacccugaagcagcaccugccugcccagcauaccucucucuugagaagaugggguucauagggugggaauuuggcacagguccacuccagggcugccuuuuagauguggccaucccuggacuuaaaucggacucaaggauccagacaggcuucuggcaagaaaaagucaggcugccucugguuuuuacaaugaaaauauaccucucucuccucccacaaaccagucuccugcugucauaauggccgagggaacuuaccggugagcagguacaccagugagggcugagugagggugagcuccaccucugugaggggcucagggggacagagagguggcauucucaaggcaaaaggaagaagaaagaccaaccaggccggagcagaggagccgggaguguggagcagguggggccuagguagcccaggccagccaaggcuuugcaggggucuuuguuccacaggcagaguccagguagaugguggguccccaagugacacagccugugcucccuuuucugccagguugauuaugagagugaggaagaggaggagagggagggcgaggagaacgacgaugaagacaugcaggaggaacgaaauccccacagggaaggugcucgaaagacccaagagcaagaugaagaggugggcuuaggcacugaggaggacccgucccuucccgcccuccugacgcagccccggaaacccacccacagccaggagccccaggggcccgaggccauggagcgccggguccaggcugugcgugagauccacccguucauagaugacuaccaguacgacaccgaggagagccuguggugccaggucaguguggccgugcaggccagggcuugggugguugguccagcuggccaaaucccucuguggaaggggccugcugagcuccccugcacagcugggcagggggcagccaacauuccccauggucucccacucagagcacagccaggccuccuguuuggggccugcgagagucauuuguucuuuuuaaucccagaucccuuuaggaaucuggugauggcuauaaacccucugccccgaaaaagggcccacacgugucauuuucaaaccccuaguaagccaguucuccccgaucuuucaagacacacaagacugaucuaccaggcccuuuagguacuuucaaauacaccaccuccuuuaaucuucaguacaacagauauguuaccauggaccacacguguuguagagacacuguucgugcccucaggcagggacacuucaguuccccacacacacagccccugccaccaucuuuuuagggauuucaugguucccuuaaagccuggaugaucuggaugccuagacaugugcacacacuuacgcuuugucuuuccuuugauccaguucagugguucccaagugaugggguaauaacaagaaccacugaugggauugcacgcgugaaacaacguguacccugccuuguggucuuuaaggacauuaagagcagugcagaguggaugugaaucucaauguugucaccgacagcugugaaaacaaccccacuguuucccccugaaucugggggacuggagauggcugaccuguacacaguucagccaucuccaauguucagacuaccugcuggcuugcccagcaggaccacuuucccccagccagggaguuccugaaaagguuuugaaggagucucgccucaguccucuuuguggggacuggaguagcugucacccuacccagcucucccuccuuuugcaggugacagugaagcucccucugaugaagaucaacuuugacaugagcucccugguaguaucuuuggcccauggugccgucaucuaugcgaccaagggcaucacucggugccuccugaaugaaacaaccaacaauaagaacgagaaggagcuugugcuaaacacagaaggaaucaaccucccagagcuauucaaguaugcagagguaagacaggcugucugcuggccugggacaaagcauuaguccucaccccacguugucucaagacccagccacugggaggcucgcucuacgcgauuuacucuggcccuuccugagccauuugugcuuccaggccacauuccccaaaccaagugugcguguccucgucugccucccggggauucuggggcacguuagccucauucagguccccaguaaagcacccugcugaacuuauccaacccagagucgcccggguuaauuugaguagaguuuuuuccuugaaauuaagacccucgggccgggcguggugguucacaccuguaaucccagcacuuugggaggccaaggcaggcggaucacgaggucaggagaucaagaccauccuggcuaacacggugaaaccccuucucuacuaaaaaauacaaaaaaaaaauagccgggcauggugacgggugccuguagucccagcuacuugggaggcugaggcaggagaauggcgauaacccaggaggcggagcuugcaguaaaccaagauugcgccgcugcacuccagccugggggacagagugagacuccaucucaaaaaaaaaaaaaaagaaagaaauuaagacccucccgaaguagaguugugagaaaucauugcugcaucaccugccuagaugcuguuugcuuuaucugguaaagggggucccagggguagaggugcccuggcauuccugucccaccugcucaccagcucaucuguccuuugagcugugucuccaaguacucccacuucaccaacucucccagaacuuucuggguuucccccacagaacacugaggaacuggggcccucuagccuaaccccccaacaagucuaugcuaagcuggcaaagcucccccugccacguacacuucugcccccaccaaugaccacccugcaaagucuccugcuccccugaacccuuuuaccaaacacuucccagaggaugagcaaggaggauuggcaccugccaagagugcagggugagaggcuccuccaagacagcucagccgcaccuuggccccuugguaaggcccagcacaugccugugcggcugacuggcccccacuccaugcacccuggagggguguguaaugugucgcugcuaggggaacuuuccuugcuuccuaagggaagccuuaauccuaguaaacaggucucaguuuaaaaauaagaagaaaaaauccuuuucuucccauugaaucuaaagcguguccaaaguggacacgcuggauucuuguaaugacgauacagaccuugggccccggccagcgagccgucagcagcucugccuagccauuuccuucugcuaauccugggccaccucuugaccacuuugucaucagcuguaccgagcugccagacacaaggagagagagagcggccagggggagauacgcaggcagaagggagcagaaggccaggcccucuaaauaaaucccuuccuuccucucuccagguccuggaucugcgccgccucuacuccaacgacauccacgccauagccaacacguauggcauugaggccgcgcugcgggugaucgagaaggagaucaaggauguguuugccguguaugguaaggggagcuugcagauaacaccccgaggucugggcaccagccaggacaccagaaggcucggcaggagggucaggaccgugucgguccagcaccgagucaguccagcacuaaggcaggcacugcagcaugcgugcagugagugcaccuguaggagacugcagaucugugaagaggugacgucucccaucacugagaccgcuucaguggugucucaucugcuggugccuuagagaaagcuccugauugauaacuuggccccauccugccuuugggguuucaguucccaagugaaaacagugcgguuagauccucauuuccugugcugcuggaaggaagcgggaagcaggaugcaggggucagggaaagaugccccagaccacggggaaggguuaaguagcgugagcagguggcggagcugaaggggagccccagagucuaacucccaagccaugugcugauguggaggcagcuuggcuugugucugcugacugcucccguggucacugcuuaaucccuccuaauuuuaccucccguuugacaggcaucgcggucgacccucgccaucucucccugguugcugauuauaugugcuucgaggguguuuacaagccacugaaucgcuuugggauccggucaaacucuuccccgcuacagcagaugacauuugaaaccagcuuccaguuucugaagcaagccaccaugcuggguuagugcgugggcaggagcccuggccuccccucuacugacgacucugggcacacgggcucacccaugggcaucuuuccaugguuccuugcacaccagugggaucuugggaucugaggggagcgggggcggcuggagggggcugaacagcagacacgacagcugccucuacgcuuugaaggaacaggaagagggccuuccccucucaagugcuagaggggggcugccucgugaucccaucagcuucagagacucaggacccaccugagucccgagacuucaguguucagccccauaaucaccucaugacauucccaacuucuaccucaacacccugacacauguuuuugugucucugucaggaucccacgaugagcugaggucuccuucugccugccuuguggucgggaaggucgucaggggcgggacaggccuguucgagcucaagcagccucugagauagcagcuaccccggcaccaucugcccagcuccaaggacccuuggugagggcguggcccagccugccuucugcaugagaggaccaggagacuggaauccagggcaguuccaagugacaguacagagcacagcagcgaccuugggccugaaagcagugggccucugagcugggccagcuucaccuggaaagugacagaguugcucauccuugccccucccugucucuggauuuuuaucaagguuuaccaagucuucugagucccccugagauggcuggggccucaccugugcugcaggaggccucuguggcauaaccccuaaggagaaguccugauucacgauucacugagaagaccaaggggaagccaugcuuugcugcuggggaccccaggcaccuccagaguagggaagcgggguucuuuugcugugaguggccagggacaacagacaagauuccugggggcucccgaugagcaggaacguggagccugcugcccaaggccugcuccuuccggcugcuccagccccugggggcagaguccacaaagaguccccaucaagacuucuucccugagucaaguacagcguagcauaguccuccacccacccaaccucucugccuggccaggguccuggcccugccacuguguggcgagguguccuucuagaccacaucagccccaaggcugggagcagucgcuccagggccgcagcaguucacucccacacauagaacccaggucacugcuggggcgauugaacagguugccuggcuuuucucugcugucaguuugguguggaggccuauguucugccccauacaccccacaggcccugcuuaugggaaggaacacaggccuccagcccagaggacugugccgcccuguucuuggccguccacguuuccucucccucuagcaccagcaauacauuucccuggcauggacagaaaagacagagaggacuuauacaaaggcuuuguaaaaccagaggcuagcuucuaucuuugucuacuguuauuucagcucagggcggguaauuaacaucauuggaacuagcuauuaggaaagaaaaaaaacuugguuuuuuuuacaacaa

SEQ ID NO: 191628 - RNA, 28522 nt, Homo sapiens
cuggggaguaauagcaugggcaaccauuauccugucucgccgccacccaggacauggcuucuguucguaaguccccaucacacguuucuuucugagaaacuggauucgucagccucuuccuuggccuuuggggguggguuugcauaugccugcccaccacagagcacauaccuuuaauagauauaucccaggagguaacuacauguguagaugcauagauuuuuauaaaacugccuuuuucuuauauuuuucagugucaauaaaugugaaguacugaguacuuuaagcuagugcuucucaaacuuuaauaugcauaugaaugucccaggaucucauuaaaaugcugagucagcaagacuggggcgggccugagacucugcauuucuaacccacuuccagguuacacugaugcugucagucagagacccugcuguguagcaagaucuuaaggacuguagaguauucauguaguuugugcuguaauuuaccaacaaauuuccugcuguuggacauuuuugauguuucauuuauuauuauuuuuuuguagaggcagggucucacuguguugcccaggcuggucucaaacuccuggccucaagugaucaucccauccccgucucccaaaggugugagcuaccacacccagccauuuuagauguuucaauagaguuuaugcuuuauucuugccauuauaauuucuguuaacauucaguuuuaguuuuacucuuaaucaguauugagaaaaugcuuuucuuggaaguuuaucuuguuugaugacaggcuacaaacauguaaugcacauuucauuccauucgagauguuucuuaaggggcugcugugugccaaucucuguccuagguuuuagggauacaaaggugaacagaguucuggcucugcagcucauuccuccaggagucugcaaaagaaaauucaguucauugugguaaacagagauagggacgugcccagggauggaugugguggugaaaaaugaccucagagauaaggaaagagaugcuugagcuggguuuaaggaugaaaaguagcucagcaggcagauuauugggugggauuccagauugugagcacauccugugcaaaggcacugaaguaacaauuuggcacauccagguuucuaacaguacuucuuugugcagugugauagacagguuugucacauggagucacagaaucugaaauaagcugggaaccaguaggcagauauguauuuuugaaagacggcuuugaggcgauaaaauugagaucagggcauucgagguaagugacuucuauuaaaggcauguagugaacaggaaaaauucaggagguauuauuggcaggcccuggggauugacugggguugagaaugaaagucugguugaccugcagguuuucaucuuauggcugaacagaugguucagauaccaaagaaugaaaggaauagaagaaaaugccagguuccauuuaggaauguugcuugaggugaagauagcaaacaagacauuagguauacaggucugggcuuaggugagagguccacauuagagagauggauuuggucuucagggagccauugucaccccuagucugaagcuuguacuugucacaaaguuacuggaagugccacagcaucugcugccuaaaaacccaagaauccgaaugcacacgacugcugcaggagucacauguagacaccuucccuugccugcuacuacugcuauccaaagcuucaccaagucaggggaaaagaaagauugccucccagucuuucaccagcacauccuaggaucacaacuuuacgagaagccagcugguaagagagaguucggaaaauauuuacaggcuuauagucugacgggcagaguagaacaagagccagagcacugucuggcucagcaacagagcaccuggaggcggaagcccuggagucuuucucauacucuuaccacagucaucuuuguucucuggagguccacuuuggugugaacugaguaucauuccagucaucucagaaguuuccauuuuaaauaugcacaggcuacagguagccugcugauucccaccacuuggcugacuguacaugaaguaaccacagaauugugguauuugaaaaccuuccaggaucucaguuguucuaacuucucauuuaauaauucagcagauucuucagcaaagguuuauuaauaaggcccucaacacuuauugaaacuauuuugauagaauuauacauaaugauaaaaacucuugcuacacagaauuagaauuaaggaguuaaggaagagauuguuuacaguagcagaaaaaaaaaacuugaaugccuguuuaguuuaagauaaacagauuuuuuucaaagaagaugguaaaacccuaacgggaaaaaugaagugaauaaugaaugagauauaacuucuuccauccaacuaaaaacuauagugaagacauuauuucuuaaauuaauauaugcauuuauuauaauaguaacuagugccuauauuaguuaagauauaauuuugccuuuaauuaaccauuccuuaaacaagacagaagcuuauuccucuaucauagaccaguccagaaguagaguggcagcucucugcccuaugggauugucccaggggccccagcuccuucucuuguuguuccaccauccuugaguaauguccucucugugugguccagaguggcagaucaugguccauauuucagucaggaggcagaggggauacaggagaagccagaguaugccaagggaagcaccuugagaauugcacaggaugcuucugcucauaucccauuggcuaaaacuuagucuugaguccuagcuccaagggagacugggaaauguagucuucauucugggagguacuaugccccacuaaaaauccagagcuguauuaaguugaguuaggggaaagcgaauaugggggagacggaccaaucccuacuacaguacuauuggaauauuauuuagaacuugaaaauugcuaauaaaauuauuucaaaagaauaaauaggcaggcacacaacauauuuuuuaagaaaaguguuuuuaaauugccauauucucucuuuuucuuuuuuuuuuuugauguaacacuucugcuuuuaauguaacuuucuuuuuaaacuuuuuuauuauauaaauuuuaaccauacacagaaguggggagaauuguguagugagcccuagacccaucucccagguuuaguaaguuaucagcuuaaaguuaguuuuaucuauucucccuggcccuccacuuauccccuuccugaguucuugaagcagaucucauuuuugcuauuugaucuguagauauuucuguauguagcucuaaaagguaaaagguccuuuuuaaaaaaaauaaacuuuaaaguuuaggauaauuguauucacaugcgguuguaaaacauaaucuggagagauuuuguguaugcuuuacucauuuucccccaugauagcauccugcaaaacuauaguaccauaucacagcuggaaucugacauggauacagucaagauguagaacaucuccauccucacaagaguccuucguguugcccuuuuauagccauaucuaccuaucuaccuccccuuccacaaccccugacacucacuagucuguucucccuuucuauaauuuugucauuuuaagaauguuaaaaaucagccgggugcaguggcucaugcauguaaucccagcacuuugggaggccgaggcaggugaaucacgaggucaggaguucgacaccagccugacuaacagggugaaacccugucucuacuaaaaauacaaaaauuagccuggcaugguggcaugcgccuguaaucccagccacucaggaggcuaaggcaggacagucacucgaacccaggaggcagagguugcagugagcugagaucacgccacugcacuccagccugggcaacagagcaagacuccgucucagaaaaaaaaaaaaaagaauguugagaaucauacaguauguaacauuuugguaucagcucagcauaguucccucuagauucacccacuuuguugcauguaacaacaguucauucuucuuuauugccaguuacuauuccaugguauggaugcaacauauaaaggcucuuugaaaaccauaauccauccuccuaacucucuccucucuuuuuccccacugcccucuucgccucucuucacagcaaugccaagugaguacaccuaugugaaacugagaagugauugcucgaggccuucccugcaaugguacacccgagcucaaagcaagaugagaaggcccagcuuguuauuaaaagacauccucaaguaaguaccgccccugggacuguagaucccccugcuuugggucaacuguguagaacuaggagaaaaauucagugagagcccucaagauggcuaauguuggagaggcaugcuuggucaaaggaugccucagacauucaaaggcacgucugaguaaagacugagugcacagccggagugagccuguacagcuggcuguauuugguaagugcacagugcccaguagcugcucaggcucucuaccuuggccuggaugccugggagagcagcucucaccgugcacugcucuucaugcccuuauuuaacaaaagagggcuuuucccuuagcuauuguaaguuaaucuaaaauaugguuaauuaaauuucccugaaggcccuugaauacuguuaaauaucgaauacuaaaaaugaugacagguguuugagccaggucacccuuauauccuaauaagugauagaauuaaucaaggaggaacuuggcaggugucuuuuuuuacauauauaccagucaaaccuaguugaaaauugcccuuuuuucaugucuaaacauagaaauccaaccuugcaaucuagucuucugucucacuuuacugacuuaggaaguguaggggaaaaggaaauuuauaagaauaaggcuuauguuacauucagccucccuugagucaccaaccaauauuuauugaggcccaccacguucaugacgucaugcugggcgccagccacaaggcagcaggggagauagaccugcgcccugugcugcuuaggcugugggugagguggacucgcuccaggaauuaaggcacagucugauaugugcuacagacacugggcuugccuucacacccuuuucuuuuauuuuuuuuuuaaaucaaaauaagggaaguguaugcacugaauguaacaccuuuucuggggcugaagagaagaauagguaauauuagguuuucaagauugaaaauucaaaagguauuaaagagucucagugaaacaccuucucaucccugcuccccauuuacccuccauauuuaaagauaaccagugucaccgguuucuuguguauaugagaaauauuuugugugugugugcucugccaugccccgugcccaaacccacuuuuacacaaauugauagcauccuguucacuuaucauuauacauaaucccaacuuguccaaguugucaugggaagccuguuuuaaaugagaauuuuaaaguuuuuaaaacacucccagcaacacuucauuguauucucauccucaaauauuaagaaauauuuugcaucuauuauguauaauauauuaugcuagaugcaauuuuuuugaaaaaaaaacugccccuuuauuuagaaaauggauuacuuucucuuuauuucuugcauuuguuuuuucaagaacagaauuguuuaaagcagugguucuuaaauuuugguugaaacuuuuuagcuugcgguuugugucacuggagaacuuaguaaaaaugagauuucuaaaacuaagacuagacucagcucuuuucuccaagucguguguguguguguguguguguauuaaacuauauaauagugugaauuuaucagaucuguaaaaaauauuuuuuaggucaucuuaaggguaacuaaugguccugucucauuucccagucggccucacuuccggguagaauucuuuagacguacugugaauaaacuguuucuuuucuuuucuuuuuuuuuuuuuuuuuuaaggacugacagaauuuucaggucacaaaagauugaagccgagauucuguaguucaagucuauuacuugauuuuaaguucaauaauugacauugugauucagauuuuguuacagugcucuugcaaaaaaaguuuuuucuguguuugcuuauaacaaagacagucauaaaugacuaguuuaucuugucaggaaaauaggaaauggccccuuccuuucaccccaaugucaacuuaaagauuguaguuuuaugcugcauagcaggcagacucauuuaggauuccguuuucaguuucacauugcaucucaugauucucacaugacuacaucauaauaccuaauugauuuuuuuccagauguacauugcuuguguuuggaguguggauccuuuauauccucaaguuaaauuauacuacugaagaaugugacaugaaaaaaaugcauuauguggacccugaccauguaaagguuagauaucccauuggugugguuuaaaugaaaacauugccaagcauaugcucaaacuauaauaucauuagucuacugugugacaaauauauguuaauaaaaguuugaacucagaggggaaagcacuuaaucucagcacuccaaaaccaaagacaaccuucuucuaaaaacccaccacuaacuacuccacaguauccuucucccauuuacugcagcuggggugugggaugaggugggcucaacccaacaggcucuagggcuccucuccuggaauuaauuugcccugaugcuauaaaguaaacaacaaagaaauucuuucuuuuuucuuuucucccuuuuuuuuuuuuugagucagggucucgcucugcacccaggguugagugcaguggcaagaacacggccaccucagccuucugaguagcugggaccacaggugugcaccaccaugccugacuaauuuuuuuauuuuuuguggagauggggucuugccauguugcccaggcugaucuugaacuccuaggcucaagcuauccucccgccuuggccucccaaaggucggggauuacagacaugagccaccaugccuggccagaaauucucuuaguaucaucuguccuuccuguguuuuauuuuuaauuuuaaugaauucacauugcauugcaagauuuuucuuucagcuuacauuuauguuuccaaaucaagugacauaucaaaugcuuaugucacugauuauuuuaguggcuggauuaucugauaacauuuagcccaggauggaggaagagaugauuuuaaauaaaguagcaugagagggaugauaacugacauguauggaugcuuuauauauauuaucuccuuuagucauugugacugggagauaucccaguaucaucuccaucuuacagaugauggcuugaaagguugagcugcucacccaaguucacgucuaguuuagcuaguuuauaaugugguuuagugcucccgugugccaggaacuguucuaaaaguguauuaguaauauuagcucauuuaacuuucaucacauuccuggggauguaggugcuacaaucauccccaucucacaggcagggaaacugaggagcagggagauuuaguaaccugcccagggucaccagcggcaguacguggugaagcccggcuugaauucaguggugugguuucagagucugagcuccugaccacucugcucucugccugguuagggaguguccacagagaagcccaaaguuaaaagcagcauggugcagagaggaaagagcuuaaauguuuuacccaauucaaaucuaacugccacuuaguaauggugaaacccuaggcaggugacuugauuguuuugagucccaguuuucucaacugugaaauguagaaguugaguaagagaauauauacaaaauuccuuucuugauccuaauuuuuauucauacguuucuacuuuaauuuguacauccuuugaagugccuccaauuuuuuuugugguacagacagguauaaacaaauaaaugaagagcucaguuagcaaaggcacagcuuggcuccugcaaaacuauugagucucagggucuugcuggucgcagggccagccuucccagcauagguguccucaggugucugcuggcucaugucauuucaucagcauuaacacaucugcuuuggucgaguaggauguguccaguacccucugcucaggcuucccuuucuuccuggacugucuggccuugcagacauaccucccccaguccuuugcaauuccacggcgcuucacagcucucuuggauaaagguuuuagacauccugucucuguuuuugucuucugagaaagucuuuaaaugauggcacuugguauggcuuacugauggacugggaacucuucccuuuguuucucugcugcccuucuccacuuucucuuugcauccucuuuuuccuguccauuaccaucugaccaacuguaaagugauuguucuaaagucugggucagcugaggagagaggugcgcucuccuguacaagggccaagaauacuauuccacaagcacaggguggagaagguguguuuuaguaauacccugggggaaaucaacuuaguaguuuuccuguccagccaggcacaucugugucaaccugugccccggcugccugugaucauuuugaacuuaagccacguggucugcuugucucugcaguggucagucaagugcucugguuguuaggcuguuacuuguuaaggcuccccuaaggaauccuagugauuucuaagaaugaccagaggagaaacucaagaucaccucccugaggaaucauggaagggauaggaacaucuguguagccuuaaggagagaagaccugguacagggcacauggcagucagugucaaugagccagagguucagaccgcagaaggaugggccugcccagguggccuuaauggcagagcucuguauagggauggcagccaaucucaaaggagaaagguuugacggucccaggcauccaaagaugggauaaacagaccaccuuuguggugacucucuggggaucuuuaagaaagucaggggucugaccgggugugauggcgcacaccuguaaucccagcaccuugggaggcugaggugggcggaucaugaggucaggaguucgagaccagccuggccaacauggugaaaccccgucucuacuaaaaauacagaaauuagcugggcgugguggcaggcaccuguaaucccagcuacucaggaggcugaggcaggagaaucacuugaacccaagacagggagguugcagugagccaagacugugccauugcacuccagccugggcgacaagagugaaacucugucucaaaaaaaagccagggguccuguagguagaauucagacauuagacagggaggggcucaggggccuuucugaucccuuccaggucugagauucugugguucucagcaauuugccagugccugacuggaagauggaggcugguuucguaaccuggggcuuucaaaguucugaauucuggguggaguugucucaaacgguaggcucucaaagaacaccugcaugcagccuaaccaguccccaacucagugacuuucagacugaaccucacugcuacuuccaagcuccucugaagcuugccacauuccaucgguauuauccuaauucauacgagccucucauccugccaucuaaaguauaaguuacuugagaguagggacuaugucuguaaaaauacauaguacguggcauucuaaggaaagguguagugagcgagggcugcccuuuagagucaccugcucuuccuguuucccugguugugugucuucucaccugccuuccugcauccagccaugccccacuguggccggaguagucguguucuacaauuugaaucuaauauauugcuucccuccuuaaaacucuuuggugccucuccuuuaccuucaggaaaauacccagacuccuuagucuggcccagaagaccguucaugacuugguuccuacugaucucuccagucuuuuugugccaccuccauugucccaacucuauguauuuuaggcacacucaaccccucacagguccuuggguaaaccucuucucuucuuuccuuuucucuuuuuuuuuuuuuuuuuugagacggagucucacucugucucccaggcuggugugcaguggcaugaucucagcucacugcaaccuccaccuccuggguucaagugauucuccugucucagccucccgaguagcugggauuacaggcaugugccaccacacccagcuaauuuuuguauuuuuaauggagaugggguuuugucauguuggccaggcuggucuuaaaccccugaccucgggugauccacccgccucaaccucccaaagugcuaggaugacaggcaugagccacugagcccagcuucuuuucuuuucagcagggccucacgcugucacccaggcugaagugcaguggcccgaucauugcucacugcagccucaacuucccaggcucaagcaauccucccaccucagccuccugaguagcugggacuauagcaugcaccaccauacgugccuauuuuuuuuuuuuuuuuuuuuuuuuuuuuuuugguagaggcagggucuuaccguguuucccaggcuagucgcaaacuccuggacucaagugacucaagugauccuccugccucagccucccaaagugcugggauuauagacaugagccaccaugcccugcccuuaaaacauuuuuauugagauauaauuaacacaccacauaguucacccauuuaaagcauacaguacagccaggcaugguggcuccugucuauaaucccagcuuuuugggaggccgaggcaggaaggaucauuugaggccaggaguuugagaccagccugggcaacauaccaagacaucaucucuauuaaaaauaaaaacauuagccuuguguggugucucacaacuguagucuuagcuacuccagagacuaaggcagaaggaucacuugcgcccaggaguuugagauuacagugagcuauaaucaugccacugcacuccagcccauaaaacagaacagaacaagacacugagaaaaaaaaaagggauacagugcagugauuuugugcaauacacuaugguuuuagugauuuacagaacugugcaaccaucaccaugaucuaaguuuagaagguuuuuaguaucccaaaaagaaacuccauauccauucauagucacucccuauuucccccuccccacaaauccuaggcaaccaguaaucuacuuucugucuguauagauuugccuauuauggacauuucauguuauucauuucauggucuccugugacuggauucuuucacuuaggauaauguuuugaagguacacccauguuguagcauguaucgguacuucauuauuauuucuggauaauaccucauuguauggauauaccucauuuuguuuauccauucaucaguuaguggacauuuggguuguguccacuuuuggcuauuaugaauaaugcugcugugaacauguguauguaaguauuuguguaccuguuuucaguucuuuuauguauauacuaggaauauaguugcugggucauaugguaacuauguuuugcuuuuugaggaacugccaagcuguuuuccaaaaugguugcauuauuuuacauucuuguaagcaagguaccagaguuucaguuucuccgcaucuuuaucaacauuuguuauuaucuuuccuuuuuuacuacugucauccugauagauguuaagugauaucucauugugguuuugauuugcugauagcuaaugaugcugagcaucuuucccaugugcucucauugaccguauguguguuuucuuuggaggaaugcccauucagauccuuugcccauuuuuaauugggcuauuugacuuuuuauucuuaaauuguaagaguucuuucuguguucuggauaccaguacccuauaucugguaugugauuuccaaguauuuucuccacucucuaaguugucuuuucacuuucuuuaggguaucauuuuuagcacaaaagucuuuaauucugaugaaacccaauuuaccuauuuuuccuuuggucauuuaugcuuuuggugucauaucuaagaaacuauuguuuagucccaaguuuucuucuaguauguuuauaacauacuaccucuuacauuuaggucuuugauucguuuugcauuaauuuuuguauaugguauauuaguccauuuucacuacugauaaagacauaccuaagacugggcaauuuacagaagagguuuaauuguaguuacaacuccacauggcaggggaagccucacaaucauggcagaaggcaaggaggagcaagucacgucuuacaugaauggcagcaggcaaaagagagaaacugugcagggaaacucccauuuuuaaaaccaucagaucucaugagacccauucacuaccacaagaacggcacaggaaagaccugcccccaugauucagucaucuaccacuggguccuucccacaacacaugggaauuaugggagcuaccagaugagauuuggguggggacaaagagucaaaccauaucagugugaggucaggguccaaggucauccuuuugcauguuguucuccaguugucccaggaccauuuguugaaaagaacuuuccucuauuugcugcauucuuucuuucuuugcugccuagagccuuucccugcccuucgcccuucuguuacucguauuuuaagucaagucucagcucagcgguuaccccuucuaagaggcuaucccugaucgucccucugugugugugagagagcccccucaugccuuaauccugauguuuaucauuguaggauuucagcuguucaucuuccccacuuguuuuccaggccaggucuugggagacaggggcugugugcuuaacaucuuacauuacuuaauaugcacuuacauauauucaacuucagggggaaggggagauaguacuugaaucacaguguaaucuuccauuaccugugaacucuagauuguacagaaaauccgguuauaacuuguaauucuuugaguacaucaguaaugcaccuuagguuuaaugugaggaacaggacugauaguucucuucaaccuaaacauccacugguagacagggaaaagcccagcacccgcucccugccccuucucccugaaccauggaauguaaguccuuucauuaggcuacugggccaauuuuuagaccuaagcucauggcuggaccaauaguagccuucauagaugccaaugcccuuccuugaugggcuucagugaggacuccugaccaaucacugacgagggggguugggaggacuucugaugggggaguuggccucccugguccuacaccuaccugccuggagaaggagccaaagccacuuaagcaaaacugagcagcagcccacaguguccaucuaccaugucaccccagugcugagcgauuucuaaaagguuacuuuuuucaauuauuuaaaaaaaacaccaaaaauucaaguaauacggaaauaaguaaaggagaaaguccccuguaauuuuucauagagaaagaggaaggaauggggggcagcuguguaagucaaacauguuuguaaaacuccgugaguuugaaacuaguaaaauagaaagugaaagccugcuauaauuaugguggaauugagggugucuuauuguguuacuagagaauuuuuuuaaguagguuuuuaacauuuugaccuuguuaaaaugcuccacuuuucaaaacgguccugacaggauauccugcuuccuuccacgcagaagaggugguuugugcagaagugcaggccucagaaugcuuugcacaugagaggaauggcaagaguugccuaucacugaggauuuggggaggagggaucacaggauaugggacugaaaaugagacagggccagauagcaaaaggccuugaaugcuacacuaagcacgaagcagcuccuuaauuugugcaucacugaagcaagaauagaguggaggacauggcccgugugguccucguguucugaguggcuaugacauggaguucugugugagcucuccaugaagaaaaucccgucuccaggcagucaguggagauuugauccuuaccacaagagcacguggacaaauuugaauuaucguggauguauaugggcagaagaaggucucagagccauaaggguggggcccuguuagcucuguugguuccacucagcagcccacagugugagugggacccugccagcccugcuagacuugagcauugucuggugacgcugguccccgccuucauuacugcagcagaggaaguguggcuguggcaguuguggguuuuguauuuucuauuuaaauaugucccuuaaugugccaguuguuaaaaagacuaccagugggcucugaagggaugccuggacacuuugaaagugugguucagaugugaaauugcacucaaaagauguuuuaagagagacgagggcacguugaugucaguuucgguuugggcuguguaguagcagcauuuugaacuuggcccucucuccuuucugagagcuaaagaccuuaucucccugcggauggcauugcgugcaguuaauuauggccagauggacucagccgcuucuucaucgucuucucucggacucugcagaccuacaccgugccuuuaaaggaagcagggcccucccugcugaagcauucagugagcccaggcaccagcaucuucaaaccgagucuuuucucuccuuagugcugcuccccgcuuuccaggccuuccugggauaucuuagagguaagaaaacugaagccucgaccuagggagaaaugcuuuaacaaagacgacgcugcuaguuaaaucaaucuagaacugaguccagccuccagaucuccugauuauuuuuuuuucuaacaguugaugggaugaaaucuacauaagauuuaauccuuugaagcccauuguuugaugaguauuaaaaacuuaugcagccacgccucugucaccacaaucccgcuuuagcacauucccauggcccaagcgaguuccccggagccccucugcagucaguccccacccucaaccccaccccaggcuuccaccaacugguugaguuuauaguguaguguuauuuccaugacuugguuauuuaaauuuuuuucugcuucuaacuggguaagaguuauaacuuaaaugugaguaaaauaugucaauaacgugacccucaguuauuguccuugugugauaucauacaagucuccacacaugccagguacugggcaaaaugcuuagggcaucagagcaaccugcgaagaagcgaccagcaccagaguuuacaggugugggaaaugaaaguuccacaaggucacugaugcccccagaucacgugauccauggcagaauugagcuccuucccacaucucauuaaugccagacacaaguuuucuuucaaucugaaugcucugcccuguuccggauuuuuaaaaaauaauaagugcaauagaacauugccuuuuacuaagaauuaugccacuuacuuguauuucugagaaggguuguccuuaagauuucagaguggaaaugaaaguggggauuuugcugaggaaaauuacuuugauuguuuuuaauaccuuucugugaauuucacaugauguuuuuauggcacacugccacagcauuaacaauuggcacuaccagaugucuacuuugucuuaauugugggcaaccugcaagcgcagccuggaagauguuaaaaacugaaaccuuuauuuuugucccuggauauaagacgaacgggaguucuuguauuuuacgagagagucaccagcuccuggcuuccagugagccucaucuggaugaaugccacccaggccccagcugacgccucugaggccuuccugggagcucuggaguccucacagccuagucacacugcuuccucucuucauugcagcuccugaaggugcggcacucgccuugaggcacuuucuucugagcugugagcuaugggcaagcaguggagggggaagagagcagcugaagcagaugccgguucaacuuacuuaaagaugugggacaagcucugaggaagcccccaagacaaugaugucugguugugcaccauugaagcaagaacagaaaccaucccagaguggaggacauggcccaugugguccuccuguucugaguggcuaugagauggaguucugugugagcucucuacagaaaaagcccugucuccaggcaaucaguggagaucuguuaaacgaguugaaacaaaagaggacaaggaauugcuguggcuuuagacguugccaggacauguagaaacucacucaggauuuacuacugcauccacugucacuuaggcgcaggaggggucacagucagaaggugacuacugagaaaugugcccuacccacagucuagaaaauuaaguuugggcugggcgugguggcucacaucuauaaucccagaacuuuggaagguggaggcagguggaucacuaggucaggaguuugagaccagccugaccaacauggugaaaccccgucuguacugaaaauacaaaaaguagccgggugugucagugcacgccuguaaucccagcuacucaggaaccugaggcaggagaauggcuugaaacugggaggcagagguugcagugagcugaaauugcgccacugcacuccagccugggugacagagcgagacucugucucaaaaaaaaaaaaagaaaaaaaaagaagaaaauuaaguuugaaaccugaaauuaaccucuuggugagaauggaaauggaaugaaauuucacuccuuuccagaugcagcuucugaagaggagaccuggcagccuggcgagcauccagcucgcucacgcaccucuuucuagucccguggccaucagugagcuucuccgggucccucuugccacuucucagauguuccuuucuguccuaggagauuuguaaaaccagauacuuaggauaugauucucuaguggaggguuaggccuuuaggucucuaaaaauugccauucaugaccuucgggccuaggguuuugagaugaaugugcaguguguguggccgcucugugugucccgcuuccaccagcuuggcauuaagcacccggagcaucaccugcugggcaggccuggccaggggugagccccuccauucgggggcucagggucaaggcagauuccuugcuuggcuuuccugcugauuuccucaugaagaugccaauucguauuuaaacauuuguuaucaauggugguguuugugugcugauuucuauagguagaggcuguuguuuuaggagccagguuugcugggccagcucagaccucuuacaaagugaagauacuaaugaucgucuugcaaggugccauagugucgugagggugaacugaggcaguggcuaugcauggugucugcagcagcguuucugaggcuccaagaauaucaguuccuuuuucagaaauggggccagauucuucggauguagacaguguucucuucacggaugcuaacaacuuaucaaagcuauaauauauuaaguaucucuguuauaauaggauagaugcauuccuaaaaaaauguguuaagcaaaaaucagaaaaugaaaauaaaaauaacaaggccuugaggaaaagcauaguugggaugaacauuuaaaccuauaccccaguaauaauccucauaaugauacugacaaaguugaaaagauauguugaauuccuaauaaauaucccaguaaauauaggauuacacacacacacacacacacacacacacacacacuucugccugugagaagguagugaauaggaggaguaaugcagggccaauuccaaggcugcuaaauauggagacaaggauaaaaaagcacaaagauaggaagaacuaccugacagggguucugagucagcauuuguccagcugagccaagaggaagacuggggugaauggacacgcauaccauauuccuccaagguugcguuuuuguuuuuugggggguuuuuuguuuguuuuuuuguuuuuugagacagagucucgcucuguugcccaggcuggaguauaguggcacgaucucggcucacugcaagcucugccucccggguucacaccauucuccugccucagccucccgaguagcugggacuacaggugcccaccaccacgugcccggcuaauuuuuguauuuuuaguagagacgaguuucaccguauuagccaggauggucauguuuuuguucuuguuuuuguuuuagagacagggucucccucugucacccaggcuggagugcaguggcacaaucacagcucacuacagugucaaccuuccagguugaggaucacucgauacucaugccucagccucccauguagcuggggccacaggggcacaccaccacuccugacccauuuuuuaaaaaauuuuuuguauagguggggucucaccauguugcccaggcuagccucgaacuccugggcucaagcaacccucucaccuuggccucccaaagugcugagauuauaggugugacccgccaugcccgccuuuccucugaguuuuguugcauucacgcagcuccuggcugaggcaaaacauuaaaaugcauauggaaaugcaggcugggaaaaugcuuugaaaccaaugcaauuucuguguuaaggggacauucccugauucuuucagguaauuugcauucuagacugugacauucuguaucucaacugauaaauaagccuguuugucauccugcuagaugagaaccugauauaugaaaccuuuuuuuuaaucgugguuaaaaaaaacauaaaauuuaccaucauaauuauuuuuaaauguaccauuuggcagcauuaaguauauuuaaacucuugugaaacaaauuucuagaauguuuucaucuugcaaaaccgaaacgcuguaccuauuaaacaacuccccuuuucucccucucuucaacccugguaaccauguuuuuaugaauuugacuacuuuagauaccucauauaagucaggucauacaguauuugucucuuugugacuggcuucacuuagcauaauguccucaaaguuuaacuauguuguagcauguaucagaauuuuaugaaacaugaagucuuagacaccccgaaguacauuuucaccccaaauguauuugaacaguguuaggcugggggugggaggcgggaguccuucuugcuuugccugugcaaugaaaugaauacccugcuguguuuaucuccuugucaugugauucucccagguuguuucuucaaguuucugagccaaacuuaacucuaaaaagcaaauauucuguguuaaaagacaguaaucaacacgggagcuacaucagacaucauaggacaaauugucaucuagaagaguauauuuuuaaugcaggagaguuuuuaaaacccagauuggugugauuucauuccagagagcucagaaauaugcucagcaagucuugcagaaggaaugucgucccaaguuugccaagacaucaauggcgcuguuauuugagcacagguauagcguggacuuacucccuuuugugcagaaggcccccaaagacagugaagcugaguccaaguacgauccuccuuuuggguuccggaaguucuccaguaaaguccagacccucuuggaacucuugccagagcacgaccucccugaacacuugaaagccaagaccugucggcgcugugugguuauuggaagcggaggaauacugcacggauuagaacugggccacacccugaaccaguucgauguugugauaagguacauugguuuuuuuuguuuguuuguuuacuuauuuuuauuguuuuuauuuuauuuuauuuuuugaggcagggucucacuccuguuguccaggcuggagugcaguggugugaucucagcucacugcagccucaacuucccaggcucaggagauccucccaccacagccuccccaguagcugggaccccaggcacacaccacgcguggcuaauuuuuuauauuuuuaguagagaugggguuucuccgaauugcccagacugggguacaucgcuuuuaaaaccaaccuuucuccucuagaacucagugcacugcucuuggucaguguggcuccaggaacagugagggacacaggaagcucuucacagucccugcccacaagggacuuaacguuugagaaguugaaacaaaaacacaaaaugguuggaugcuccaaacugucauacugacccuaaguuggaggagcaugcugcuggcuacaguaaguggcagaaccuugucagaggaagugagauuuggaagguggguagauucaaguaaaacagcaaaggaccacaacucccagacaggggcaagaagaggacacagcaagagacuugagucaaugaggggccuggcuucuggagaaggggcuuggggccagugaguccuggaaggcagugcuggcugggacauggaaggcacacagagaaguucagacucaccaugauagccaauaggcagucauccuagauucuuuuuugguuucacuguuuaaaaauuguuuucuggccaggcgcaguggcucaugccuauaaucccagcacuuugggaggccaaggcaggaggaucgcuugagcucaggaguucaagaccagccugggcaacauagagacagcuugucucuacagaaaaucaaaaagucagccaggcaugguggacuagauuuucccuucugauuccuuuuuugaaauucuggcaagaacuaacaucugagcacaauggaaaauuucugaggauauuuuacuggcacccagagaaagucccaaauguaauaugcuuagauugaguaaaaauauuagggcuagaugaaauugcuugacauucagggauuagauacaaguguucgcucaaguacuaaaggcugcauuccucgaaauccuagaaagacagagcugggaggggagaugaggcugcaaaccaugcacucauucuuagucauaagaagacguggaggacaugacauggauacugccugguguacagagaugguugauggccugcuuugucagugugucuuuguccuuuuuauuuaaauagguuaaacagugcaccaguugagggauauucagaacauguuggaaauaaaacuacuauaaggaugacuuauccagagggcgcaccacugucugaccuugaauauuauuccaaugacuuauuuguugcuguuuuauuuaagaguguugauuucaacuggcuucaagcaaugguaaaaaaggaaacccugguaagcacuaauacuucuauuaaaucugccuuaguaaaaagugaaggagucuuacuuaguuguaauuauagccuuuuauuuuuaaacacgcagagcggaaugcauacuuauguguugucuuucaaaugaugaucacucucuuuguagaaaccccucagcaauucuuuuuuuuggggauggagucucauucuguuguccaggcuagagggcuggagugcaguggugcagucuuggcucucugcagccuccgcaucccagguucaagcaauucuccugccucagccucccgaguagcuaggauuacaggcgccugccaccacgcccaguuaauuuuuguauuuuuaauagagaugggguuucaccauguuggccaggcuggucucaaacuccugaccucaggagauccacccgccucagccuccaaaagugcugggauuacaaacaugagccacugcaccuggcccucuuccagugguucuugcacaugggcagguuggagaauuccugguagagacaguggugaggguguuuauaauuuaaacugaacaaauacuaggagcuagugggagauuuguugggugcggucucagcaccggcacuuccucagugcuuuugauuucaugggugaaauuucacacuccugagagacaaaugagacccugccccccaguugaaaucggaaaguaccauacagugggaguauuuuuccuuuugguggcgggaauggagugagaugguuauaaagaggcccugcugcaguugugucaauccaggagugggugcuuuccuccuaugucuguguacagcuguacacucugcauggaugggccagaccuaauuaagagucgcaugaaaauggugaucauugcuuaaugggaauauccagauugugaccaaaauugcuguuacugagguuguucacccaccuuguucuccagacaugaacuugcauagcuuuuggcuaguuccagaaauuagacuuacuuagauggauauaagccuuuuugaggguauucaaaagcauauaaaaaucaaggaauacucuaaagagcuccaaaaaugcuuuggucagugguucccuuguuggaauaaauucauggcauuccagaagggcagcuauggaggagauggcccucacuuggucauauuccuuuugucuuuauuggucacauuacuuuauagucucacccauuauauucaaauacauuucagaggucagcugucgaggaguguaugcacauguauagacauaugcacaaacuagcugucugugaaacuaaugggacguauucaacuuuucacguaaacuccaugugaugacaaauuuguauuuccaaagcugauucuauaucagucaucauggucuucuggauuuucuauugggcagaaguucuaguuggaagaugaagcauauaugaaacgacuucaugggacuaggaaauagaguaagugagagaggaugcgaggugagggcaguuucagcacuuaauagccuuaaauuggaccuauucacuugggcuucccuagacaaaaugaugguguuagcaccauugaggaaugucuaccucaaacaaauacaagcugguucugcaauucaucucuuuguccagugccgccugugugaaguggcuauuucagaguuacuuuuuugaguuggagugccggauuugcguagcuuuugcaaucuauaggaguagauugcuucagaaggcagugcacagggccacauggggucacacccacagccuuggucugaugagugggaaugcuuucuccccuccccuagaaggaugacuaacaacugcuugcuugcuuuccuuagccauucuggguacgacucuucuuuuggaagcagguggcagaaaaaaucccacugcagccaaaacauuucaggauuuugaauccaguuaucaucaaagagacugccuuugacauccuucaguacucagagccucagucaagguucuggggccgagauaagguauuuuuguugcuacucaaaguuaaucauucccuguuugaggggcgauguguacaaauuucacuuuggcucaacuguauacccagaagcaucuccaguggagaaacccagccugugauuagaugcuccauguguguuuaccacucugcacuuggcugcagggcuccucauuguuuaauuggccuucucuccagugacucuucucuuuaguguaggcagcacauuaacacuugaaucacugagauacuauuuuaagguauucuuacuccaggacuccauauaacugcaggacacugaaaggcacuuucaugaucugaaaaguuauuuacauuuuauuuuuuaauuuuuuaaaaauuuaaaaaauuuuguaccccagagaaaagucauauuuacauuuucacucugugggccauucaggugaguauugauuuuuaucaucacuuuguaggugauaguuauaaaaguuaauccucaagaacaguguuuuucaguuaaugccugggucucaucucagacauucuaauuguuuuguguuuuaagauuuucuaaauuccguggacgauuuuuauuuugcagccuaauuugggaacuuugugcucuaggcuguuuauugcaguagagauucuuuaccugcaauuagcaagugcugccaccaggggcgugggggugugcaugccuuuauuacuugcggcuucuugaucugaauaacuugacuggugucuuuaaaacuuaagaccuguguggaaauuaucacauguacaaugagaauaaacacucucagaauacaaagagcucuuacuaaaucaaagagaaaaagaugaaccaauagaaaaugggcaaaaaauaggaauagacauuucacaaaagaagaauuaaaauagccaaagaauacauguaaaaauguucaacuuuaccaauaaucaaauaaaagcaaauuagagccacaauaguauuuuugcccauuuucuuagcaaagacuuaaaaguuugauaauguccuuguuuggcaggaauguagguagaaugaucagcuggcacuuuuucuggaggauauuuuggcaauauuaaaccauuuuaaauacgaaucaucucugacccaccaauuuuacacuaaaaacauuauuacaaggaaauuagagaaauuuauaaagauggauauucuaggauguacacuauagcauuaacagcagaggacuaaaaacagccuaaauguucauuauuaugggauuguuuaaacaaauuaugauaaagucaaugcaguauugucuguuaaggaugaagaauauaggaaaacaccuccauaguauauuaagugagaaaauaaacauacaaaacacuaggcugggcgcgguugcagacgccuguaaucccagcacuuugggaggcugaggcgggcagaucaccugaggucaggaguucgagaccagccugaccaacauggagaaacccugucucuacuaaaaauaaaauuagccaggcgugguggcgcgugccuguaauuucagcuacuugggaggcugaggcaggagaaucgcuugaccugggaggcggagguugcaaugagccgagaucgccccauugcacuccagccugggcaacaagagugaaacuccaucuuaaaaaaaaaaaaaaaagauacagaacacuuuaacaauaaaaguauguguuuaguauaaaagcuuggaaauagacaccagccugugaagaaugcccuucuucagaggggaagucuauagaagacuucuacuuucugcuuuauaaucugucuguuaguugaacugaauauuuuccuauuuuuauaauugauaaaauggcauuuuucuuuuggauaaaaacaguaacuuaaaagaggacuucugaucuaaaguugcaguaucagaaacuuccucauguauauguccuuccagcagaugaagaagccuguugagcaguaggagaugugaucucaaagggcaugcuauagagaugacaugcuuuggggaguuuuucaucgguuuuuuaguucucuccauauaucaccccaauggacaguugauuucacacacuccuucgacaaacauugaauauucccugugugacaagauggucacuggggguacaugguuggagaagacagaacaacgccuagagcccuggcuaaacaggaggaaaguguccuuuguguuaauuucucuugguuucuauuuccaagcaugcagaauggcuguugaguuccuuuuuaacaggugagguuggcuuugagagguagaugcaucaaggagcaggaagcagauuuuaacaaaugauggcuucaguagauguucccuaaucccaccugaaucugugaacucuggaggguccacuguuguuccacuuuacaaaaaagaagaguuauauuuauggcagccacaagcucaacuaagaugaaugaaaagagaggcacauuuuuccaugaaaaacuauacaaaaggaugcuaauaguaagaguaguaguagauugguggcagccuuugaggaggccuagugagcugcagggccuucuguauuccucccuguccuguguacuguuuuuacccaaggcuggcauggagauccagaaagcacgaugucagauuugcacauuccaggaagcaagacaagaugccagacaugaggagggaguggggacaccaucagaaucuagaaagguuuagacaauggagauucuaggccaaggucaguaggauacauuuuuaaaggaacaaauguggaaauauuuaauucaggacuaaaaauguacuugaggcuggacaugguggcccauggcuguaaucccaacacuuugggaagccaagacgggaggauugcuugagcccaggaguucgagaccagccugggcaacauggugaaacccuauuucuacaaaaaaauacaaaaaguagcugggcaugguggcacaugccuguagucccagcuacucaggaagcugaggugggaggaucaccugagccugugaaggucaaggcugcagugagccgugaucgcgccacuguaccccaaccugggcaacagagugagaccgaugcugucucaaaaaaaaaaacaaaauuuacuugcccaaacagacggugggaagaaacuggcuuagcagcucuacauagggaaauggccuggaagugcuauuugccagcaaagccaauggggcccuuaagugggauguagcugcuggugugugaacacagucuucugcagugagaacugagaauccucuguucucaggaagggaugggcuccagaaacugugcccugggaaggaccguggaagguccuguggccaccucucccagagcagaccucauagacauuugucauugagagaggaaguaggcuuuuuuuuuuauuuuuuuuuuuaaugauucugggcaucacauauaggaaggaccagugggguagacauuuuagaaggaaugccuuuuuuuuuuuuuuuuuuuuuuuugagacagagucuugcucugucgccaggguggagugcaguggcucgaucucggcucacugcagccuccgccuccuggguucaagugauucuccugccucagccuccugaguagcugggacuacaggcgugugccaccacaccuggcuaaauuuuguauuuuuaguagagacaggguuucaccauauuggccaggcuggucucaaacucuugaccucgugauccgcccaccucggccucccagagugcugggauuacaggcgugagccaccgcaccuggccuagaaggggaauaccuuuuaacuugguguaagaauugucaggcugccccuugaaagugugugaacaucacagaccauguuuuagagccuagauuccugacuuaaauggagaguuggacucuaaaguucaugauguauaaaauuaugugauguaugaaauugcagcccccaauguagcuuucaugacucugcguagcauguguaauaccagcaaaauggugacuugugccaaaauuuuuuuuuacuuuuuggucuucuuuucccuuucucagaacguccccacaaucggugucauugccguugucuuagccacacaucugugcgaugaagucaguuuggcggguuuuggauaugaccucaaucaacccagaacaccuuugcacuacuucgacagucaaugcauggcugcuaugaacuuucagaccaugcauaaugugacaacggaaaccaaguuccucuuaaagcuggucaaagagggaguggugaaagaucucaguggaggcauugaucgugaauuuugaacacagaaaaccucaguugaaaaugcaacucuaacucugagagcuguuuuugacagccuucuugauguauuucuccauccugcagauacuuugaagugcagcucauguuuuuaacuuuuaauuuaaaaacacaaaaaaaauuuuagcucuucccacuuuuuuuuuccuauuuauuugaggucaguguuuguuuuugcacaccauuuuguaaaugaaacuuaagaauugaauuggaaagacuucucaaagagaauuguauguaacgauguuguauugauuuuuaagaaaguaauuuaauuuguaaaacuucugcucguuuacacugcacauugaauacagguaacuaauuggaaggagaggggaggucacucuuuugaugguggcccugaaccucauucugguucccugcugcgcugcuuggugugacccacggaggauccacucccaggaugacgugcuccguagcucugcugcugauacugggucugcgaugcagcggcgugaggccugggcugguuggagaaggucacaacccuucucuguuggucugccuucugcugaaagacucgagaaccaaccagggaagcuguccuggaggucccuggucggagagggacauagaaucugugaccucugacaacugugaagccacccugggcuacagaaaccacagucuucccagcaauuauuacaauucuugaauuccuuggggauuuuuuacugcccuuucaaagcacuuaaguguuagaucuaacguguuccagugucugucugaggugacuuaaaaaaucagaacaaaacuucuauuauccagagucaugggagaguacacccuuuccaggaauaauguuuugggaaacacugaaaugaaaucuucccaguauuauaaauuguguauuuaaaaaaaagaaacuuuucugaaugccuaccuggcgguguauaccaggcagugugccaguuuaaaaagaugaaaaagaauaaaaacuuuugaggaa

SEQ ID NO: 191629 - RNA, 28522 nt, Homo sapiens
uuccucaaaaguuuuuauucuuuuucaucuuuuuaaacuggcacacugccugguauacaccgccagguaggcauucagaaaaguuucuuuuuuuuaaauacacaauuuauaauacugggaagauuucauuucaguguuucccaaaacauuauuccuggaaaggguguacucucccaugacucuggauaauagaaguuuuguucugauuuuuuaagucaccucagacagacacuggaacacguuagaucuaacacuuaagugcuuugaaagggcaguaaaaaauccccaaggaauucaagaauuguaauaauugcugggaagacugugguuucuguagcccaggguggcuucacaguugucagaggucacagauucuaugucccucuccgaccagggaccuccaggacagcuucccugguugguucucgagucuuucagcagaaggcagaccaacagagaaggguugugaccuucuccaaccagcccaggccucacgccgcugcaucgcagacccaguaucagcagcagagcuacggagcacgucauccugggaguggauccuccgugggucacaccaagcagcgcagcagggaaccagaaugagguucagggccaccaucaaaagagugaccuccccucuccuuccaauuaguuaccuguauucaaugugcaguguaaacgagcagaaguuuuacaaauuaaauuacuuucuuaaaaaucaauacaacaucguuacauacaauucucuuugagaagucuuuccaauucaauucuuaaguuucauuuacaaaauggugugcaaaaacaaacacugaccucaaauaaauaggaaaaaaaaagugggaagagcuaaaauuuuuuuuguguuuuuaaauuaaaaguuaaaaacaugagcugcacuucaaaguaucugcaggauggagaaauacaucaagaaggcugucaaaaacagcucucagaguuagaguugcauuuucaacugagguuuucuguguucaaaauucacgaucaaugccuccacugagaucuuucaccacucccucuuugaccagcuuuaagaggaacuugguuuccguugucacauuaugcauggucugaaaguucauagcagccaugcauugacugucgaaguagugcaaagguguucuggguugauugaggucauauccaaaacccgccaaacugacuucaucgcacagauguguggcuaagacaacggcaaugacaccgauuguggggacguucugagaaagggaaaagaagaccaaaaaguaaaaaaaaauuuuggcacaagucaccauuuugcugguauuacacaugcuacgcagagucaugaaagcuacauugggggcugcaauuucauacaucacauaauuuuauacaucaugaacuuuagaguccaacucuccauuuaagucaggaaucuaggcucuaaaacauggucugugauguucacacacuuucaaggggcagccugacaauucuuacaccaaguuaaaagguauuccccuucuaggccaggugcgguggcucacgccuguaaucccagcacucugggaggccgaggugggcggaucacgaggucaagaguuugagaccagccuggccaauauggugaaacccugucucuacuaaaaauacaaaauuuagccaggugugguggcacacgccuguagucccagcuacucaggaggcugaggcaggagaaucacuugaacccaggaggcggaggcugcagugagccgagaucgagccacugcacuccacccuggcgacagagcaagacucugucucaaaaaaaaaaaaaaaaaaaaaaaaggcauuccuucuaaaaugucuaccccacugguccuuccuauaugugaugcccagaaucauuaaaaaaaaaaauaaaaaaaaaagccuacuuccucucucaaugacaaaugucuaugaggucugcucugggagagguggccacaggaccuuccacgguccuucccagggcacaguuucuggagcccaucccuuccugagaacagaggauucucaguucucacugcagaagacuguguucacacaccagcagcuacaucccacuuaagggccccauuggcuuugcuggcaaauagcacuuccaggccauuucccuauguagagcugcuaagccaguuucuucccaccgucuguuugggcaaguaaauuuuguuuuuuuuuuugagacagcaucggucucacucuguugcccagguugggguacaguggcgcgaucacggcucacugcagccuugaccuucacaggcucaggugauccucccaccucagcuuccugaguagcugggacuacaggcaugugccaccaugcccagcuacuuuuuguauuuuuuuguagaaauaggguuucaccauguugcccaggcuggucucgaacuccugggcucaagcaauccucccgucuuggcuucccaaaguguugggauuacagccaugggccaccauguccagccucaaguacauuuuuaguccugaauuaaauauuuccacauuuguuccuuuaaaaauguauccuacugaccuuggccuagaaucuccauugucuaaaccuuucuagauucugaugguguccccacucccuccucaugucuggcaucuugucuugcuuccuggaaugugcaaaucugacaucgugcuuucuggaucuccaugccagccuuggguaaaaacaguacacaggacagggaggaauacagaaggcccugcagcucacuaggccuccucaaaggcugccaccaaucuacuacuacucuuacuauuagcauccuuuuguauaguuuuucauggaaaaaugugccucucuuuucauucaucuuaguugagcuuguggcugccauaaauauaacucuucuuuuuuguaaaguggaacaacaguggacccuccagaguucacagauucaggugggauuagggaacaucuacugaagccaucauuuguuaaaaucugcuuccugcuccuugaugcaucuaccucucaaagccaaccucaccuguuaaaaaggaacucaacagccauucugcaugcuuggaaauagaaaccaagagaaauuaacacaaaggacacuuuccuccuguuuagccagggcucuaggcguuguucugucuucuccaaccauguacccccagugaccaucuugucacacagggaauauucaauguuugucgaaggagugugugaaaucaacuguccauuggggugauauauggagagaacuaaaaaaccgaugaaaaacuccccaaagcaugucaucucuauagcaugcccuuugagaucacaucuccuacugcucaacaggcuucuucaucugcuggaaggacauauacaugaggaaguuucugauacugcaacuuuagaucagaaguccucuuuuaaguuacuguuuuuauccaaaagaaaaaugccauuuuaucaauuauaaaaauaggaaaauauucaguucaacuaacagacagauuauaaagcagaaaguagaagucuucuauagacuuccccucugaagaagggcauucuucacaggcuggugucuauuuccaagcuuuuauacuaaacacauacuuuuauuguuaaaguguucuguaucuuuuuuuuuuuuuuuuaagauggaguuucacucuuguugcccaggcuggagugcaauggggcgaucucggcucauugcaaccuccgccucccaggucaagcgauucuccugccucagccucccaaguagcugaaauuacaggcacgcgccaccacgccuggcuaauuuuauuuuuaguagagacaggguuucuccauguuggucaggcuggucucgaacuccugaccucaggugaucugcccgccucagccucccaaagugcugggauuacaggcgucugcaaccgcgcccagccuaguguuuuguauguuuauuuucucacuuaauauacuauggagguguuuuccuauauucuucauccuuaacagacaauacugcauugacuuuaucauaauuuguuuaaacaaucccauaauaaugaacauuuaggcuguuuuuaguccucugcuguuaaugcuauaguguacauccuagaauauccaucuuuauaaauuucucuaauuuccuuguaauaauguuuuuaguguaaaauuggugggucagagaugauucguauuuaaaaugguuuaauauugccaaaauauccuccagaaaaagugccagcugaucauucuaccuacauuccugccaaacaaggacauuaucaaacuuuuaagucuuugcuaagaaaaugggcaaaaauacuauuguggcucuaauuugcuuuuauuugauuauugguaaaguugaacauuuuuacauguauucuuuggcuauuuuaauucuucuuuugugaaaugucuauuccuauuuuuugcccauuuucuauugguucaucuuuuucucuuugauuuaguaagagcucuuuguauucugagaguguuuauucucauuguacaugugauaauuuccacacaggucuuaaguuuuaaagacaccagucaaguuauucagaucaagaagccgcaaguaauaaaggcaugcacacccccacgccccugguggcagcacuugcuaauugcagguaaagaaucucuacugcaauaaacagccuagagcacaaaguucccaaauuaggcugcaaaauaaaaaucguccacggaauuuagaaaaucuuaaaacacaaaacaauuagaaugucugagaugagacccaggcauuaacugaaaaacacuguucuugaggauuaacuuuuauaacuaucaccuacaaagugaugauaaaaaucaauacucaccugaauggcccacagagugaaaauguaaauaugacuuuucucugggguacaaaauuuuuuaaauuuuuaaaaaauuaaaaaauaaaauguaaauaacuuuucagaucaugaaagugccuuucaguguccugcaguuauauggaguccuggaguaagaauaccuuaaaauaguaucucagugauucaaguguuaaugugcugccuacacuaaagagaagagucacuggagagaaggccaauuaaacaaugaggagcccugcagccaagugcagagugguaaacacacauggagcaucuaaucacaggcuggguuucuccacuggagaugcuucuggguauacaguugagccaaagugaaauuuguacacaucgccccucaaacagggaaugauuaacuuugaguagcaacaaaaauaccuuaucucggccccagaaccuugacugaggcucugaguacugaaggaugucaaaggcagucucuuugaugauaacuggauucaaaauccugaaauguuuuggcugcagugggauuuuuucugccaccugcuuccaaaagaagagucguacccagaauggcuaaggaaagcaagcaagcaguuguuagucauccuucuaggggaggggagaaagcauucccacucaucagaccaaggcugugggugugaccccauguggcccugugcacugccuucugaagcaaucuacuccuauagauugcaaaagcuacgcaaauccggcacuccaacucaaaaaaguaacucugaaauagccacuucacacaggcggcacuggacaaagagaugaauugcagaaccagcuuguauuuguuugagguagacauuccucaauggugcuaacaccaucauuuugucuagggaagcccaagugaauagguccaauuuaaggcuauuaagugcugaaacugcccucaccucgcauccucucucacuuacucuauuuccuagucccaugaagucguuucauauaugcuucaucuuccaacuagaacuucugcccaauagaaaauccagaagaccaugaugacugauauagaaucagcuuuggaaauacaaauuugucaucacauggaguuuacgugaaaaguugaauacgucccauuaguuucacagacagcuaguuugugcauaugucuauacaugugcauacacuccucgacagcugaccucugaaauguauuugaauauaaugggugagacuauaaaguaaugugaccaauaaagacaaaaggaauaugaccaagugagggccaucuccuccauagcugcccuucuggaaugccaugaauuuauuccaacaagggaaccacugaccaaagcauuuuuggagcucuuuagaguauuccuugauuuuuauaugcuuuugaauacccucaaaaaggcuuauauccaucuaaguaagucuaauuucuggaacuagccaaaagcuaugcaaguucaugucuggagaacaaggugggugaacaaccucaguaacagcaauuuuggucacaaucuggauauucccauuaagcaaugaucaccauuuucaugcgacucuuaauuaggucuggcccauccaugcagaguguacagcuguacacagacauaggaggaaagcacccacuccuggauugacacaacugcagcagggccucuuuauaaccaucucacuccauucccgccaccaaaaggaaaaauacucccacuguaugguacuuuccgauuucaacuggggggcagggucucauuugucucucaggagugugaaauuucacccaugaaaucaaaagcacugaggaagugccggugcugagaccgcacccaacaaaucucccacuagcuccuaguauuuguucaguuuaaauuauaaacacccucaccacugucucuaccaggaauucuccaaccugcccaugugcaagaaccacuggaagagggccaggugcaguggcucauguuuguaaucccagcacuuuuggaggcugaggcggguggaucuccugaggucaggaguuugagaccagccuggccaacauggugaaaccccaucucuauuaaaaauacaaaaauuaacugggcgugguggcaggcgccuguaauccuagcuacucgggaggcugaggcaggagaauugcuugaaccugggaugcggaggcugcagagagccaagacugcaccacugcacuccagcccucuagccuggacaacagaaugagacuccauccccaaaaaaaagaauugcugagggguuucuacaaagagagugaucaucauuugaaagacaacacauaaguaugcauuccgcucugcguguuuaaaaauaaaaggcuauaauuacaacuaaguaagacuccuucacuuuuuacuaaggcagauuuaauagaaguauuagugcuuaccaggguuuccuuuuuuaccauugcuugaagccaguugaaaucaacacucuuaaauaaaacagcaacaaauaagucauuggaauaauauucaaggucagacaguggugcgcccucuggauaagucauccuuauaguaguuuuauuuccaacauguucugaauaucccucaacuggugcacuguuuaaccuauuuaaauaaaaaggacaaagacacacugacaaagcaggccaucaaccaucucuguacaccaggcaguauccaugucauguccuccacgucuucuuaugacuaagaaugagugcaugguuugcagccucaucuccccucccagcucugucuuucuaggauuucgaggaaugcagccuuuaguacuugagcgaacacuuguaucuaaucccugaaugucaagcaauuucaucuagcccuaauauuuuuacucaaucuaagcauauuacauuugggacuuucucugggugccaguaaaauauccucagaaauuuuccauugugcucagauguuaguucuugccagaauuucaaaaaaggaaucagaagggaaaaucuaguccaccaugccuggcugacuuuuugauuuucuguagagacaagcugucucuauguugcccaggcuggucuugaacuccugagcucaagcgauccuccugccuuggccucccaaagugcugggauuauaggcaugagccacugcgccuggccagaaaacaauuuuuaaacagugaaaccaaaaaagaaucuaggaugacugccuauuggcuaucauggugagucugaacuucucugugugccuuccaugucccagccagcacugccuuccaggacucacuggccccaagccccuucuccagaagccaggccccucauugacucaagucucuugcuguguccucuucuugccccugucugggaguugugguccuuugcuguuuuacuugaaucuacccaccuuccaaaucucacuuccucugacaagguucugccacuuacuguagccagcagcaugcuccuccaacuuagggucaguaugacaguuuggagcauccaaccauuuuguguuuuuguuucaacuucucaaacguuaagucccuugugggcagggacugugaagagcuuccugugucccucacuguuccuggagccacacugaccaagagcagugcacugaguucuagaggagaaagguugguuuuaaaagcgauguaccccagucugggcaauucggagaaaccccaucucuacuaaaaauauaaaaaauuagccacgcguggugugugccuggggucccagcuacuggggaggcuguggugggaggaucuccugagccugggaaguugaggcugcagugagcugagaucacaccacugcacuccagccuggacaacaggagugagacccugccucaaaaaauaaaauaaaauaaaaacaauaaaaauaaguaaacaaacaaacaaaaaaaaccaauguaccuuaucacaacaucgaacugguucaggguguggcccaguucuaauccgugcaguauuccuccgcuuccaauaaccacacagcgccgacaggucuuggcuuucaaguguucagggaggucgugcucuggcaagaguuccaagagggucuggacuuuacuggagaacuuccggaacccaaaaggaggaucguacuuggacucagcuucacugucuuugggggccuucugcacaaaagggaguaaguccacgcuauaccugugcucaaauaacagcgccauugaugucuuggcaaacuugggacgacauuccuucugcaagacuugcugagcauauuucugagcucucuggaaugaaaucacaccaaucuggguuuuaaaaacucuccugcauuaaaaauauacucuucuagaugacaauuuguccuaugaugucugauguagcucccguguugauuacugucuuuuaacacagaauauuugcuuuuuagaguuaaguuuggcucagaaacuugaagaaacaaccugggagaaucacaugacaaggagauaaacacagcaggguauucauuucauugcacaggcaaagcaagaaggacucccgccucccacccccagccuaacacuguucaaauacauuuggggugaaaauguacuucggggugucuaagacuucauguuucauaaaauucugauacaugcuacaacauaguuaaacuuugaggacauuaugcuaagugaagccagucacaaagagacaaauacuguaugaccugacuuauaugagguaucuaaaguagucaaauucauaaaaacaugguuaccaggguugaagagagggagaaaaggggaguuguuuaauagguacagcguuucgguuuugcaagaugaaaacauucuagaaauuuguuucacaagaguuuaaauauacuuaaugcugccaaaugguacauuuaaaaauaauuaugaugguaaauuuuauguuuuuuuuaaccacgauuaaaaaaaagguuucauauaucagguucucaucuagcaggaugacaaacaggcuuauuuaucaguugagauacagaaugucacagucuagaaugcaaauuaccugaaagaaucagggaauguccccuuaacacagaaauugcauugguuucaaagcauuuucccagccugcauuuccauaugcauuuuaauguuuugccucagccaggagcugcgugaaugcaacaaaacucagaggaaaggcgggcauggcgggucacaccuauaaucucagcacuuugggaggccaaggugagaggguugcuugagcccaggaguucgaggcuagccugggcaacauggugagaccccaccuauacaaaaaauuuuuuaaaaaaugggucaggagugguggugugccccuguggccccagcuacaugggaggcugaggcaugaguaucgagugauccucaaccuggaagguugacacuguagugagcugugauugugccacugcacuccagccugggugacagagggagacccugucucuaaaacaaaaacaagaacaaaaacaugaccauccuggcuaauacggugaaacucgucucuacuaaaaauacaaaaauuagccgggcacgugguggugggcaccuguagucccagcuacucgggaggcugaggcaggagaauggugugaacccgggaggcagagcuugcagugagccgagaucgugccacuauacuccagccugggcaacagagcgagacucugucucaaaaaacaaaaaaacaaacaaaaaaccccccaaaaaacaaaaacgcaaccuuggaggaauaugguaugcguguccauucaccccagucuuccucuuggcucagcuggacaaaugcugacucagaaccccugucagguaguucuuccuaucuuugugcuuuuuuauccuugucuccauauuuagcagccuuggaauuggcccugcauuacuccuccuauucacuaccuucucacaggcagaaguguguguguguguguguguguguguguguguguaauccuauauuuacugggauauuuauuaggaauucaacauaucuuuucaacuuugucaguaucauuaugaggauuauuacugggguauagguuuaaauguucaucccaacuaugcuuuuccucaaggccuuguuauuuuuauuuucauuuucugauuuuugcuuaacacauuuuuuuaggaaugcaucuauccuauuauaacagagauacuuaauauauuauagcuuugauaaguuguuagcauccgugaagagaacacugucuacauccgaagaaucuggccccauuucugaaaaaggaacugauauucuuggagccucagaaacgcugcugcagacaccaugcauagccacugccucaguucacccucacgacacuauggcaccuugcaagacgaucauuaguaucuucacuuuguaagaggucugagcuggcccagcaaaccuggcuccuaaaacaacagccucuaccuauagaaaucagcacacaaacaccaccauugauaacaaauguuuaaauacgaauuggcaucuucaugaggaaaucagcaggaaagccaagcaaggaaucugccuugacccugagcccccgaauggaggggcucaccccuggccaggccugcccagcaggugaugcuccgggugcuuaaugccaagcugguggaagcgggacacacagagcggccacacacacugcacauucaucucaaaacccuaggcccgaaggucaugaauggcaauuuuuagagaccuaaaggccuaacccuccacuagagaaucauauccuaaguaucugguuuuacaaaucuccuaggacagaaaggaacaucugagaaguggcaagagggacccggagaagcucacugauggccacgggacuagaaagaggugcgugagcgagcuggaugcucgccaggcugccaggucuccucuucagaagcugcaucuggaaaggagugaaauuucauuccauuuccauucucaccaagagguuaauuucagguuucaaacuuaauuuucuucuuuuuuuuucuuuuuuuuuuuuugagacagagucucgcucugucacccaggcuggagugcaguggcgcaauuucagcucacugcaaccucugccucccaguuucaagccauucuccugccucagguuccugaguagcugggauuacaggcgugcacugacacacccggcuacuuuuuguauuuucaguacagacgggguuucaccauguuggucaggcuggucucaaacuccugaccuagugauccaccugccuccaccuuccaaaguucugggauuauagaugugagccaccacgcccagcccaaacuuaauuuucuagacuguggguagggcacauuucucaguagucaccuucugacugugaccccuccugcgccuaagugacaguggaugcaguaguaaauccugagugaguuucuacauguccuggcaacgucuaaagccacagcaauuccuuguccucuuuuguuucaacucguuuaacagaucuccacugauugccuggagacagggcuuuuucuguagagagcucacacagaacuccaucucauagccacucagaacaggaggaccacaugggccauguccuccacucugggaugguuucuguucuugcuucaauggugcacaaccagacaucauugucuugggggcuuccucagagcuugucccacaucuuuaaguaaguugaaccggcaucugcuucagcugcucucuucccccuccacugcuugcccauagcucacagcucagaagaaagugccucaaggcgagugccgcaccuucaggagcugcaaugaagagaggaagcagugugacuaggcugugaggacuccagagcucccaggaaggccucagaggcgucagcuggggccuggguggcauucauccagaugaggcucacuggaagccaggagcuggugacucucucguaaaauacaagaacucccguucgucuuauauccagggacaaaaauaaagguuucaguuuuuaacaucuuccaggcugcgcuugcagguugcccacaauuaagacaaaguagacaucugguagugccaauuguuaaugcuguggcagugugccauaaaaacaucaugugaaauucacagaaagguauuaaaaacaaucaaaguaauuuuccucagcaaaauccccacuuucauuuccacucugaaaucuuaaggacaacccuucucagaaauacaaguaaguggcauaauucuuaguaaaaggcaauguucuauugcacuuauuauuuuuuaaaaauccggaacagggcagagcauucagauugaaagaaaacuugugucuggcauuaaugagaugugggaaggagcucaauucugccauggaucacgugaucugggggcaucagugaccuuguggaacuuucauuucccacaccuguaaacucuggugcuggucgcuucuucgcagguugcucugaugcccuaagcauuuugcccaguaccuggcauguguggagacuuguaugauaucacacaaggacaauaacugagggucacguuauugacauauuuuacucacauuuaaguuauaacucuuacccaguuagaagcagaaaaaaauuuaaauaaccaagucauggaaauaacacuacacuauaaacucaaccaguugguggaagccuggggugggguugaggguggggacugacugcagaggggcuccggggaacucgcuugggccaugggaaugugcuaaagcgggauuguggugacagaggcguggcugcauaaguuuuuaauacucaucaaacaaugggcuucaaaggauuaaaucuuauguagauuucaucccaucaacuguuagaaaaaaaaauaaucaggagaucuggaggcuggacucaguucuagauugauuuaacuagcagcgucgucuuuguuaaagcauuucucccuaggucgaggcuucaguuuucuuaccucuaagauaucccaggaaggccuggaaagcggggagcagcacuaaggagagaaaagacucgguuugaagaugcuggugccugggcucacugaaugcuucagcagggagggcccugcuuccuuuaaaggcacgguguaggucugcagaguccgagagaagacgaugaagaagcggcugaguccaucuggccauaauuaacugcacgcaaugccauccgcagggagauaaggucuuuagcucucagaaaggagagagggccaaguucaaaaugcugcuacuacacagcccaaaccgaaacugacaucaacgugcccucgucucucuuaaaacaucuuuugagugcaauuucacaucugaaccacacuuucaaaguguccaggcaucccuucagagcccacugguagucuuuuuaacaacuggcacauuaagggacauauuuaaauagaaaauacaaaacccacaacugccacagccacacuuccucugcugcaguaaugaaggcggggaccagcgucaccagacaaugcucaagucuagcagggcuggcagggucccacucacacugugggcugcugaguggaaccaacagagcuaacagggccccacccuuauggcucugagaccuucuucugcccauauacauccacgauaauucaaauuuguccacgugcucuugugguaaggaucaaaucuccacugacugccuggagacgggauuuucuucauggagagcucacacagaacuccaugucauagccacucagaacacgaggaccacacgggccauguccuccacucuauucuugcuucagugaugcacaaauuaaggagcugcuucgugcuuaguguagcauucaaggccuuuugcuaucuggcccugucucauuuucagucccauauccugugaucccuccuccccaaauccucagugauaggcaacucuugccauuccucucaugugcaaagcauucugaggccugcacuucugcacaaaccaccucuucugcguggaaggaagcaggauauccugucaggaccguuuugaaaaguggagcauuuuaacaaggucaaaauguuaaaaaccuacuuaaaaaaauucucuaguaacacaauaagacacccucaauuccaccauaauuauagcaggcuuucacuuucuauuuuacuaguuucaaacucacggaguuuuacaaacauguuugacuuacacagcugccccccauuccuuccucuuucucuaugaaaaauuacaggggacuuucuccuuuacuuauuuccguauuacuugaauuuuugguguuuuuuuuaaauaauugaaaaaaguaaccuuuuagaaaucgcucagcacuggggugacaugguagauggacacugugggcugcugcucaguuuugcuuaaguggcuuuggcuccuucuccaggcagguagguguaggaccagggaggccaacucccccaucagaaguccucccaaccccccucgucagugauuggucaggaguccucacugaagcccaucaaggaagggcauuggcaucuaugaaggcuacuauugguccagccaugagcuuaggucuaaaaauuggcccaguagccuaaugaaaggacuuacauuccaugguucagggagaaggggcagggagcgggugcugggcuuuucccugucuaccaguggauguuuagguugaagagaacuaucaguccuguuccucacauuaaaccuaaggugcauuacugauguacucaaagaauuacaaguuauaaccggauuuucuguacaaucuagaguucacagguaauggaagauuacacugugauucaaguacuaucuccccuucccccugaaguugaauauauguaagugcauauuaaguaauguaagauguuaagcacacagccccugucucccaagaccuggccuggaaaacaaguggggaagaugaacagcugaaauccuacaaugauaaacaucaggauuaaggcaugagggggcucucucacacacacagagggacgaucagggauagccucuuagaagggguaaccgcugagcugagacuugacuuaaaauacgaguaacagaagggcgaagggcagggaaaggcucuaggcagcaaagaaagaaagaaugcagcaaauagaggaaaguucuuuucaacaaaugguccugggacaacuggagaacaacaugcaaaaggaugaccuuggacccugaccucacacugauaugguuugacucuuuguccccacccaaaucucaucugguagcucccauaauucccauguguugugggaaggacccagugguagaugacugaaucaugggggcaggucuuuccugugccguucuugugguagugaaugggucucaugagaucugaugguuuuaaaaaugggaguuucccugcacaguuucucucuuuugccugcugccauucauguaagacgugacuugcuccuccuugccuucugccaugauugugaggcuuccccugccauguggaguuguaacuacaauuaaaccucuucuguaaauugcccagucuuagguaugucuuuaucaguagugaaaauggacuaauauaccauauacaaaaauuaaugcaaaacgaaucaaagaccuaaauguaagagguaguauguuauaaacauacuagaagaaaacuugggacuaaacaauaguuucuuagauaugacaccaaaagcauaaaugaccaaaggaaaaauagguaaauuggguuucaucagaauuaaagacuuuugugcuaaaaaugauacccuaaagaaagugaaaagacaacuuagagaguggagaaaauacuuggaaaucacauaccagauauaggguacugguauccagaacacagaaagaacucuuacaauuuaagaauaaaaagucaaauagcccaauuaaaaaugggcaaaggaucugaaugggcauuccuccaaagaaaacacacauacggucaaugagagcacaugggaaagaugcucagcaucauuagcuaucagcaaaucaaaaccacaaugagauaucacuuaacaucuaucaggaugacaguaguaaaaaaggaaagauaauaacaaauguugauaaagaugcggagaaacugaaacucugguaccuugcuuacaagaauguaaaauaaugcaaccauuuuggaaaacagcuuggcaguuccucaaaaagcaaaacauaguuaccauaugacccagcaacuauauuccuaguauauacauaaaagaacugaaaacagguacacaaauacuuacauacacauguucacagcagcauuauucauaauagccaaaaguggacacaacccaaauguccacuaacugaugaauggauaaacaaaaugagguauauccauacaaugagguauuauccagaaauaauaaugaaguaccgauacaugcuacaacauggguguaccuucaaaacauuauccuaagugaaagaauccagucacaggagaccaugaaaugaauaacaugaaauguccauaauaggcaaaucuauacagacagaaaguagauuacugguugccuaggauuuguggggagggggaaauagggagugacuaugaauggauauggaguuucuuuuugggauacuaaaaaccuucuaaacuuagaucauggugaugguugcacaguucuguaaaucacuaaaaccauaguguauugcacaaaaucacugcacuguaucccuuuuuuuuuucucagugucuuguucuguucuguuuuaugggcuggagugcaguggcaugauuauagcucacuguaaucucaaacuccugggcgcaagugauccuucugccuuagucucuggaguagcuaagacuacaguugugagacaccacacaaggcuaauguuuuuauuuuuaauagagaugaugucuugguauguugcccaggcuggucucaaacuccuggccucaaaugauccuuccugccucggccucccaaaaagcugggauuauagacaggagccaccaugccuggcuguacuguaugcuuuaaaugggugaacuaugugguguguuaauuauaucucaauaaaaauguuuuaagggcagggcaugguggcucaugucuauaaucccagcacuuugggaggcugaggcaggaggaucacuugagucacuugaguccaggaguuugcgacuagccugggaaacacgguaagacccugccucuaccaaaaaaaaaaaaaaaaaaaaaaaaaaaaaaauaggcacguaugguggugcaugcuauagucccagcuacucaggaggcugaggugggaggauugcuugagccugggaaguugaggcugcagugagcaaugaucgggccacugcacuucagccugggugacagcgugaggcccugcugaaaagaaaagaagcugggcucaguggcucaugccugucauccuagcacuuugggagguugaggcggguggaucacccgaggucagggguuuaagaccagccuggccaacaugacaaaaccccaucuccauuaaaaauacaaaaauuagcugggugugguggcacaugccuguaaucccagcuacucgggaggcugagacaggagaaucacuugaacccaggagguggagguugcagugagcugagaucaugccacugcacaccagccugggagacagagugagacuccgucucaaaaaaaaaaaaaaaaaagagaaaaggaaagaagagaagagguuuacccaaggaccugugagggguugagugugccuaaaauacauagaguugggacaauggagguggcacaaaaagacuggagagaucaguaggaaccaagucaugaacggucuucugggccagacuaaggagucuggguauuuuccugaagguaaaggagaggcaccaaagaguuuuaaggagggaagcaauauauuagauucaaauuguagaacacgacuacuccggccacaguggggcauggcuggaugcaggaaggcaggugagaagacacacaaccagggaaacaggaagagcaggugacucuaaagggcagcccucgcucacuacaccuuuccuuagaaugccacguacuauguauuuuuacagacauagucccuacucucaaguaacuuauacuuuagauggcaggaugagaggcucguaugaauuaggauaauaccgauggaauguggcaagcuucagaggagcuuggaaguagcagugagguucagucugaaagucacugaguuggggacugguuaggcugcaugcagguguucuuugagagccuaccguuugagacaacuccacccagaauucagaacuuugaaagccccagguuacgaaaccagccuccaucuuccagucaggcacuggcaaauugcugagaaccacagaaucucagaccuggaagggaucagaaaggccccugagccccucccugucuaaugucugaauucuaccuacaggaccccuggcuuuuuuuugagacagaguuucacucuugucgcccaggcuggagugcaauggcacagucuuggcucacugcaaccucccugucuuggguucaagugauucuccugccucagccuccugaguagcugggauuacaggugccugccaccacgcccagcuaauuucuguauuuuuaguagagacgggguuucaccauguuggccaggcuggucucgaacuccugaccucaugauccgcccaccucagccucccaaggugcugggauuacaggugugcgccaucacacccggucagaccccugacuuucuuaaagauccccagagagucaccacaaagguggucuguuuaucccaucuuuggaugccugggaccgucaaaccuuucuccuuugagauuggcugccaucccuauacagagcucugccauuaaggccaccugggcaggcccauccuucugcggucugaaccucuggcucauugacacugacugccaugugcccuguaccaggucuucucuccuuaaggcuacacagauguuccuaucccuuccaugauuccucagggaggugaucuugaguuucuccucuggucauucuuagaaaucacuaggauuccuuaggggagccuuaacaaguaacagccuaacaaccagagcacuugacugaccacugcagagacaagcagaccacguggcuuaaguucaaaaugaucacaggcagccggggcacagguugacacagaugugccuggcuggacaggaaaacuacuaaguugauuucccccaggguauuacuaaaacacaccuucuccacccugugcuuguggaauaguauucuuggcccuuguacaggagagcgcaccucucuccucagcugacccagacuuuagaacaaucacuuuacaguuggucagaugguaauggacaggaaaaagaggaugcaaagagaaaguggagaagggcagcagagaaacaaagggaagaguucccaguccaucaguaagccauaccaagugccaucauuuaaagacuuucucagaagacaaaaacagagacaggaugucuaaaaccuuuauccaagagagcugugaagcgccguggaauugcaaaggacugggggagguaugucugcaaggccagacaguccaggaagaaagggaagccugagcagaggguacuggacacauccuacucgaccaaagcagauguguuaaugcugaugaaaugacaugagccagcagacaccugaggacaccuaugcugggaaggcuggcccugcgaccagcaagacccugagacucaauaguuuugcaggagccaagcugugccuuugcuaacugagcucuucauuuauuuguuuauaccugucuguaccacaaaaaaaauuggaggcacuucaaaggauguacaaauuaaaguagaaacguaugaauaaaaauuaggaucaagaaaggaauuuuguauauauucucuuacucaacuucuacauuucacaguugagaaaacugggacucaaaacaaucaagucaccugccuaggguuucaccauuacuaaguggcaguuagauuugaauuggguaaaacauuuaagcucuuuccucucugcaccaugcugcuuuuaacuuugggcuucucuguggacacucccuaaccaggcagagagcagaguggucaggagcucagacucugaaaccacaccacugaauucaagccgggcuucaccacguacugccgcuggugacccugggcagguuacuaaaucucccugcuccucaguuucccugccugugagauggggaugauuguagcaccuacauccccaggaaugugaugaaaguuaaaugagcuaauauuacuaauacacuuuuagaacaguuccuggcacacgggagcacuaaaccacauuauaaacuagcuaaacuagacgugaacuugggugagcagcucaaccuuucaagccaucaucuguaagauggagaugauacugggauaucucccagucacaaugacuaaaggagauaauauauauaaagcauccauacaugucaguuaucaucccucucaugcuacuuuauuuaaaaucaucucuuccuccauccugggcuaaauguuaucagauaauccagccacuaaaauaaucagugacauaagcauuugauaugucacuugauuuggaaacauaaauguaagcugaaagaaaaaucuugcaaugcaaugugaauucauuaaaauuaaaaauaaaacacaggaaggacagaugauacuaagagaauuucuggccaggcaugguggcucaugucuguaauccccgaccuuugggaggccaaggcgggaggauagcuugagccuaggaguucaagaucagccugggcaacauggcaagaccccaucuccacaaaaaauaaaaaaauuagucaggcaugguggugcacaccuguggucccagcuacucagaaggcugagguggccguguucuugccacugcacucaacccugggugcagagcgagacccugacucaaaaaaaaaaaaagggagaaaagaaaaaagaaagaauuucuuuguuguuuacuuuauagcaucagggcaaauuaauuccaggagaggagcccuagagccuguuggguugagcccaccucaucccacaccccagcugcaguaaaugggagaaggauacuguggaguaguuagugguggguuuuuagaagaagguugucuuugguuuuggagugcugagauuaagugcuuuccccucugaguucaaacuuuuauuaacauauauuugucacacaguagacuaaugauauuauaguuugagcauaugcuuggcaauguuuucauuuaaaccacaccaaugggauaucuaaccuuuacauggucaggguccacauaaugcauuuuuuucaugucacauucuucaguaguauaauuuaacuugaggauauaaaggauccacacuccaaacacaagcaauguacaucuggaaaaaaaucaauuagguauuaugauguagucaugugagaaucaugagaugcaaugugaaacugaaaacggaauccuaaaugagucugccugcuaugcagcauaaaacuacaaucuuuaaguugacauuggggugaaaggaaggggccauuuccuauuuuccugacaagauaaacuagucauuuaugacugucuuuguuauaagcaaacacagaaaaaacuuuuuuugcaagagcacuguaacaaaaucugaaucacaaugucaauuauugaacuuaaaaucaaguaauagacuugaacuacagaaucucggcuucaaucuuuugugaccugaaaauucugucaguccuuaaaaaaaaaaaaaaaaaagaaaagaaaagaaacaguuuauucacaguacgucuaaagaauucuacccggaagugaggccgacugggaaaugagacaggaccauuaguuacccuuaagaugaccuaaaaaauauuuuuuacagaucugauaaauucacacuauuauauaguuuaauacacacacacacacacacacacgacuuggagaaaagagcugagucuagucuuaguuuuagaaaucucauuuuuacuaaguucuccagugacacaaaccgcaagcuaaaaaguuucaaccaaaauuuaagaaccacugcuuuaaacaauucuguucuugaaaaaacaaaugcaagaaauaaagagaaaguaauccauuuucuaaauaaaggggcaguuuuuuuuucaaaaaaauugcaucuagcauaauauauuauacauaauagaugcaaaauauuucuuaauauuugaggaugagaauacaaugaaguguugcugggaguguuuuaaaaacuuuaaaauucucauuuaaaacaggcuucccaugacaacuuggacaaguugggauuauguauaaugauaagugaacaggaugcuaucaauuuguguaaaaguggguuugggcacggggcauggcagagcacacacacacaaaauauuucucauauacacaagaaaccggugacacugguuaucuuuaaauauggaggguaaauggggagcagggaugagaagguguuucacugagacucuuuaauaccuuuugaauuuucaaucuugaaaaccuaauauuaccuauucuucucuucagccccagaaaagguguuacauucagugcauacacuucccuuauuuugauuuaaaaaaaaaauaaaagaaaagggugugaaggcaagcccagugucuguagcacauaucagacugugccuuaauuccuggagcgaguccaccucacccacagccuaagcagcacagggcgcaggucuaucuccccugcugccuuguggcuggcgcccagcaugacgucaugaacguggugggccucaauaaauauugguuggugacucaagggaggcugaauguaacauaagccuuauucuuauaaauuuccuuuuccccuacacuuccuaagucaguaaagugagacagaagacuagauugcaagguuggauuucuauguuuagacaugaaaaaagggcaauuuucaacuagguuugacugguauauauguaaaaaaagacaccugccaaguuccuccuugauuaauucuaucacuuauuaggauauaagggugaccuggcucaaacaccugucaucauuuuuaguauucgauauuuaacaguauucaagggccuucagggaaauuuaauuaaccauauuuuagauuaacuuacaauagcuaagggaaaagcccucuuuuguuaaauaagggcaugaagagcagugcacggugagagcugcucucccaggcauccaggccaagguagagagccugagcagcuacugggcacugugcacuuaccaaauacagccagcuguacaggcucacuccggcugugcacucagucuuuacucagacgugccuuugaaugucugaggcauccuuugaccaagcaugccucuccaacauuagccaucuugagggcucucacugaauuuuucuccuaguucuacacaguugacccaaagcagggggaucuacagucccaggggcgguacuuacuugaggaugucuuuuaauaacaagcugggccuucucaucuugcuuugagcucggguguaccauugcagggaaggccucgagcaaucacuucucaguuucacauagguguacucacuuggcauugcugugaagagaggcgaagagggcaguggggaaaaagagaggagagaguuaggaggauggauuaugguuuucaaagagccuuuauauguugcauccauaccauggaauaguaacuggcaauaaagaagaaugaacuguuguuacaugcaacaaagugggugaaucuagagggaacuaugcugagcugauaccaaaauguuacauacuguaugauucucaacauucuuuuuuuuuuuuuucugagacggagucuugcucuguugcccaggcuggagugcaguggcgugaucucagcucacugcaaccucugccuccuggguucgagugacuguccugccuuagccuccugaguggcugggauuacaggcgcaugccaccaugccaggcuaauuuuuguauuuuuaguagagacaggguuucacccuguuagucaggcuggugucgaacuccugaccucgugauucaccugccucggccucccaaagugcugggauuacaugcaugagccacugcacccggcugauuuuuaacauucuuaaaaugacaaaauuauagaaagggagaacagacuagugagugucagggguuguggaaggggagguagauagguagauauggcuauaaaagggcaacacgaaggacucuugugaggauggagauguucuacaucuugacuguauccaugucagauuccagcugugauaugguacuauaguuuugcaggaugcuaucaugggggaaaaugaguaaagcauacacaaaaucucuccagauuauguuuuacaaccgcaugugaauacaauuauccuaaacuuuaaaguuuauuuuuuuuaaaaaggaccuuuuaccuuuuagagcuacauacagaaauaucuacagaucaaauagcaaaaaugagaucugcuucaagaacucaggaaggggauaaguggagggccagggagaauagauaaaacuaacuuuaagcugauaacuuacuaaaccugggagaugggucuagggcucacuacacaauucuccccacuucuguguaugguuaaaauuuauauaauaaaaaaguuuaaaaagaaaguuacauuaaaagcagaaguguuacaucaaaaaaaaaaaagaaaaagagagaauauggcaauuuaaaaacacuuuucuuaaaaaauauguugugugccugccuauuuauucuuuugaaauaauuuuauuagcaauuuucaaguucuaaauaauauuccaauaguacuguaguagggauugguccgucucccccauauucgcuuuccccuaacucaacuuaauacagcucuggauuuuuaguggggcauaguaccucccagaaugaagacuacauuucccagucucccuuggagcuaggacucaagacuaaguuuuagccaaugggauaugagcagaagcauccugugcaauucucaaggugcuucccuuggcauacucuggcuucuccuguauccccucugccuccugacugaaauauggaccaugaucugccacucuggaccacacagagaggacauuacucaaggaugguggaacaacaagagaaggagcuggggccccugggacaaucccauagggcagagagcugccacucuacuucuggacuggucuaugauagaggaauaagcuucugucuuguuuaaggaaugguuaauuaaaggcaaaauuauaucuuaacuaauauaggcacuaguuacuauuauaauaaaugcauauauuaauuuaagaaauaaugucuucacuauaguuuuuaguuggauggaagaaguuauaucucauucauuauucacuucauuuuucccguuaggguuuuaccaucuucuuugaaaaaaaucuguuuaucuuaaacuaaacaggcauucaaguuuuuuuuuucugcuacuguaaacaaucucuuccuuaacuccuuaauucuaauucuguguagcaagaguuuuuaucauuauguauaauucuaucaaaauaguuucaauaaguguugagggccuuauuaauaaaccuuugcugaagaaucugcugaauuauuaaaugagaaguuagaacaacugagauccuggaagguuuucaaauaccacaauucugugguuacuucauguacagucagccaaguggugggaaucagcaggcuaccuguagccugugcauauuuaaaauggaaacuucugagaugacuggaaugauacucaguucacaccaaaguggaccuccagagaacaaagaugacugugguaagaguaugagaaagacuccagggcuuccgccuccaggugcucuguugcugagccagacagugcucuggcucuuguucuacucugcccgucagacuauaagccuguaaauauuuuccgaacucucucuuaccagcuggcuucucguaaaguugugauccuaggaugugcuggugaaagacugggaggcaaucuuucuuuuccccugacuuggugaagcuuuggauagcaguaguagcaggcaagggaaggugucuacaugugacuccugcagcagucgugugcauucggauucuuggguuuuuaggcagcagaugcuguggcacuuccaguaacuuugugacaaguacaagcuucagacuaggggugacaauggcucccugaagaccaaauccaucucucuaauguggaccucucaccuaagcccagaccuguauaccuaaugucuuguuugcuaucuucaccucaagcaacauuccuaaauggaaccuggcauuuucuucuauuccuuucauucuuugguaucugaaccaucuguucagccauaagaugaaaaccugcaggucaaccagacuuucauucucaaccccagucaauccccagggccugccaauaauaccuccugaauuuuuccuguucacuacaugccuuuaauagaagucacuuaccucgaaugcccugaucucaauuuuaucgccucaaagccgucuuucaaaaauacauaucugccuacugguucccagcuuauuucagauucugugacuccaugugacaaaccugucuaucacacugcacaaagaaguacuguuagaaaccuggaugugccaaauuguuacuucagugccuuugcacaggaugugcucacaaucuggaaucccacccaauaaucugccugcugagcuacuuuucauccuuaaacccagcucaagcaucucuuuccuuaucucugaggucauuuuucaccaccacauccaucccugggcacgucccuaucucuguuuaccacaaugaacugaauuuucuuuugcagacuccuggaggaaugagcugcagagccagaacucuguucaccuuuguaucccuaaaaccuaggacagagauuggcacacagcagccccuuaagaaacaucucgaauggaaugaaaugugcauuacauguuuguagccugucaucaaacaagauaaacuuccaagaaaagcauuuucucaauacugauuaagaguaaaacuaaaacugaauguuaacagaaauuauaauggcaagaauaaagcauaaacucuauugaaacaucuaaaauggcugggugugguagcucacaccuuugggagacggggaugggaugaucacuugaggccaggaguuugagaccagccugggcaacacagugagacccugccucuacaaaaaaauaauaauaaaugaaacaucaaaaauguccaacagcaggaaauuuguugguaaauuacagcacaaacuacaugaauacucuacaguccuuaagaucuugcuacacagcagggucucugacugacagcaucaguguaaccuggaaguggguuagaaaugcagagucucaggcccgccccagucuugcugacucagcauuuuaaugagauccugggacauucauaugcauauuaaaguuugagaagcacuagcuuaaaguacucaguacuucacauuuauugacacugaaaaauauaagaaaaaggcaguuuuauaaaaaucuaugcaucuacacauguaguuaccuccugggauauaucuauuaaagguaugugcucuguggugggcaggcauaugcaaacccacccccaaaggccaaggaagaggcugacgaauccaguuucucagaaagaaacgugugauggggacuuacgaacagaagccauguccuggguggcggcgagacaggauaaugguugcccaugcuauuacuccccag

SEQ ID NO: 191630 - RNA, 16680 nt, Homo sapiens
gcacagccgcugacgcgucgggaggcggagccuagggaagcaaauucuccuggcggccuccguucagacgcggcagcugugacccaccugccuccuccgcagagcaauggcggugucugccggguccgcgcggaccucgcccagcucagguaggcuuaggaccccgcccuccggcggagaguuccuaggagcgcuggucucagaggggcgggggcgggaggacgcccagugucucccggugaggcgggggggggguccucuguggggaagggggcgugcugugagacauuugcagccugcggcuucugaaugaugaugacauucgggaacacugcgguuaggggacuguagucugagggguucugggacauuaggggaucguggagagggggcugcacugcagggauguuuccuauagucagaucauugaggcaaccucauugagccgacccgggugggcggaagcucugagcuguuggugcagugauuucuuugauuugagguggagcccacccccgcacacauauuuucuccauuuauugauugcagauaaaguacagaaagacaaggcugaacugaucucagggcccaggcaggacagccgaauagggaaacucuuggguuuugaguggacagauuuguccaguuggcggaggcuggugacccugcugaaucgaccaacggacccugcaagcuuagcugucuuucguuuucuuuuuggugaguccaguuuaugggugggagcaauuugguugagaguggagaaugacaaucucuauuuuuugguugcaaguagacuuagcucccuuuuccucagagcugaagacauugguauaaaagaagaggucuuugcgaaguuuaggauuaaaccugcuuugucuccuacaguuaggauuuacuugguggccagaaaugcuuuuuuuuuuuuccuuagacggacuuucgcucuuguugcccaagcuggagugcaauggcgcuaucucggcucacuguaaccuccgccacccggguuaaagcgauucuccucccucagucucccgaguagcugggauuacaggcgcccaccaccacacccggcuaauuuuuuauuuuuuuuguauguguguuuuuaguagagacgggguuucaccauguuggccaggcuggucucaaacuccugaccucaggugauccgccugccucggccucccaaagugcugggauuacaggugugagccaccguacccagcuagaaaugcuauaugauauguagaggcgaggcagcagugacccauuuugcuuguggcaugaaguugcccagaagacucagagaaacagagcagggggccacagggaccauaccuuuuggcugugacucccuaaucaagagcuucuuaacugaggccgcagcauggugugcuuggaaugguuuacagaugugcagagauauuaguccccuuagcccaguaguucucaacuggagggaguuuugcucccugggagacauuuggcaauguuuagagacauuuuuaguugucacaacuugggggaggaagaauagguggcugcuggcaucucuauagaggucagggagugcuccuaaauguccuguagugcauuggauaauccccucaauaaauaauuaaccagcccaaaaugugacuaguccugaaguugagaaacccugcuuuaucucaagcuggcuuccugaucugaguagccucuucuguuuauucccaggguguugacgaaaugcaacuguuuuuggagugugccaggaagcagaaaagguugagaagcacucccagagcacuuucuuucuuucuuucuuucuuuuuuugagacggaguuucgaucuuguugcccaggcuggagugcaauggugugaucucggcucacugcaaccuccgccucccagguucaagugauucuccugcuucagcuucccgaguagcugggauuacaggcaugcgccaccacaccuggcuaauuuuuuuguauuuuaaguagagacgggguuuuuccauguuggucaggcugguuucgaacucccaaccucaggugaucugcccaccucagccuccuaaagugcugggauuacaggcgugagccaccgugccuggccucccagagcacuuucugaagcucaauaggauggaucuuuauagcugucaagacccuaacaguuuuuauagcauuuugugcauuucuguaauuuaauccucucuguaguccugugauguauuccccuucucacaaauggggaauugguuaaccgagcugcaggggcuguucuagauggcacaacagauguaguacugugcagaguaggcacucaauaauuaauacugaauaaauggcagagccaagauuagaaaagaagucugacccuggagcugcacacugucaacuguguuccacuguauucuacugcuuccuuagcugaggcccaaugaccaacuccccuauugccuucuuaggguucuugauggugcuagacauuccccaggagcgggggcucagcucucuggaccggaaauaccuugaugggcuggaugugugccgcuuccccuugcuggaugcccuacgcccacugccacuugacuggauguaucuugucuacaccaucauguuucugggugaggggaacugugggaaauauugacuggccugccagaaacacagaaauagaagcaugcuggugaauggucaaagucuuuggcaccuuauuucacuucugcugugaucaauuucaugcuguugaccugugugucacuuaagcugugaucccauaauucuuuuuaaaauauuaaaauaacauuuaauuuucauuuaguuuuaugugauuauacaaugcuugauuuuucuuaauuccaaccauauccugguccagggaaacugggccuguggugaucucuugaccucuuaauccucucccuacaaaucccaggggcacugggcaugaugcugggccugugcuaccggauaagcuguguguuauuccugcugccauacugguauguguuucuccuggacaagacaucauggaacaaccacuccuaucuguauggguuguuggccuuucagcuaacauucauggaugcaaaccacuacugguaugagucaggggggacaaaggggagggguuggcugggucaggaugguuaucagagauaggggcccagugagguucuggaauuuuucagucauguuugcaaaguaugguuacaaggucacuuugaucuagguggauuugggaggggaaagggccaacuaguuggagcgcuugggaugacacaaagcaaaauggcuccaucccaccccuucagucuuucccuaucuccccaggugccuugauuuauucaccucuuguaacccucuuagagagaaaaacagaauacuaaagccagacauggcuguuuucagauacuuuaagggugguuauguagaagagggagcagacuuucucugugugaguccagaagggcagaguuagagccaaaaguagaaguugcugugaggcagagaucaugucaggagaagagggcccaccagggcugcucagcauugcuguucucggaggagguaacccuuccccauuucuggcuuaggugacugucucuaaggggagguggagaagggauuuggagauaaggugguggggcaguugaccuuaaggauucuuuauauguugagugaaaaguaauaaaauaggugucaauaacaugaguauggggaaaaaaacucaaacauugaauucauuaacagucauuaaguuuuauuuauuuuucuuuuuauuuauuuauuuuuaaauagagauggggucucgcuuuguugcccaggcuggucuugaacuucugggcucaagcaguccucccaccucggccucccaaagugcugggauuacaggcaugagccacuguguccggccuauuuguuaauacacacauacaaaaccccuuugguaaaacuugaaacucauucagaauggccagcucugaucauagagaauuaagaggcaguuuugauagaauaucucugaaaaguuccguuguggggauauuuguugagauggcaucucacugugucgcccaggcuagagugcaguggcgugaucauagcucacugcagccucaaccuucuuguguuuaggugauccuuccaucucagccuccugaguagcuggaacaacaggugugugccaccacacucagcuaauuuuuaaaauuuuuuguagagaugggaucucacuauguugcucaggcuagucagaaguuccauuuuuaugacuuuaugcauuuugaaaaaaucacuuaucauuuauucaggguuuuccacaucgcaggcacuauacuaaauauuuagaguuuuuccucauuaaaacccuguaaggucgauggugcuguucacauuuuauguuuuuuggagucagggucuugcucugucacugaggccagaaugcaguggugcagucauagcucacugcaaccucaaacuccugggcuccagagauucucucgcuuuagcuucccaaaauguugguauuauagguaugaacuacugagccuggccuguucacauuuuaaagauaaagaagcuaaguauuauugacgagugaagaauuugccuaaggucagcuagcaguuaagaaacagaagugaguccagguguucaugacugcagaguccagugcucuugaccacaguguaagcugccccuuucccagcuucuacuucuugaaaacuugcuuugcuucugcuuccccagaguacaucugguguuaguagccugggucuaaucaguucucuuccagaauacaagcuguuagcaggaacccucuuauacuggauccuggcacccaggucuaugaaauguuaguuuauguuguguguuacucugcuguugaggguuuucauuuuuuuuuaaagauaauacaccgcauauuuauuuacacauacauagcuuuucaaacacuccaucaaauuccuccccuuuuucaguaauuuucuaguauuguaguccuuuuuuccugauuugauccauuagaacaaacucaacugggagcuaacaagaaauacugaacuuuuugcuguuauaacuuaguagcaauauuucuucuaugacuuguauaaucauguuagaauuugcucauauaauucuaaaaggucucagaauaaccagggaggauaugggagaugugcccaggauagauaggauuaucguguauaaaaggaaggauggagauguagcugcauuaagcagcuccccccucaauguuuaccucccucgguguaggucuguggacggucugcugaaugcccauaggaggaaugcccacgugccccuuuggaacuaugcagugcuccguggccagguacagcauuuuaggacagagggaggagcuccuugacagccauguggucagcauggccaucccacugccagacuacacucuccgcugccucccuggaucuucuguuuuuaguuuuuacccuuugcuggaaagcuaggcuggcuucucauuuuuuccaaucccuuaaucucugaauuaucuuauuugucaaggaaagacuagagcuuugucccugcuagauuggaauccucaugacaaagagaaaggauucagucugugcuuuaugacuucuuccuuggugccugauacugucgcugacauugguuggaugucaauaaaugcuguuuggaugaggcgaauuucugagaugaaugaauagaagauggggucuauucuuccuugggcccuggacucagaucaguauuuauuuuauucauuuaaaaaauauauauaaguagauuauuugggucaaggacuguaauauuugggucaaggacuguaacucaggagcauggauucaaguuguccuaacuauaugcuccuuauuuuauucuugccuaucuguagaaaagauucuuuuugcuugaacuuugugucacauuuuauuuucagaucuucauuguguacuucauugcgggugugaaaaagcuggaugcagacuggguugaaggcuauuccauggaauauuugucccggcacuggcucuucagucccuucaagugaguggcagucaugguggaggccucuuugaggcauggguacagagcaggugacucaucucucucaguaauggcaccuguuccuacuuugccugaauuugccacaugccuuccuuuguccacucauuucccuauucagcagaagcagagucagugguaucaaaagauugagcccuagcugcucuugggagauauaugguauagauaggcaagaaaggaaaagaaauuuaaaaaggaaaggaaagagccggaacuggcugacuuggugagugagccagugcccucagcagcugccuuggauggugccuguguccuugccuugccacucuagccucccaucagagcccugcagcugauguacugagaagaugggcacucacuguucaggcucugacaaaaccauuauuaucacuuccacaaaacaaagggucaccuuucugauuugucuucuucccauuucuucuuuccucuuguuuuacuuuauucucuuucuucuucccuguuauuuuccaguuccugaaguuugacuucauuaugauguuagccaagcauucaccuuuuaaaguguccucucacucaugaccuccguggggaacgucccuuccacaacacacacacaucucagucaaauuuuguccuaggagaucugcccuugcuuauuacauaggauauguuagaaaacauugaacaccuaaagugugugaaaauguagagggggcugggcaugguggcucaugccuguaaucccggcacuuugggaugcuggggugggaggauugcuugagcccaggaguucaagaccagccugagcaauauaagacacugucucuacaaaaaaauuuuuuaaaaaaacagcuaggcgugguggcacgugccugugguuccagcuacuucggaggcugagacaggaggauugcuugagcccaggaguuugaggcuacagugcaccaugaucaugccauugccuuccagccuaggcgacagagugaaacuucguuucaacaacaacaacaacaacaacaacaacaaacaaccuagaggagugucuucauggguggauuauguaccuuaggcaucuacccagccacuggaguagccaaggcacauucgugcugugaaugugcuuugauguguucuccagugggcuggugcuugaacuuucuccauguguuugcagacugcuguugucugaggagcugacuagccugcuggucgugcacuggggugggcugcugcuugaccucucagcugguuuccugcucuuuuuugaugucucaagauccauuggacuguucuuuguguccuacuuccacugcaugaauucccagcuuuucagcauuggucaguaccuguagccugggaggaaacaggaaccacaguuuugcaggaagggacuagccagaggcauuguuugggagugggagaggguggugugagcaggagcuaaauugaacccagggcagucacuaugaaguaggcauaaauggggauaagaggacuggggcuucugggcucaguuaguauguuguacaguagggaaucuccaggaagaacaaauaucuuacaguuaagaacuacuuuguggccgggcuugguggcucagguuuguaauccuagcacuuugggaggccgagguggguggaucaccugaggucaggaguucgagaccggccugaccaacauggugaaaccccgucucuacuaaaaauacaaaaacuuagcugagcaugguggcgcaugccuguaauuccagcuacuugggaggcugaggcaagagaaucgcuugaacccaggaggcagagguugcagugagcugagaucacgccacugcacuccagccugggcgacagagaaagacugucucaaaaaaaaaagaagaacuacuuuccuuuucaguggaacaccugggagaagucuccuaagggaacgggguugaagaggcccagccaaacuccugaaauauguauuuucucccugcuuuccuagguauguucuccuacgucaugcuggccagcagcccucucuucugcuccccugaguggccucggaagcugguguccuacugcccccgaagguugcaacaacuguugccccucaaggcagccccucagcccaguguuuccuguguguauaagaggagccggggcaaaaguggccagaagccagggcugcgccaucagcugggagcugccuucacccugcucuaccuccuggagcagcuauuccugcccuauucucauuuucucacccagguuuguaggggcuguggaguguacagcaaaggcuggacuuagaaaggaacggaugacaauaguugggaaagaauggggcugguuuugcagccccuucuugguaggggauggggucagugugagaagcauugagcugauuccccucugugcugccuucccagggcuauaacaacuggacaaaugggcuguauggcuauuccugggacaugauggugcacucccgcucccaccagcacgugaagaucaccuaccgugauggccgcacuggcgaacugggcuaccuuaacccuggggugagaugucugaugcugacaauuuacuguucuucagagcccccuugugcuuuggggucugguuuugucuuacacacaccauaaagcaaaacaaauuugagucugcuuugccuuuucucaagagccagauugaacuaucuuuuauguggguugagauagggcaaugcauucauuuccuugaacugagauuagauucaggaaaaguaagcaccacuagcccaacaaugaaaaauucauucccaaaggcaaguuccauuuuuuucuagccagaaugggcagcaggcagggaucucguugugccauuggcagugcaugacaugucuuggaaguugauaaugaugaggugggacuaauauggggguuuggggcagguauuuacacagagucggcgauggaaggaucaugcagacaugcugaagcaauaugccacuugccugagccgccugcuucccaaguauaaugucacugagccccagaucuacuuugauauuugggucuccaucaaugaccgcuuccagcagaggugggcaaggggagcagagagugggaaaaaaugaagcacaguucuuuuuaccaagaugaacagcccuugcuuccugguauugucuugcuuaaaaagcuguccuuccucuagugcaugucccccuugaucugguugugggcauagcugguugcuuccagcagggggcaccaucauccaggagaaaagugaguugacuuguucuuuuagacacuguugacauaauaccuucucagguagcuacuaacccccauuauacccagugcuccagaucucuucugccuucuuucucugcccuggacuggcaauaacaugcugacacaggccauuucuucuucuauucccuguccuuaggaaugaugaugaaagggagagaacuggaaguucugguggguggguggcugugauguccuuagaacaugguuuucuuuccuaaggauuuuugacccucguguggacaucgugcaggccgcuuggucacccuuucagcgcacauccugggugcaaccacucuugauggaccugucucccuggagggccaaguuacaggaaaucaagagcagccuagacaaccacacugagguggucuucauugcagauuucccugguauggaggaaagugaggagaggcuuuucugucuuuccuucuggcuuccuuggccagggacauuccauguggugggaggggagagggaauguuuuugaaaccuaaggggaugauggugguaaaggugugaugucucuguucuggcugggagugaguucacucugccauggggugggaugaugaacucuguuggucuggcaggacugcacuuggagaauuuugugagugaagaccugggcaacacuagcauccagcugcugcagggggaagugacuguggagcuuguggcagaacagaagaaccagacucuucgagagggagaaaaaaugcagguauuuugcugggauuaacaacagcagaaagaacugagugcaguagcucacaccaguaaucccagcuucuuaggaggcugaggugggaagccaggaauucacagugagccugagcaacagagugagaccccaucucuaacaauuuaaaaaacaauggcagaaagcuuagaugagcaagauucacuuauuauagacugaaaauauuuuaccauagcaguaaugcaguggagcucaaaaaacaagggccccugggacugugaagagccucauccaggauucuagagguccguuacuuucgauuccaaaacacaauugaguagaaagaagccaagagucauagaguagggaggccauaagcuggcuagagaaaagcugaugaaauuuauccauuucuucucccuugucaguugccugcuggugaguaccauaagguguauacgacaucaccuagcccuucuugcuacauguacgucuaugucaacacuacagagcuugcacuggagcaagaccuggcauaucugcaagaauuaaaggaaaagguggagaauggaaguggugaguguaugaacauuugggcugagauagccucugguuucaagaagucaggguuaugaaugauguucuagccauucaagaaugaacuugaagucucuagcuggcagaagaggaguucuaaggggagagagugauccaucucagugauuccucuuuuuucugucuuccgggcagaaacagggccucuacccccagagcugcagccucuguuggaaggggaaguaaaagggggcccugagccaacaccucugguucagaccuuucuuagacgccaacaaaggcuccaggagauugaacgccggcgaaauacuccuuuccaugagcgauucuuccgcuucuuguugcgaaagcucuaugucuuucgccgcagguaaguucacaacaauauuugucauugccaucauauguuggcaagcuugguaacuuuccccuggggagaguaacucuagagacugucauacaggaaaggacaguuuagcucuagguaucuuuuccugccauucuucuugauuuacuggaagaauaaguggccuauaucugauggccugcuuucuuguucugccucagcuuaucuccagccucucugugggcuguuccuacccuauccuggaauccucuaccagacuguauaaagagugguguacccuuccagcugggagauggagggucacuuggggggagauucccauauaugccugugugggaggagugaggaccaggugccuucuaagggcuuuagcugaaauucuucuggugaaacaggaguuugaacuuggucggcuuuuuccuguuuuucagcuuccugaugacuuguaucucacuucgaaaucugauauuaggccguccuucccuggagcagcuggcccaggaggugacuuaugcaaacuugagacccuuugaggcaguuggagaacugaaucccucaaacacggauucuucacauucuaauccuccugagucaaauccugauccuguccacucagaguucugaagggggccagauguugggugcagauguagaagcagccagucacagacccauucuaugcaauggacauuuauuugaaaaaaauucucaaaaguuuuuuuuuuuuuuuugggggggcgggguucuaaagcuguuuuuaacuccgagauuacaacuuagaggaaccaaggaaauaaagcaaauaagauuuaacaacccaagauuaagaggccaggaagagguuagacgcaaugugaaacuguccuccuaggauaagguuuaaaguggcuuuuugggggcugggugccguggcucacgccuguaaucccagcauuuugggaggcugaggugggcagaucacuugaggccaggaguucgagaccagccuggccaacauggcaaaaccccuucucuacuaaaaauacaaaaauuagccagacgugguggugggugccuguaauccaacuacccaggaggcugaggcaugagaaucgcuugggcccaggagguggagguugcagugagccgagaucgagccacugcacuccugggcaacagagcaagacuucgucucaaaauaaauaaauaaaguggcucuuggggaaaagcaauuuaauguaccacgaugaauagcuaacuguucccaaguguuugcuaugugcaacacaccgcgugagcaguguuaccugcauuauuacauuaggcugagagguaaaauaauuugcccgaagacauacagcuagugacgaauggacugaugguuugaacuuaacgucuauuugacuuaagguccugcacccugccacuuguaauuuucagaaucacugauaaucugaaauaaugcagcuuaaaacauguuuucuuaauuaaaaguauaauuggaugguggucagguuguaaaugcacacaaaguaauuuaucuucauugcaauuuugguuccuucuuuguuccuauuaucuauauacacccaguguuucacuagcaguuaugagagcagucagaauagcagcaucaaaguuaaauaaggaaaucuagaugauugcuagauuuucucuaaaaauaagcuuaguauuugguauuauucuagccuuuggugagcagaaggggagguaaaguaagaauuaacuaaauuuaguaagggauuagggaaugcuuagacauuuuguagguugggguauacaaggguaacucaggaagcuccucaguucagugaaaauucaaaggguuggcacugagcuaggaagcgagaaugcaggguuaugaaaaaggaucccugcuuugggagcucauggacuuguagcagagaccgguaguaaauuggcagucucaguaacuucuguaaaugauugcaucucuuugcaggcuucucuucccauacucucccccacuccuccuuggacaguguuccggggguucuuuccuaagcaacugcuuuuucaguauacauacuucagaugauugugucuacuccaggauuuccaacgaugcuagguuucuuuccugugcccuagacguauaggucuaaguuccaccuggauaucccacagggcuaucaagcucaguucauccuaaacagaacuuacauucauccccaacucagacuuccuuauucuuuauuauugaauggcagcucuguaccuuagccaagcuguuaucucuaggucaucagccuugacucuuccuuuuuccuugcauuucuuaaaauugccaagucccaucaauuuuaccuccuggauaccucuugaaucuauuuuuuuuuaaagacaggguuucacucuaucacccaggcuggaguucaguggcacaaucuuggcuuacugcagccaccaccuccuggguuuaaacgauucuuccacuucagccucccauguagcugggacuacaggugcccaccaccacgcccaacuaauuuuuguauuuuuaguagagacaugguuucccacauuggccaggcuggucucaaacucaugaccuuaaguauccaccugccuuggccucccaaagggcugggauuacaggugugagccaccgugcccagccaaaucuguuuucauuacuaccuauaucuguauuuucaaccuuuguauuagcaucuaguuagggauagaccaggacagggccgacauguuaguugucaagcagauugccacccucccccaccacugaggaggccaaauggaguuugguggaaaaucucuaauucauucaagguauuauaugggcaagcaauggcuguggcacaggguccccugauuacuuuguaagaaugggugggagggaugcugauuuucaauccuuuugcagaucuucucucauaguaacacaauagaagauacuuugccacuauguuguuugccaaacucacuguaccuacuugacugguaacaaaagucccaagaguuacuugggagaagacacuugaaaaaguauuuuucuaaauaugggcaaggaugcugcccuuccccaaacuguuaguauaccaccucucugaccaauuuucccaaggaagauauugggguagggugagguguaaagaaaaaguggucauguaaauacugguaauaaaagcuguucagugggguagaguuggguugcaacuguagccauucuaaaaaugggcuaucaauguccuuuuagccaaaagacuuuaguauacauccuccucauucuacccucaggauuuggaucuuugccccugauggguauccauccccuuugaaacuuuagaaaggcagguuauauacagaauguucaaccuaaagacauuuccuuaagucauacuuucaugcuuucuaaacuauaaucacccuuaucauccccugcuguuaugcuuucccucugcucccuguggccuaauguuccuccaccaccuuauuaaccuucaggauacuuuuccccuaggcugggcaggacaacacuauccccuugguccacaagcucccucaagguuggggaaucuuuguuuacuuagcaaauacugaacauaaccuuaaagcgguuacuuuugaaaacuucucaugcuauucuaccaacuuggaggcaccuauccaugcucauuccccuaauguagccaauaugguuaucugcaauguauuggcaucuaaaaacucccuuaugaaacugccagacuuguucuggaacauuucaauuacaugcaaaauucagguucucaaguuggaacaagucuaauugacacaccugcauagguuuuaaccuugcccucccccuacuucccaacagauuuccaaguuuuuugagaaggaaccuugcucuggcccaggcuggagugcaauggcgccaucucggcucacugcaaccucugccuccuggguucaagugauucuccagccuccugaguagcugggauuacaagcaccugccaccacacccagcuuuuuuguauuuuugguagagacgggguuucaguuugccaggcugguaucaaaccgugaccucaggugauccacccgcauuagccucccaaagugcugggauuacagguguaagcuaccauacccagauuuccacggcuuuuuuuuuaagucucacucuguuacccuggccggagugugguggcacgauuucagcucacugcaagcuccaccucccggguucacgccauucuccugccucggccuccugaguagcugggacuacaggugccuggcuaacuuuuuuauauuuuuaguagagacaggguuucacuguguuagccaggauggucucgugaucugcaugccuuggccucccaaagugcuaggauuauaggcucacgccuauauuacuauauaguggccuauauuacaggccacuccgccuggccuccaaauuuccaaguuuuuaagucuccaugcaaacaggcauaagcaagcacuccuuggcucuacauuugcaggacaagcuggaccaccauucagauguugguagaaauguaauccaaguggcuauucucuaugcauguagcuccuagguucaagagcaguguggucugcggauuuucuacacaaccugccauaaaugaaauuuaagccuuuggaaauuuauagcauuuucagcuaauuugcauuauuuaucucugcaagauauugacuagaaaucacguuucagaacuucucagaugaaaacaucauacaacccuuaaaacuaagcucauaauuuaaaaauguaugcagauuaauaggcuuaaauugccaggacuuuagauagacauuaccacuuccagguuaauacuuuuagcgguuuuuaugccuucaaugguuugaagcccucaaccuuaguugaaaacuuaaaaauggcauugaauggcugcugcaauaaggacacaugaauuuuggcuuaaguggacuaggaggacuaaaucuugcuuaggcuuuuaaaaaaugcccacccacugggucuagggauugagguuauuuuccugaauuauggcuaauuauggauuacaauucaagguuaaagauacacauauaguauucucagguuauucauaugauagcauuuuuuaagagccaaagucucagucacccaggcuggagugcaguggcuugauaaugguucgcuacagccuccaacuucuauguuaaagugauccuccuaccucagccuuucaaaguguugggauuauaggcacguaccuauggccccaaagcacuuuaacaaaugaguaacagacacaguuaagguagaaccuagcauuuuauuuagaucuucauuaaacuguuggaauugagaaccagacauacguaauaaaccuccaaaaauagauccugaaaggcacuuucugcuuagggcaagcagucauggaauaagcauguaaacaagcuggcuucucuguaccacaccagccaagucagcuuucuccauggccagccgcaccagcucugcccucccuucuguuaacaccagccagacccccuguaggucuaacccaagguuuuucuguaggacaccuuggccuaccugggaaugcuggaaacauguuguuaaaggaaucaugguguugagagaaaaaaaaaaaaucuuuuaaaagcugccaucugaggugauggcuucucuguacuuacgccauaccccagaauacaauaaauaagcaauuagaaaac

SEQ ID NO: 191631 - RNA, 12744 nt, Homo sapiens
uaacuuuauaauuacuuaauuuuauuuuuuuaaagcuuauuuugguguuauucaguauauaguguuuuacugagcuucugcaaaugccaucacaauaauaguuuuguuuucuugaacaaaaaaccaaaauaaauuucaaauguuaaagcaauggaaucaauaaauuuauuaauguuacauuaacacgaacuacaaagagaccuuucguaugucugauaccaaagacauaacugaaaagucauuuuuccaaaccuugagcuugcauucaccuaccugucuaacccucacaugugcuaauuaacugcaaaugccauuucugggcuucacacacauuccguggcuuucccuuuucugaugugacuucccucccuuaccccacaccucccugcacuguccccugcugugcccuuggcuggaaugcccugcagccugcuucagcccagcaaaguauucaucuuaccaguccaugcccugacuccugaugucacccuucccugcaucacccuucccuguguauuugguggauaaggcuugauugaggcucagguacugagucccugcuggcacauugagaaccagcugccaccccgaugauaaggaagacagacccgggacuuccauaugaauuggauaugaucaucugacaugcacccuacuaacugauggauccugcuguuaccccaaagcuccagaaccacacuggccagacacaggcauuuccuguccccugaagagccacugaacccagcacaaaagagaucuagagcucuccaaaccuauggaauggcaaccaaaaccacgcccagguuuugaguuaagccucauuagucucccuuuucccuugacaguguagaacugugcagcguagcacuaaaugaaugagagcagaagccucaggacagaacugaacccaccagguugagcugacaacacugccagggguucuauccacagauggaauauucgcuuugaucacugaguuaggaggcaugggugagggaugcagagcgccgcucgucaugagacaucaagcuauccaagucaauauccuauuaguagggauggcauguuauaaaaggcguaaagaucucaccugccccagcuggaagcagugauuccauugccccagauucggaauugugauuuaaacuaggccucucuucaggcaucagaaccaaauuagagugcuuuauacgugcaaggaacuaaugcagaaagacauuauggguaagucaagggagaugccccagccauugggcaaauuccucugacuccucccugauggaacuaauucuuuuucuucugugcccggauccuagaaucaagauucuuaaggucugaguacaaguuccgcuucaggauggcgcugcugcacagcagggcaccuugcagggccccgaccaguccacaggugaagauauccuggccuaggaggcaagagcagaggccccugagcgugcacccaggcaggcccaggggaggguggggccuuggugcucuucccuccacaugagggccacccagagcuggcuccaaucagacaggggccacagccugcccaggcagcccugcucaggggaugggaggcugcaggggacagcagggccugagggcaggaacagaggacguugggcgacaggggcccagggucucagguccugacaacauggggcagugaguauaccugucagauagagguuggggauggggcucugggcccucaaggaggccaucacacaagggugcaggcggcccaggucauggucagccccguagcaggcaccucggggagcagccagauagaacugguuggugaguggggauccugcagucacacucuccaccugagggcagaaaggguggggcaggcaugugagauccuggcuccccucccucuuccacucuuucccauucacugacugcagggaugggugcccuguccuucccuggggcucaugucuuggggccugauuccccugucucaaggaaagggcagaaacagcaccgugagguucgucaccaccccaaauacuuuacccccuaccuuccccuccagcugugggaacaguuucaggaccacugacauagaggcuuccacaaaggaguuuuugaaggucucauagucacugccccgcuuucccuucagcuccgccugccacuccucaaaccacucguaggcaguggguaugagcaugaucaugguggaccggccuggggaucagagcugauauuacuacugcccggccucucccuccacccccucacccgggacgugcagccccaccugggaaucgguccucccaggucggaucuuuggcugaugggaaagcgaagaagagaagagggauguguuccgcagccucuucccugggcauggagacguagcgcuccauccugcaugugacaagaguguggugggaucuccagguuuuuguccucaaaaccccagaaccacugcaaggacugcuuaucccuagggacuccccacaggggugaagcugagccacagccuuggcgugacaaacuuccaggagcaaauuagaaauugccuacuuccucccauuccauaaccucugcucauucucugagucaagcagggaggcacgggccacacacauacacacacacgugcaccuuacgccugguccauguccgugucauaguaaacauaguaguugguggacggcagaugcaggucuuccuuggugccucgcaggcagaugaaaacagaggucaugccuaagccgggccgcaccguccccaguugcugcuucacaccugccagggggagugguuggugccuguguggaccauggccggagacggccacuccuugcucccaggagagccuuggggugccagcucuggcaccugccugaggcaugccgggccccuggccacucugcuuccuucauuuaacuaaauauuuuugaggccuucagaucguguucaggaggaaaauucauagacaagggaaaauuguaaccagacagugagaggggggcgggagggacagaugacuguagcagggcugccuggccaggacagugucaguucccagagguccugggacaggggagaagggaggucagggucacagagagaaagguaggaaguagcaaaggcagagucugccugugcaccaagcccgaccucccugcucugccccugggccaucucugccucaccccuucagcuccugagagucugagagaggggaggccgagcaggcugcaggcucagccacgcagggugaaggaaggagaggcuggcgcuggugaaaucacccuaugcccuggagacaaucacaacugccuuaccacccaguccccaugcggaaagccaggaccucgcuuuaccccccagcccgcucugcuguccccuuccccggcuccucagggagcagcucccgggcccacccucuggggucagggcuccuuccccugcucucuagcuccugcaccagucaagguuuccgccauaccauauccggagcuacuccaugcucuccagcucccgccccauccugaguccuucaucugggccccucucucucaccccugcuggguuacugguccccucuucccagcggccucccuuccucagauccaguuacaugaagguggcgggaccucuuagcugcguuggcucggcggcucugcucccugugggcugccugcucuccugcuucucuuccugaggccucuucucuggaagcccccucagcccagaagggugggaggagcggagcuuucaaaucagaccagcuacucugcucagcccugccccuuucagcugaguggccucaggacuguaauuaaucuguaugggccucaguuuccccaacauuaaaugcuaggguuaggaugauguuagagguagcguucucaccuuguugcuuaaggacaaucagagggccggccaagaagaggagaagcaugacccacacggagcagguuggcuccagaaggggacacauuggggaaccugcaagaggggcagugcagacccgccuuuuaccuggcaggcagcgggcguuccccggcaguagguguucauagguguugaacaguccugcguuggagaccacgauggggcaauagauguucaccagcucaugccccuucuucacacugacaccugcaggcacaagagcuuggcugagggucugugagcucugggaugaagagaaaggcccacggcccccauggaucucucucugccugugcccauuucucagaccuuggaguccagcuaccuagacucaggcagggcaggccccugggaaaaugcacagugagugaguaucuucaggugcuuucacacuauccuacaacugcuugggcuuacuuucccuagcucuguacccaccuguguguguguauguuuguauguacucuguguuugagccaaaucccagacaaagcucaagggcuaaagaccuuccacuggaaauccaggcccuuuucucugcugccagaguuguuuccaaauacucuuuaauacccuccaaucggggcuaggcacagugguucaugccuguacucccagcgcuuugggagucugagguaagaggacugauugcuuguguacaggaguucaagacuagccugggcaacauagugagacccugucucuauagaacaaaaaaauuuaaauuaagcuguauggaguugugcacaccuguaguccuaucuccucagccagaggaauggguucagcccaggaguuaaaugcuacaguaagcuaugaugacacuacugcacucuagccugggcaaaagagugagaccguguaucuaaaaaaaaugaaugaaugaaugaaugaauaaaauaaaaauaaaacccugcaaugaugccucauccuggauaagagaaccuccaaaaucuuacagcagccugugcaauguggucccuucuguguguccagcuccauccgucucuggucacucucacuaaacucccacuaaacuauuaggcagaaccaauaucaaacagcugagagucaaccauuucuuaccuacaaaaauggcaguuucuuauuguucgaccuaauacuucuggaugccugaaaacacccagcucuuucauaucuccacaccuuugcacaugcugcuucccauuccuggaauauucuccaaccucaucugcuugcuagcuucaucucacccuuuauuacucagcuccaacaccugugccuccaggaggcuuccccuguuccaccgugcugucuguuauccccauccuuagcacacgccuccagauggcaaguaaaugaaugcuuuuucuuuuuuaagaugaagccucgcuccguugcccaggcuggagugcagugguucaaucucagcucacugcaaccuccgccucccagguucaagcaauucuccuauccuggccuccaaguagcuaggauuacaggcucccagcaccgugccuggcuaauuuugguauuuuuaguaaagacaggguuucacuauacuggccaggcuggucucgaacuccugaccuugugauccacccaccucggccucccaaagugcugggauuacaggcgugagccacugcgccuggcccuggcuaauuuuuguauuuuuaguaaagacaggguuucacuauguuggccaggcuggucucgaacucccaaccucaggugaucugccugccuuggccacccaaagugcugggauuacaggcaugagccacugcgcccggccucuuuuaucucuaucuuuuauuaccuagcacuugaaaaacaaacaaauauaucuggauuguauuuaacucaacugauaccuugcuuccuggaccccuuucagcugaaaggagaacuuguucauggacaucagagaaaaccuugcccaaccaacagccaccucucucuuaccacccgguaacuuaucagucucuccuacuaauggauucucucagaucacugauggccuuuucuccuucauuuuucauuuugcacugggccccccacuuaucaccuccuugaaagguuccucugauaaaugcaugucuacauuagcccaguuuuucccaggccucuuuuugucugcuucccuggcuucuuuaagcacccauuagucauagauggccuauucuguuuaacagaguccuucuugcacagacccucuauuccaagaguucauuuauacugggauucugagucccuaugcggguuacagcaucaaccugagccaggguaauaacguucugggccccacuuuacagauagaggcagggaaccuugcuggccuccauacuauccuguggaauccaagguuacucauucauucuauuggccacugaacagcauuuauugagccucuaauaugugcuaagauuuauagauacaaagauaaaagacagucucuacacucaagaagauagucggcuggucuccgugccugacgccuguaaucccagcacuuugggaggccaaggugggcggaucacaagaucaggagauugagaccauccuggcuaacacauggugaaaccccaucucuacuaaaaauacaaaaaauuagcugggcgugguggcgggcaccuguagucucagcuacucgggaggcugaggcgggagaauggcaugaaccaggaggcggagcuugcagugagccgagaucacaccacuggacuccagccugggcaacagagcgagacuccaacucaaaaaaaaaaaaaaaaaaaaagaagacagucauagauuacuggguaaauaauuuuaucuauuaaauaaauaaauaaauacuguucuuuggggaccaugcaauccuuuauuuuucuuuucuuuuccuuucuuuuuuuuugagauggcgucucgcucugucgcccaggccggagugcgguggcgugaucucagcucacugcaaccucuaccuccuggguucaagcaauucuuccgccucagccucccaaguagcugggacuauaggugcgugccaccaugcccagcuaauuuuuguauuuuuaguagagacgggguuucaccguauuggccaggcuggucucgaacuccugaccuugugagcugcccgccucggccucccaaagugcugggauuacagacgugagccaccaugcccggccauauuuuuguuuuuuuuuuuuuaaagagacaggguuuaaccauguugcccaggcugaucucaaauuccugagcucaagugauccucccaucucagccucccaaagugcugggguuacaggcuuggaccacuaugcccggccaauccuuuaucuuuccugcuuccuuuuuauuucuggacuaaucacuaucccuggacccugcucuggggcagauucucaccuuuagccuccaugaggaggucaguucuccuacuccuucuggucucagggagaccccaggucucgcccacaccaacccagggacccagaagggcagggcggggcagggcucucaccacaggcuuucccagcugaguccagcaacacacucugcacaguggccuuugugaggacagcgcccccagcccgcugaaucacagggaugguguggaaggcaauuucacuggaacccccucggggauaaaagccuccuuucauguagugguugaccagcagggcgugcauggaaaaggcacugugguugggggugacaccugcagaagcaaggaaggguggugagcuggcaagagaaggcaccagcaccauucagaaaggaacguggaauucugugagauaacacacagcccagucuauccgaggaaccacauguuccucaggguccaaggcagccagaggagccuuuccaucuagacaugggguaccuuagagaucuuggcgccaguaggaauacccccccugcaaacugccaugcugccaagaccaaggaggauaguguugcuugaauugaaaaaucauccaaggcauggaugaacagaauuuugaccaaggaguccagcagguggccagacuucucauccacaagcuccagagggccugggguuuacacugcuccauaucagucagccaggcagggucgagaagaaagauugagagaugagagggcagccguuccuccuccagaagcugcccagagcccaggcccaguacccaccguaaguggggaagauguagcugaguacugccuggagcucagaggaggcccccagcugcugcaggaccucagccaggcucuggguggaugcuugaaggaauggagagaaacgagucagcagcccacaccugucgaggagcugaaccacgggcaaugggaggaauuucaacaggauggcaugaggggcuccacuggauaccaccugggggagugaaugaggacagcaggccucaccucuagaaccgcuuugacagaacugcuauccccauagccuggaccagcccaagaauccagcaacacuuaccccugacugaacuuugcugaauuugaauauuuuuaaaaaaucuauacucugugaauuuuucccauccuacacucggaugaguccuuuuuuugcuuuuaauuuuccugcucaaauuccuuuucaaaaaucccaaucuggucucggaugcaguaaaaaggaguagugaucugaugucauggaagccagccuagucagggaggagagcagggcauccccagaggccagggugacagcagcagccguggagccaaggcuccagagagagagagacagagaacuggauggacuuggguggaggcugagcuaagaacagaugugacucuuccucccuuccugccucccgcacugcacucuccacccccagugccuccacuaauaauaaagaaacccagccuuaucgagaacaaacucuggguccucagcauguccauguuaccuuaaccagcuuuauauacuugucaaugauagcuuccuccuguggaaacuucuccuugaggcccugaauguaggcuuucucuccacuguacaugggguacuccuuucggccauugggcccuuccaguaccaugaugucaaaaggagaggacaggggagcccaguccagcugcccuucagugaucugguccaagauaaaacggccaaugcugcccucuuccauacgcccaauguaauggauuccuguugggagauggaaaaacaagguaguaaagggauauggggauugagcccuggaaagguggcugaggaagugagguggaagaguuuaucuggccuggccaaguucacgcccagagugagcugcucacucugucuguagggaggugucacagcagaaaccgccagaucgcugcccgauucaacucccaguagcuaugcugucacauaagaaaacugcccagaggcugggcacgguggcucacacccauaaucccaacacuuugggaggcagagggagguggaucacuugaggucaggaguucgagaccagccuggacaacauggagaaaccccaucucuacuaaaauacaaaaaaauuagcggggugugguggcccacuuggugggauuacugaguguaaucccagccacucgggagacugaggcaugagaaucacgaacucaggaggcagagguuacaguaagcugggaucacaccacugcgcuccagccugggugaugaagugagacucugucugaaacaaacaaagaaaaaaaguacccagagagaagauggcacuuccaaaacaacagaaaugcucaguaucaccccacaagggcugcuccaagccucuucaacauacagccaugcucccaacccuuuuccacacaagccuuaccugugucaaauucaaggccauucuuuccaaagguaugacagcagcccccugccuugguauguuguuccagcaccaggacucgcuugccagcuuuagcuagaauugcagcugcagccaggcccccaaagccacugccaauuaccaccacauccagcuucuccggcacuugguuggcugaaaaagcuacagcagaagggccaaaggguggguuucucaggcaggggcagggaaauagcaaagauagggaaaccaaagaagacuucucuagcuuguacagugcaagaaaccucuagagugguuuggcacagaacucuugacuaacauguuucaaacauuuuaccugggaauacucagaaccagccaggcagauuugggguuuugcuuauuuguuuuuugagacaaggucucacuauggcccaggaugaagugcagugaugugaucacagcucacugcagccuugaacuccuggccucaagcaauccuccugccucugguucccgaguagcugggacuacaggugcaugccaccaugccgggccauuuuauuuuuauuuuuauuuuuauguguuuaauuauuuuuuaagacggagucucacucugucacccaggcuggagugcaguggcgcaaucuccgcuuacugcaagcuccgccuccuggguucacaucauucuccugcuucagccucccgaguagcugggacuacaggugcccaccaccacgcccggcuaauuuuuuuuuuuaauauuuuuuaguagagaugggguuucaccauguuagccaggauggucucgaucuccugaccucgugauccgccugccucggccucccaaagugcugggauuacaugcaugagccaccgcgccccgccuauuuuauguuuuauagagccaaagucuugcuauguugcccaggcugaucuugaacuccuggccucaagugauccacccaccucggccucccaaauugcugggauuacaggcaugagccaacacaccagcccacaagccggguuucuuuggaagaugcagggucugcaagcaauaguggaauagcugggucuuaugguggcucuuccagguccugaugaaaaggcuugggcaggacagaacugcucagaggcugcagcucugagaaaucacagcaccagccccucccauagggaaggucugggggcagugcugagggaggcagcaccuucucagaagacaaaacuggauagcaaguggugcuauauggguacuuccgacacaagaucuguucuuuaacaaucacuggcaaagaacugagaucugggauguuucaagauacaagagaacuuggcaaacugcuuauuuuuuuaauguuuuuagagagaucaauaguaaaaaaaaauuucacauguaaguauauaagauaaauacaugaaacaagugucacaaugcaauacuuaguggaacuauguauaaugcacucugauauuuucuauucuacugcauucuaaaauacuaguuguggccaggcgugauggcucacgccuguaaucccaacacuuugggaggccgaggugggcggaucgcuugaggccaggaguucgagagccuugacaacauggugaaacccugucucuacuaaaaauacaaaaauuagcugggcaugcccacuacucgggaggcugaggcaggauaaucacuugaacccaggaggcggaaguugcggugagcggagaucgcgccacugcacucuagcauggacaauagagcgagacucuguuucaauaaauaaauaaauaaugccaguugcaacucacuaaauugauuucauagcccacuaauagaucacaauccgguuugaaaagcaguuaagcuagucaucucauuuuuagaccagcccagguaggugcuaaugguuaugcagcaaauuagugacagaguccaagcuaaaacucaguucucagaaguccagaugauuaguccuuccacuuagaacaguacugucuccgauuguguagcaagauaugacacggagaauucuaaaauuuacaagugagagggacuccguagaucaaacaggugauccauuauuuuuuaaagcagcagaacucuuuaaacucuagaagcaaccacaaaauauguuuuaaagaugagaguggagagcaggcucugagccugaggcgccuuguugaaccucugccaauguuucagaacuaggguucaauccuuacgauuugggaccaugcaaagccuguuaaaucaccggacgggcaaaacgcaauuuccuacgcauuucugugcugcucccccacaccccugagcucgcaugggaggguaggugaaaaaguuaagguccuggaaccaaguggaggaaugagucacggggauuaucaguuccacgagccacggggauuacaaguggcagggcgggugccaacaccuugcaaaccaaggacaaugaccacacccuugggacuacuauucccggggccuacuagggcaaaggcuaucgacaguguugcacacuaaagcggggcuccuccacgugcaaggaagcccuccuaguacuuuacauauggggaaacuaaggcccacgucugguagcggcugccuuggcaaaaugagaacccaaaucugugagaaagccucgagugcagccccggaccccagggucccuccugcuaccuuguuugagaaccuucuuccuggccuccuugucaguuaccaggggcgcugggggccguuugacaucuucggagaaaggauucggggagcugccagagaauagucccaaguaaacuuugcagaggacggccagcagcagcacagccaggagcagcaccagcggaagccacaucacgccggcgucgggucggguaaaugggacagcuccgacugcgcucagccucuaggacuguggcuccgcccgggcuaguucgcucuccagucaggaggcggaggcagcuuugagcacugauuaaccagccagccagcgaagagccaacucucaggugaugauugacccucccggcucuccguacuucuuuu

SEQ ID NO: 191632 - RNA, 176929 nt, Homo sapiens
aaaaggucuugcaacugcaauuuuauuuucuuuugugaaaauaaacaacugggaguuuaaauugcuccaaaaaccauaaaaacaaaaagaaauacacacagaagaagcaugugaggugauggggaagggaacagggucucuagaacuuuggcagauugugcuggcacggacccaggugacaggagccagaccauggggccggucccgccugccacucugggauugugaagggaugaucgccacuggcaaggacggggaggaacacagacuucuucgcugaggaaguggcaggcaccuugagucccuuuaaaugcggggguugggaggaaaccauuucagaggaccgcuuucuccacugaaagcuggggcuggcgaguucgggcccacugagggaggggacgcugguggcagcaaaucaggccaagaugucuucucacauggugauggccucacacugggcagaggacagaggacgaagaagaacccacgguauugagcagacgaugaaaacuugggcuggguaacaggaaaugucacaauggcagagcugcagauggagucggggaagcuggggcaggcggcaggggcgagaagagacaggagacagaaagugcaagagagguaagagagagaagugcccucugcccagguccauccaccacagcaccuacaggacgaauagcacgcuacuuuucaguucucuuucuuauaaagauuuuuuuuuguuguuuuguuuuguuuuuuaaaaaagccuuaagaucagcuacugguuacaucuacaaacuguaaagugcuguuguuaccagccacuuuacagaacaguccagaguggucaaauauugaccaauaaagucuccuuuuucuuuuucuucugaaucauuacuacucaaugagucaugugacagccugcaggggucggggggagcuuagugggcagacuuggugaccagggaaagaggcugggccuguagcaccgggagggccuggugggcauggagcguggcggggaaggacgggggagaggccagcagagcugugggcauggacccaagggggaggggccgggacaggaggggaggcuggcugcccaucugcccagaggaggaggcugcagccuuagccgacaggaaggcggcagaguggagagccagcugggcccggguuucugguuugguggugagggagaggggcugggcuugcuccgaauggguggcagcaggggcagcuggugaggccaaagcugcagagggaguggccggggaguccagcaugcucccgugggaggaggcagggcugucacagggcuucucggggggcagguacugaacacauggcuucuugcucuuggaggccagggcaccuagggggaaaauacaagaaagagugagcagcuauagcucugugagaggaggaggcugaggaacagcccuggcgauacaugugcuuuggagacacagggaugauuuuggcgaggaccugacauuacuuccaaggcuuucaagacuaggaaacugcauucacaaauacccagagcacagagaagaggcaacgcccaaacugaugaagauccacccagcaucagaucggagagaagacggcucagugucucacaggaccacccuccuuuccuaaagcugguaacuuuugggaugaaucuccaguuugcuuugaaaucuuugguuuaugguauuaauacagucagagagagugcaugccugcugaacagcgugccagacagcggguucuguagcagguacggguuccacucaugugcgcuccuauguauaauggaaggaaggaaggaagggaggaggggaggcaaggaaauagggagggagggaaggagaaagggagggcggaaggagaaagcgagggaagaagaaagggagggggggaagggagggaaggagggggagagggagggaaagagagggagggaaagagaaagggagggagaaaaggagggagggaaggggaaagggagggaaggagaaugggagggaaggugaaagggagggaggaagaaagggagggagggaggaaugaagaagagagauugaaagcacuuuacaucgugcaagcagcgauacacuuguccuggagugagcaugagauggggggcgugaccuaaauauuaauaauaaucgucacagugugagcaucuuucugugcuaggcaugauucugguaauauagagauuuuauacaugguuuugacacaaagugccuccuaaacccaagcaaacuaauuuuuucugguguucaaccaaagaaacauccaaggaaacccgggcuccccuggauccacugacaggugggaugucaggggcucaugugcugccuuccuaaggguauuucaaagacaauuucaaccucauuccauuaacccucagguaggaugauucacuuuucaauggaauuagauugucuaggcuuugaagugacaaaguccugggaucaaauccuaccaccaccacugaagcagagugccugggaaaaugccuucacaucucagagccucuuaaguggccaccucgagaaagggguaauaauacccgcccgcgaauaccgaggcagaagcccugacccaucagggagcuagagacagcaugggcagguguggcugugacaaaaggaaaagcaggagaagaggccagugccccgagacgcacccucugccuccuggacuugcugcugugacugugucugggacagcugcuuuucucucuuccucuucuuuuucuuacccuggaaaauacagccaaaggaagagguaagcugggagagaagaaugcuggcuucucaggggcucccagaucagagagaagacaggacguugcccuuuacugcucucgaucccucagggagaguguggagagauaauucagaucacagccgugggagcccgugaggaggcagagggagcccuuccuccccuacaaacgcguuuccccuccaggucggguguccaggccuucuuggaaggccuccucccuccacugcccuucagacucuguuuuucuguuucucucccuagaacagugcuucuagaucuuuucugaggggucccaggucccuuugaaaguuugaugcaacuguggguccucuuaccagaaaaaaagcaaagaagaacacgcaugcgaaaauuggcuugguuuccgggagcuuagagacacgcccccugaggcucacacacuggucuuugagcccuggguuaggaguggcuggagacaacucuuccuaccacagcuaaccccgugcccuguguuaugaaaucgagggcagaguccaguucaaagggaaaugcaucaacugaaguccguccucaggacuuguugaccuccugagaauuaaaacaccuuccuuauuucuagagaaguaugggcuucucccugaucuuaagaguccucuauaaaugcagucgcuggccgggcgcgguggcucacgccuguaaucccagcgcuuugggaggccgaggugggcggaucacgaggucaggagcucgagaccauccugguuaacacagugaaaccccgucucuacuaaaaauacaaaaaauuagccgggugugguggcaggugccuguagucccagcuacucgggaggcugagacaggagaauggugugaaccggggaggcggagcuugcagugagccgagaucgcgccacugcaugcacuccagccugggugacagggugagccucugucucaaaaaauaaaagaaaauaaaauaaauaaaaauaaaugcaguugcuuuccuucacccuuccuccucuugcagaggcuguuccuggggucugagcguccucugcccagagugugcacuuacauaguugucccgggcugaccagguuggguagagcugcgagugaagcugccgcuccuuccgggccagcucguaguacuuggccuguucuucucgagacagguugugccacugggggagagagggucagagaccacacggagccaucaaugcagggacgcugccucccuggccuggagggagagggcaggucuuaccuuucuuccaaggaucugguuaauggcugcacuuuccuucagggugcacucagccaccaccuuggcccucaucuccuucauauacaacaugaaggcauucagaggcuucuucacguggggcuucuuuuccuccuccuuuuucacggugacuggugauuuccugggaaggcacgugguuguagguuagcaugucaggugucacacaacucaucaauccccaccugucacugaaacaccgcugauugucucuggggaggggcgcgggcugccuggaugcuaauucaaguggccccauggcugcacucaacaccugaguaccuuccucccguaguuucccaccuuugaacgaucuccacgccagauucuuugaaaaucuacucuccaauuuccugacagaggaacagagcauggugggguugcugagaugagcucucacuggagcuggcaggugcuggcggcggugacaggacacaguguggggcacucugggcagaaccaaguugggaggggguucucuugggaucuccagggagcacugacuuuggcuuccugccaucuuuaugguacacgggcaagguaaggacccuggugcucaucucagcucggccaccagcccaccacaaguccuuaagaaaacacugucuccuuucugggccucaccuuuucauauaucuuacggugggguguuaaaagcuuucucagguucucuuucagccucugagaccugacaguaaaacuuuccuuaauaagagagaagaugcaccaugucccugaaaggacagggacccagaaggucagagggaguaagucccgaggaagagggagggccuggcuggggaggcugugaugccugcugagugacaccaagagagaagaguacaugacauuugcugcucagaguguggccaccccuccccacagccugcacccucccaccugaauccaggcugccgcuuacuuacacgcucacugcagggcucaggcuggggggugccgguuccugcuugacgaugggggagacgauggcagggugggggaucccugaggugggcaggccagggugggcaggagccaccaugugaggagagaaccgacuggagaccaggcugugcaccggauagaaacaaauggcaacagagggguucaggcuggauaccugccacccagcagaggacacgguggcucucugccuuaagggcacaggcauguccguggggcagagucucaggacuagaaggcuauuugucgucuucuagaaaaccagguuugggagaugcuuaauggcucuuccuucuccccaccaacacccaggcugcccaucuggugcuggaagcaggugggaugaaacacacaaaaggggaggagggucagaggcccgggcauacuggggaaaagaagggcuuaggcugugggcagcuuuccucuguccucagagguuccacugucagguagagcuggucccugagacagaaauccccuuucaccgucuccucuccugacaucauuucaggaaaaauucaucuucucccagucccuagcuucagugugauauacagacaguccgugacuuaggauauuuugacuuuacgauggugcaaaaacgauauuaauucaguacucuccuugaccuagaugggguuaugucuggauaaaaccaucauauguugcaaauauucuaaggggaaaguuguguuuucaauguacgacggguuuaucaggacgcggcuccauccuaagucggggagcaucuguccucaaaaugcuucagugccagagcccauggcaggaggcagagugcuagggcuuugcaauccuucuguuggagagauggggacagugauccuguggucuccauucugaccuggggguggggagcgcgggacgugagaagaugcuugaucaaagagagguggggggagggugagcccugugccugcucauuaacuggcaagaaaaagcuguuucguggucagaaauggcgugguugcuaagacaaacaugcggacagccccagccccgggacucaccuggacaucgaggcguucauggcgagggcgggguaagggugccggaagccaccgggaggaagggaguacaugggcuggccuugccugugagggggaggaaaucuggucagcauauugggaaagcucagggcagaggaagagaggcacuugggaagaagggaugagaaauaugggaaggaagcgggaagguaaugcugggagcacgcugccugggcgggggcagggaggccuaguccugggcuugccucugagggggcuccacugugcagggcgcgcagggcacagaggcagagcucagcgcaaggagggagcagggggaagagaggcuguggguuccuuacugugggacgagccagccgagggggugggggauuuguccgacagcuccgggagagaguggguaauacggugacagcucggaugggugagggggccgggggauuccugcuuccaaagagagauaugucagacuguucccucgcccugccagagcaccuuaacgaacaucaaaugggagcauccugcccuaugucccuggugcucuggagccuagcaggugcuugugucauuguccuugcccucugucaacucccuagcagcucucaccagucagucaaggacauauucaggggaggcaggacuaaugcacccccucucuagcugcacggauucuaucucugugaagaguaucuuccagcuggcugugauacagaagccagcguccuggaagagagggacaggacccacaagaccaaugacaagagucacuggugaaccaagucucuagaaagcccgccucauucauggagaaauaaacuuuggauuccuccuccacaugugucuuccucauuaucuguaacuuguagugacuguuauuucuccaaagaggggcuccaaaaaugcuuugccuuccccuggcaacucugugugaaugcuauaaagacaguggcucccuggaauggacaggucuggugggcaaguuaaaaaaaaaaaaaagaaaaaaaagccaguucagguugggcaugguggcacaccgguaaucccggcacuuaggugaguugacugcuugaguccaggaguuugagaccagccugggcaacauggcagaaacccaucucuacuaaaaauacaaaaauuagcugggcaagggcaugguggcaugcgccuguggucccagcaacucgggaggcugagggaggaggacugcuugagcccgggaggucaaggcugcagugagcugagaucacacuacugcacuccagcuugggcgacacagcaagacugucuuaaauaaauaaauaaauaaaagccaguuuggccucacugcuuuacgguugcacuucugugucugcuuagacugaugaaucuauuuaaaaauguucaguuuagggcaaacaugucuugguguagggaagcacggcccacagcugggcuagacuugggcagagccaccccacacacugccuauggagccaggcccugugcuuuacugcauuuaauuccugugggccuuaucgugacccuaugguggagaagguacaggggaggcacagaugaaaaaaaaaaugacaaggcuaaaguuagcagacaagguccaaagacuccugagacaaagagccaugauuugaacccaggucagccugauucaagggcuguuauguucccacaaaagagaagcccgccugcccugcagcagcacugccugaguggcagacgacuuaccugucuuuggaucgaucucuggggagaggugggugggaggggagccgggggagaaguggucauugcuguaggugaugaggggagucagcggaugcaugugaugcgggugcugaacgacaggaacuuuauuagacugaaagagacaaaaaagaccaggaaugguugccaaggagauggagaguaugaccagcuguuauuuauggaaucaaguaagugccagguauuuuccaggcaacaucccauucaguccucaaaacagucccugagagaugacagcaguggacacagcagagcagcaggacuugagaagggaucacacccacccuccaucgcuccccucacgugcacugugugugggaaacaguacaggcuucuggggaaugaucugcgcugugucaucucaaacacuacaggcugcugagggaugaucugcgcugugucaucucauugaaucuaaaaagguuuuuuuuuuguuuuguuuuguuuuuugagauggagucuugcucugucacccaggcuggagugcaguagcaugaucucggcucacugcagccucugccucccggauuccagcaauucuccugucucagccucuggaguagcugggauuacaggcgucugccaucacgccuggcuaauuuuuuuguauuuuuaguacagauaggguuucaccaugugggccaggcuggucuugaacuccugaccucaggugauccacccgccucggccucccaaggugcugggauuacaggugugaaccacugcgcccggcccugaaaagguuuaacacacauuuuucaaauaaacuucauagaaacaguugcucucagguucaagucugggacugggaacagggcagggggagaguugcccccauuagaccucauacuaccaagucucauauucaggcuuuacagacacaacccuaaagcacuugaaacacuucucucuguaacacuuuacucugcugaccucacuaccacauucuguguaaaacaccaccaaauggaaggagcaccauuauuuuauaaagcuauugagaaaaacgcuggcacgccacagacacaucuucagagauguuaacaugggaaaaaccugugcguucuacaauugguaaacagaauuaacuuuuuaauuguuuaaaccuaaucugacuuauccauaaggcuuuuuauuuuaaaaacaucuacaggucacugaacccugcauuacaaacacagcaccaggcauaauuucuacuccuuauaaccuagaaaagaagcugugauuacccccauuccagagaugagggaacagcccagaaagauuacaugacuuagccugggacacgguuaguaaguggcagagcugggauucauaucagcuguuuauggcucuaauaaacaagaauguuuucucuuguacaaccugucucucccagaaccuucucaaaacguaaaacuuaucugucacagagaaaggacagaaauuauguuuuuugauaauaagauaagugaguuacaaguggagaagagauuucuuuuuaaaagagauuuguggccgggcacgaugacucaugccuguaaucccagcauuuugggaggccaaggcgggcagaacaccugaagucaggaguucgagacuagccuggccgacauggugaaacccugucucuacuaaaaauacaaaaauuagccgggcaugguggcgugugccuauagucccagcuacccaggaggcugaggcaggagaauugcuggaacccaggaggcagaggcugcagugagccgagaucgugccacugcacuccagccugggugacagagcaagauuccauuucaaaaaaaaaaaaaagagauuuguaaaaaagaugauuuggagguaacccaagggcuacaacuccaaauggcuauauuccucuuugaauuuuucauuucguagauuccaugagaccuuucuuuccuuucauguggugccuauuugguacucauaaugcaaacuccaauccauagauuuccuggguauccuugagcucaccacagccuuguuccuuuucagugugccaagcagagaggagaggcggagaauuaaaccguuuauaaccaugaccaccagguggcgccagcacacagcugggcccugcugguggcuggugggcucacuggauguugcaucaugaauuuaaaaaguacugucuucuuacuguuuucaccuguccaauuacucguuuuugaagauaucuccauauacaugaacauacaacacaaaaauauuaaaaauuauuguaagaucagauuuccaggaagccaaugcaucuuaaugauaguuucuggaaacagcuuugucuaaagggugacuuuuaguaaaauaaauccaauagaauuauuaccagcgugaaaauacauaaucacaauuaaaaaauacauaaacucuguaauuuaaaaaaaggcuaaauagaagcacaccaaaaauguaaacaaguuauauuugaguggugaaacuauggguaacuuugucuuuauugucucucuuuccauauuuuccaacuuuacuuucaccaugaucuacuacuuaaaaaaauauacuaugaauaacacaaacuuucuaagaaagaaaugcaaacuauaucauaauuguaucacaaagcauuuagacaacauaacugcaccauccuaacccugucgcuauggucauuuuggcauaucuccuuucauuaagccuuucugggcaucaguguguguguguguguguguguguguguguguguguguguguguuugagacaaggucucgcucuguugcccaggcuggagugcaguggugcaaucucgguucacugcagccucuaccucccaggcucaagcaauccucccaccucagccucccaaguagcugggacuacagaugcgcacugccacaccucgcuaauauuuuguagagacgcgguuucaccauguugcccaggcuguucucgaacuccugcgcucaagcaauccauccaccuuggucuccuaaaaugcugggauuacaggugugagccacugugccgggcucaguggcucaaaauaaaauuuuauucuauuuugagacagagucuugcucugucacccaggcuggagugcaaguggugugaucucgguucacugcaaccucugccuccuggguucaagcgauucuccugccucaaccucccaaguagcugggauuacaggcacccaccaccauguccggcuaauuuuuuuguauuuuuaguagagaugggguuucaccauguuggccaggcugguuuugaacuccugacaucaggcgaucccccugccucagccucccaaagugcugggauuacaggugugagccaccacgcccagccucugcaucaguuuuaaauuuacauuuauuuacaucauuuauagcugucuuaaaaacuggugauaguauuagcaaauccugauugcucaugugcuguauuuggccuggggagaaaccagcaaacaggacucaauggguaacagaauuaaguauuagguuggugcaaaaguaauugugguuuuggccauacuuuuaauggcaaaaccacaauuacuuuugcaccaaccuaauacaaaguagggaaauuuuuauuugaagaucuauguauaguugucgaaaugcugugugaguucuuaccguuucccacuagguggcaucauuguccagaaaaugaaccgggagggaaggcgguaaguagauaguggccuccuagaaggaagguucuccuugcaggcuucugucccaauaaaaguuccugcucauuacucuccucagcugcccccaggggcaggauguucacagcauauacccaaaccgaggacuaggaauguagggaaccaccgcacaccccucuguggauaaccccaacagggacaaaacacacaagcgugggcaugggugugcauggccaggaagcugaauccagaugcauccaaagagccccugagagccaccucagaccuaaauccuucaggcaagcgcugcaagccagcucuuucuagcucagguguuucccgucuauuucagucuguuucuagaguugguacaagacaaaggucuuuaaacucuggucucccuaggaagccauguguccucucucacaugcuuuuuuuuuuuuuuuuuuuuugagacagagucuugcucugucaccaggcuggagugcagucucgacucacugcaaccuccgccucccagguucaagcaauucucuggccucagccucccgaguagcugggacuacgugcacccgccaccaugcccagcuaauuuuuguauuuuuaguagagacgggguuucaccauguuggccaggauggucucgaucucucgaccucgugaucugcccaccucaaccucccaaagugcugggauacaggcgugagccaccgcgcccggccugcacuuuuuuuuuuuuuuugagauggagucucacucugucacccaggcuggagugcaguggcaugaucucgguaaaaauauaaaaauuagccaggcgugguggcacaugccuauaaucccagcuacucgggaggcugaggcaggagaaucgcuugaaccugggagguggagguuucagugagccgagaucgcaccacugcacuccauccugagcgacagagggagacucugucucaaacaaaaauaaaauaaaauaaaaaauauuagauaaauaaguuuauuaaaauauuuuaauacaguguuaaaaugcuaagaagaaaaacuaagagaaaguagaaaagaaauauagagggggugagcagguuaaacaggauguuucccaggaugaccagggaaggugucaaugagaaaaugacuuuuuuuuggagacacagucucacuguguccccccaggcuggaguguaguggugugaccucagcucacugcagcuucugccuccugggcucacgggaucuucccaccaugccgggcuaacuuuuguauuuuuuguagagauggggguuugccauguuacccaggcuggucuugagcuccuggacuaagcaaucugccugucugggccccacaaaaugcugggauuacaggugugaggcacugcgccuggccugagagcaugacuuucacauuuugaaagaaguggggagcuggacacguugauuguggggaaggacauuuuggccaaagaaacacuaguguaguaugccuggcauagcacgugugaggacccacggcaggccagugggcugcagcagagaggagaaugagggucuguacggaugggucaacaaauacuuucugagcuccugaaaguggugugcugcaggcuacgaaaaaugugaagguaagucaagagucucugcagggcaauaggagagagaaaagacucugggaccuggaaugugcuuucagguccuucugagcaaugguauguuucugaggucuuugcaaguaggacaggauuugucauucuugggauaagccuuuccuuacccaaacucuucuuuucccacuguuugcuggcauuaaggguggcaaaagacagcccuaagguuaccuuuauuuuuguuccuuuggcauuugccuuuuuuucucuucugcaugggugcuugaaggaaaacauuucuaaacccuugcaauuugaacuguuuuuaggauaugucuaggugaaugucaauuuucauugaguuuuauagaauucaaaggagcucuuucaauccauaaauucaaguuuuuguuuuuagagcccauuuuaacuuucuuaauugccucuuuuccuucaguuuggucucuucuuuagaaacacuauuuguagaaugguuuuuaauuuuuuuucucuguaucuaucagcgacuuucucaucacaguuacaaauggcacaaaugugacuugccacaaugucaacuccagucuauacaaagacgaaugggcugggagacaugaguaagaauuucaaagacgcugaagcucaacagcagaaaugaacagaaggaacgaugcagguggaaaaccaucacugccugcuaaaacuagugggugaaaaauugaugagaaauagggcauuggcauagccuuggagccucucccuacaaaacacuuauuaauuacaaagggaaaaauuguuacccuaggguggaaacguuugucagauaccaccuaauccaaacaguugaugcuaacaucacuaauacugggacaaaggcagacuguagggcuaccuccugaaaugagguaacgaggaugcaacuuuagugcagugacauucuggccaaaaaugcacaaucugaaucuaaccaugacgaaacaucagacaaacccaaacuaagggacauucuacaaaacagcuggccuguacuucucaaaaaaugugaaggucaagaaagacaaagacaggcuaaggaccucugcuggauucgagggaacuaaagagacaugagggcuacauguaauccaugaugccagguggaaccugggaccaggagaaacacaugggcuaucauggacauuauugggacacggccaaaaguucaaucuauauugugaguaagauaaugacaugaaaaguuaauguuacuggcuggguaugauggcucaagccuauggucccagcauuuugggaggccgaggcagguggaucauuugaggucaggaguuugagaccagccuggccaacauggcgaaauccugugucaacuaaaaauacaaaaauuagcugggcgugguggugggcaccuguaaucccagcuacucaggaggcugaggcaggagaaucacuugaacccaggaggcggaggcugcagugagccgagaucgugccgcugcacuccagccugggcgacagaacgagacggucucaaaaaaaaaaaaaaaaaaaaaaguaaauguuacuuucuucauuuugaggacuguacugugauuauuuaagagaaugccuuuguucuuagauaauauagcuaaaauauuuaaggguaaagggucacaauguuuccaaguuacucucaaacuuuucagaaaagaaaaaacagagagagagagagagaaagagaagcacaaagcccaggggaaaaaugugugaaucuggauaaagguuauaugggaguuccuuguauuauucuugaaacuuuucugggaguuaaaauaauacccaaaaguggccaggcacgguggcucaugccuguaaucccagcacuuugggaggccgaggcgggcagaucaccugaggucgggaguucgagaccagccugaccaacauggagaaacccuguuucuacuaaaaauacaaaauuagccgggcaugcgggcacaugccuguaaucccagcuacuagggaggcugagacaggagaaucgcuugaaccugggaggcaaagguugcggugagccaagaucgcgucauugcacuccagccugggugacaagagcaauacuccgucucaaaaaacaaaacaaagcaaaacaaaacaaaaguuauuacuguguauuaagaauuacaaucaguauugaggguaguacagagcaccaacaggauaugcuauggguuuuggaguuuucugcaucuacacagguauacugguaagaagauggagaaguuauguagaauuuuauuuaaaaaaauuuuuuuuuucagacagggucucagucacccaggcuggagugcaguggccugaucauggcucacugcagcuucaacuuccugggcucaagcaauccuccuaccucagccucccgaguagcugggacugcagguaugugccaccaugcccggcuaauuuuuuuuauuuuuaguaaaggugaggucgcacuauguugcccaggcuggucccgaacuccugagcucaagugauccucccaccucagauucccaaagugcugggauuacaggugugagucaccgugccuggcuguauguacaguuguaaaagggaaauuccaaugaauauuuuugagaauuggcauguuaagcagcgucagguuucucagcucaaagcuggggcagagcuauugauguucuuucagagagcauccagcacuggcucagcaaucaauaauuugacaugaaacucuccaguuugcuucugagagugacccaauuugcaaugcuaaaacuggguguuuaccauuacuagugcagacaaugucccuaugccagugguucucaaagcucaguccccagaccagcagcauaagcaucaccuggaaacuuguuagaaugcaaauucucaggcucgaccuaccgcgacccacugaaucaaacucugcaaagugugauucacccagaguugaaaucauccagagagcuuuuaaaauucccaaugcucggccaggcgugguggcucacgccuguaaucccagcacuuugggaggccgaggcgggcacgucacaaggucaggagaucgagacuguccuggcuaacauggugaaaccccgucuuuacuaaaaacacaaaaaauuagccgggcgugguggcgggugccuguagucccagcuacucaggaggcugaggcaggcgaauggcgugaauccgggaaguggagcuugcagugagccaagaucgugccacugcacuccagccugggcgacagagggagaccccaucucaaaaaaaaaaaaaaaaaaaaaaaaaaaaucccaguguucaggccacaccuaaauuccaucagaaacucuaggggugggguucagcaaucuuuguuuuaacaaguuccccagaugacuccgaugccugcucaagagacccaccaaccggaugauaaggaagaugcugccagugucuaaacaguauugguaggguccuucuaauacugagaagacgacaaccaagagaaauucuaauuuugauccuacugaagaugcuaaacucugacaggaaguacuuggacacgagacuguuaacacuugcaauaauuuauuucuguuuagaguauguucuacauucuugaaucucaaaugcuaaacaagaucaauaggucaggauguagccauguguuugcuuuuacuauuuauuuauaauucucuuuccuucccuugccccaucaguauuagacuugccccuacguauuagucuguucuugcauugcuauaaagaaauaccugagacuggguaauuuauaaagaaaagagguuuaauuggcucacaguuaagcaggcuguacagaaagcaugaugcuggcaccugcucggcuccuggggaggccucaggaaacuuuuaaucauggagaaaggugaagggaagcaggcgcaucuuacuugguggaggaggaacaagacagaaagaguggggggagguccugcacacuuuuaaaugaccagaucuuauaaaaacuugcucgccaucacaagaauggcaccaggagauggugcuaaaccauucaugaaggaccacucccgugauucagucaccuuccaccaggcccuaccucuaacauuggggauuacaguuagacacaagauuuggguggggauacagauccacaccauaucaccuuaugacuugcucugaccaauggaauauuaguggacaugaaaugaagugaaaggaagcuuucaaucugcuucccuucuuuuguaucugccacaugccaugagaaggacaugaccuggauagccacugguccugggauaagagccauguggagaagaccugaaccucccccuuaacaagcuaaaacagccacuccaagugacccacagguccaucaguggaaaaagaaauguuuacuaauguaagccacugaauuguuuguuacacagcauuaugaaagaaauaguugacuugggcugggugugguggcucaugccuguauucccagcacuuugggaggcuaaggcagccagauugggugagcccaggaguuugagaccagccuggcaaacaugccgaaaccccgucucuauaagaaauacaaaaaauuagcugggcaugauggugcacaccugugguuccagcuacuugggaggcugaggugggaggaucacuugagcccaggagguggagguugaagugagccaagauugugccacugcacuccagccugggugacagagcaagacccugucuuaaaaaacaaaaagagagaaauagcuaacuuaagacauaaagucuacaaaaauauuuuuugagaaauacagaaaaguauaaagaaugauaccacacccaaaaccugccaugugggauuguuuuuauagcuuuuaaauuuuguucuuuuuuucuuaaauaaaacaucacagaaaguuaaauccucuuaaacacuccaccagucuuaugcuccuccccacuucccaaaggcagcuaccauugaaauguucccauucucccuuaaaaauacauaugaccggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcgggagaauggcgugaacccgggaggcggagcuugcagugagccgagaucgugccacugcacuccagccugggcgacagagcgagacuccgucucaaaaaaaaaaaaaaaaaaaaaaaaaaaaaaaaaaaaaaaaaaaaauacauaugaccaguaaacucagcacuuugggaggcugagacagaaggaucacuugagccugggaggucaagaccagcuugggccauauaguggaaccccaucucuacaacaaauaauaaaaauagcuggaugugguggugcacaccuguaguccuagcuacuugggaggcugaggagggaggaaugcuugaguuuaggcugcagugagcuaugaucaugccacugcacuacagccuaggugacagagugagauccugucucucaacaaagcacaaaaaaccaaaauccgggaggcugagacaggagaaucucuugaacccaggagguggagguugcagugagcugagaucaugugccauugcacuccugcuugggugacaagagugaaacuccguccuaaaaccaaaaccaaaaccaaaaccaaaaccaaaacuaaaaccaaaacaaacacauacacacaaaaacaaaaccccaaaaauauggauguuaaaggugcuuccggugaggcuucagauggaaauggggaacauguuauuggaacuaguggaaaggcgauucuuguuacaaagugggaagaaacauggcugaguuauuuuguaguguuuugugaaagguagaacuugugagugaugaauuuagauauucagcacaaguuauuucuaagcaaagugcugaagguguggcuugguuucuccuuacugcuuguaguaaaaugugagaaguaaauuauuguuaagcaaaaaggaaccagaacuugaaaauuuagaaaauucucagccuagccucauugcaaaaaaaugagaagguguguuccuaagagaacaccaaugguguggcuggacgaucagauaaugagacuggggcugugaagcauggauucaaccaaccaccucagcagaaauacugcccuuuuggauuaaaauggacaaagacaggacaaagggaaggaaggcugucagacuucuacagaaugggcuacagugauguggcugcaaacauuuguuaucuuucaagaagagggaagaaugaccccaagaggggauucacaagguguggcugccgcccagggccucaggggcacagcucccagcucccauccuggugggcuggaaggacagagaaugaauggugccaaagaggauuauucuugagcauuaaauugaauagaacucugcuagcagacugccuuuagacuuagacuguaacucuucccugccagucuccagccugccagcuuacccucuuaaaucuuucucccucuacacauucacacucacucacucacucgcuauauauacauacaucaccuugguucuguuucccuggagaacccuaacacagaacuguccuauaucuuuuuuauuuuuacuuuucauaccaagcuaagcugacuaggagaacuguucuauaucuugauuguggugaacucauguaugacugcaaaaguuugucaaaacucacagaacuauauacucaugugaauuucacuauauguaaauuauaucuuaaaaauggggagguugggcaugauggcucaugccuguaauccuagcacuuuuggagacugaggcaggcggaucacuugaggccaggagugcaaggccagccugagcaacauagcgagacccuaacucuaauuuuuuuuaaauggggggaaaagcgcacacguauacaaauauaugcacaggaugcuaacuuuagcuuaaaaacuggggccgggugagguggcucacgccuguaauuccagcacuuugggaggccaaggcgggcagaucaccugaggucaggaguucaagaccagccuggcuaucauggugaaaccccgucucuacuaaaaaaauacaaaaauuagccaugugugguggcaggcgccuguaaucccagcuacuugggaggcugaggcagggagaauugcuugaacccggagugugaaaguugcagugagcugagaucgcaccacugcacuccagccugggcgacauagugagacucugucucggagaaaaaaaaaaaaaaacugggcuaggcgugguggcucgugccuguaaucccagcacuuugggaggcugaggugcgcggaucccgugaggccaggagugccagaccagccuagccaacaugaugaaaccccgucucuacuaaaaauacaaaaaaauuagcugggcgugguggugaauaccuguaaucccagguacucgggaggcugaggcaggagaaucucuugaacccaggagguggagguugcagugagcugaguuugugccacugcacuccagccugggcaacagugagacugucucaaaacaaacaaacaacuggaaaccaucuaugucuaucuauuuuuaaaauguuuaaauaaaaggcaaccaggaagagagagguggcaaaguuucaaaggugguagauauuucugccuuugcacuaaccucaucuagauuuuucucuacaccuuccucuaucccucaacuccuuacucucuaggucccuuuucugauucuggaugcucagccuaacagcuaaaauuugcauuaaaaaaccccugaauaucugaccauuuuccaaaaagcuggauuaagucacucuaaaguuuuggagaacugcaaccauuuccaaguuaucuggauuauuugucuccuggucucugggucucuggccccauuugccuguaacucagcagaauuuauuaggcaucuaccuggacaggaagcauuuuggucaucagagagcaaguuauaaguauacacacacacacacacacacacacacacacacuccagacugaaauacuauuuaacaaaauguuuguggguugugggauuauagaucuuuuucugugcuuucuggcauuuucccaagaguucuacacagugcaugcauuacuuuuacgguuucaaaaaaagauuuuuuaaaauuaaaaaacaguucugaaugaaaaaagggguuggaucuuggguaaauguggguagagaagggguauuaacuuuuuaccagaccauucauucuuccauucauucaacaaaugcucccgagcauuacaacaggcgcucagaugcgauuccugucuucguguugcuuauauucuagaggggcauauauguguuuugcguggcuggacacagugcuccugggggacacuggagggaagacaggcaccuggcauguggggccauggugaggggucuggauaauaaucugcaagugaugaaauuacacugaucggaucuuacaaauaguugcuuauacaauguuacuguuagucuuuagagcuuguuuugaagguguaaaguccaaauuauuaagcacuuaacuucaucccgcacccgggcccaguugugacuugcuuagacauacuuccuuguuaggcagcuucuacaugacucacuaaaucucugcaaguaugcaggcuguuuccuucgcuugcucuacucccagggcaaaccucaccuuaaauauuuuacuccugacucuaaaauacauuucauaaucucaaguauuuuaacaaaaaagccgguguccaaaccucugugacucccuccgaaaaaccuucaaguucugcucacacgucuagccuggagagccgcauggaguaaacugggaugucucuagguccuccuuccacuccgccucugguuugugauuugcaauuacaacaaugauccucgacucuggcugccccuuggaaucuccuggggagcuuaaaaacuaagauaccagccgcaccccagaccaauuaaaucauauccuugggggauuagaugcuaaauucuauaggcucauuaucucuguuaccucugcaaucuguccauuuguucuggcaccuaauucaggcccucauuaccucuuaguuuugcuaauuaaacaguauuuucguuguucuuucccucucauuuaauaauaguagagguagcgguaguggugguggugacgcugggaguaguaagcuaauaguuauugaggacuuauuuugugguagaggcacaauucuagacucauuacaauacacuggcucauuuucgcacaacgacucuaugaagucagucucuucuaauccccauuuaauagaugaggaaaccaaggcaaagagagaugagguaauuugcuuggagcugcauaaauagaaagagguggaucugggauugcaaccaaguguauuauacagccucccacucauauacccuccuccccgggugucucagguuuugcuccugcacguacacaccucucguuggaaugagaugcucugccucaaaaacugagaaugauggucuucuccccaucuguugaauucccaguuaagauuuucucccauaaauguuccuuaaguuuuugaggccugugucugcuuugcuauauuauaauauagacuacgguaauauaaaauuuacuagaaaacuauccauguugcuaucuauaaugccauguguggcaacgguucaugcuucucugcccuuagacaaaauaagggaccccugcuccaccacaaugcugaguuauuauuugcagagcacacaucugcaaugguuagauguuuguuuggcaguuggaacuacggguguagaacuuucuugagaguucuacagcucucuugaugggauuuuauauauuuuuucugucacaaacauugagaggaauaagugaugaugaagaguugauuuauuugaauaaaagucuagaaagaaaauggaagcuucaaaaagacaaacaacugauuauguguauuaauacaguaucuuggagucaaugauaagauuuacaggaagcagagaguagucaggccuuggcugucggcuguguugcaaaaaagcaggaaaaugaguggaguuaguuauucgauggugacugaagcgcuaagccgggcugcaguggaguggcagaauaaaggaggugacagaggugugggaagucaggcgguaaacaauaaaaaagaaacaggacggugcucacaggaacaggaaggcugaacacaggguuuuucuuucauuucucagaggauugcucugugcaaaaggaagaaugggaaacucagaguacacguguuaguuuuguuuuuuuguucacgacagggucucacucugucacccaggcuagagugcaguggcacaaucauggcucacugcagcuccgaacucccagcucagccuccugaguaaaugggacuauaggugugaaugacugcaucuggcuaauuuuaaaaauuuuggccaggcgcaguggcucacgccuguaaucccagcacuuugggaggccgaggaggguggaucaccugagguugggaguuugagaccagucugaccaacguggagaaacccugucucuauuaaaaauacaaagguagccgggcauaguggcacaugccuguaaucccagcuacuuggaaggcugaggcaggagaaucgcuugaacccaggaggcagagguuguggugagccaagaucgcgccauugcacuccagccugagcaacaagagcaaaacuccgucuuuuuuguagagaucucaccauguugcccagacuggucucaaacuccuggccucaagcaauccucccuccuuggccucccaaaguguugagauuaaaggcaugagccaccauaccuggccacuauauguuaguuuuuuuuuuuguuuguuuguuuuuugagucacagagucuugcucuguugcccaggcuggagugcaguggugcaaucucagcucacugcaacuuccaccuccuggguucaagcaauucuccugccucagccucacaaauagcugggauuacaggcgcguaccaccacgccgauuuuuuuuuuuuuuuuuuugagauggaguuuugcucuugcugcccaggcugggguucaauggcacaaucucggcucacugcaaccucugccucccggguucaggcgauucuccugccucagccuccugaguaguugagauuacagguaugcgccaccaugccuggcuaauuuuguauuuuuaguagagacaggauuucuccacauuggucaggcuggucucgaacucucgaccugagguuaucugccugccucagcuucccaaagugcugggauuacaggcgugagccaccacgcccggccucauguguuaguuuuuaaagggaaauaacauucuugaaaaguagauggagaugcgacaauaugcagagagaaacuaagacagaggacccagccaucucaggucuucaggagugggcuggcagacggcacaggagagguagaggaaggcacagaucugaaacagagauggcugcacuggggggaggugcagggcacgagccaggucuagggugggcagaugugguccgcacauccuccaccagggcugacuggcaccacuagagggcacccgcgccucgugcuuggcuaucccaagugggacucugggccaaagccacuacccuggcuuaugccugagguguggagugcuuguucaacagcagcuugugccuuggcgacuggcugcagaaccugcugccuuucccggauggcuggucccgcacucacgguuccuuccacugucauccuugccugacucccuggugauggcugugacaaucaccugagagcugcauguggcaucccacuguagaucccacuguaaacucccaagggcuccacaggagcaggucuccugauuacuggaaaucauacaggcucccugcacccuuauuuauuuagcuuucugcacauaucuucuuucucuucugcuagacucuaagcuuuuaaugaauaagaauuaucaguuuuuuuuuuuugagacagagucucgcucugucacccaggcuggagugcaguggcgcgaucucggcucacuaucagcuccgccuccgggguucacaccauucuccugccucagccucccuaguagcugggacuacaggcgcccgccaccacgccuggcuaauuuuuuguauuuuuaguagagacgguguuucaccguguuagccaggaugguaucgaucuccugaccucgugauccgcccaccucggccucccaaagugcugggauuacaggcgugagccacugcgcccagcuaucaguaucucuuaaaauguccuaugagaugaaguaaugucugggauucacuuuaaauccccuauguagcaggagggaaauucugggugaagggaacauggggauucauuauguaauucucucuacuuugauacaucuuuaaaauuuucuguaauuaaacuuuaauaaacaucauagaagcccaacgccuaauaccuaguacagggcaguaacagugaaguccuaugucugcucgucuguaaaaugcauaggucaugcaggaugagggucccuucuaaccgcauucccugauucugaggcucacuguacagucggcgagcaccaguuagcuuguggggugagugcaucuuaaggcaaguguugacccaagcacccaggaaaagcccaggaaaguaggauaucugguucuguuccaggagcaucucuuaucagcuuuggguuucaguccuuugcauguccugaggaggccagagguacugcuuggauccacugcuccugucucccaggauuguccagacccuccuuuccagcugguauugccacagggccuggcagaagaggcucggcugcccugaggagcauuuguuugcauacguccuauugaauucuuuccuauaacauccuguacagaagagccucuucggccgggcgcgguggcucaugccuguaaucucagcacuuugggaggccaaggcuggcggaucacgaggucaggagaucgagaccauccuggcuaacacagugaaacaccgucucuacuaaaaauaccaaaaauuagccaggcgugguggcacaugccuguagucccagcuacuugggaggcugaggcaggagaaucgcuugaaccugggaggcagagguugcagugagccaagauugugccacugcacuccagccugggcaaaagagcgagacuccgucucaaaaaacaaacaaaaacaaaaacaaaaacaaaaacagaagagccucuucaacuauugccuggcagcuaugagggagaagaggaggcaauucuggguaagccucaacaggacagagaagccacccuugcccacgugaagugggcagcggguucagauggcagccgggaaggaucgcaggcaggcuucugugaugaaccagggugagcagccagggccauggggguugggggacggcuauuccaauuacaaaacaucugaggcggugugguguguguguugaggucacaacccaauuguuagccccaagcacucagcucuuccucacuguacucacacauuugaggaaacacuguuggaccccaucugcuucagcgugauggcagaaggcaguggcaugggaugaggccacuaauaguggcccuuuggugcuuuaaggugaaacagacuuaccaagugugcuggagauggugaccucguguccuugacuguggcgcuggaggggacaucgaggaggggccauuucaucugcagguacugcacagggaacagaaaagaaaaagcuguuggugagaugaggccucacaaguacucaaaguuugcugggcucugcuguuagggcaccggggcaggccauugggguggccugcauuuucaugccacaugcccuguacugggucaauuuccaaacgauuauaacaggagcgagcauauauuuacaaucacuaccagccucaccacgcccuaugucauuuuggggggggggacacgaaugacaacuaagcugaacuuuaagugguggagagaaccgauccauuccagcacaaccaaucaacauauucaaagaaccuacuagugaggcucaaguccccucccuaugcuguagucauggacacgcagggcugaccaaggaggcagaggcucccagauggccauccugccccauccauuuccaucacuuacgacauccacacacaaugcucccuacgaaacagccauccagaaguaucugggaaugaaugaauaaaagccaucugccugacacagagucaugggcaacaucuaccccaacucaaggaugcugagcuuuccuucauuauagcgucucucaacccugaaaaagauuacccagcaccccauucuuucucaugucagugcaaaaaacccaaaccaaacaguacuuccccaacacacacacacacacacacacacacacacacacacacacacacacacaaucucucucucucucuggcauggcacaguccuugccaagagccuagaaagaaugaguugaguggagcagcagucaggagcacugggaagggcccuucugggcuccggagcccugcauucauggguucaggcucuuacucugccaacauaggcugugugacccugaaugagugauuaacaacucugagucccaguuucagcaucuguaaggcaagguuauuaucacucacgguacagguuguucggacuagggacggugucacauauugaacacagugccucgcacaugggagacauuugauaaaugacgccuauuauuuccauaagcaaaccauuagucuuugccaggagcaaaagcacacauguugucuuagugucaacgcugacagguugcuucugggcaacagacccgcaagcagccucuuugcagaauucuugagacuccuuugagaaugaaagcuguaacggaaagugguggccccaggaaguuucacagaaagaagucuuuggcugggugcaguggcucaugccuguaaucccagcacuuugggaggccaagguggauggaucacuugaggucaggaguucaagaccagccuggccaacauggugaaacuucgucucuacuaaaaaaacaaaaaauagcugggugugguggcgcaggacuauagucccagcuacucgggaggcugaggcaggagaaucgcuugagucugggagguggagguugcagugagccaagaucgugccauggcacuacagccuggacgacagagugagacuuuaucucaaaaaagaaaaaaaaagaagccuuugaaucaucccucacucuggucauguaauaucaggaaaaaucaaucacaaucuggcucugcuguguacaggagcaggagggcgaugggaagagccccagaaggccccuuugcucuucauucaccauaagucuugaccaagauggcagggacugacugggcuuucaaaaagguguccaugggcaggaacaacaacuuaaggucacacgugccacaggccagacuagcacaugggaugggccaagcaggccuggcgcgggagaccuggugggaagugggaacgaagcccuaugaauuaggacagucuuuucacuuugcgaccucuguacccccaccccucagcccucaaauggggugucaccucugucccuguccucugcugacccuaucuucuuccucccuucccaccaccacccaucccuugcccuacccagagcccacacacccgacaugaauuaacugggauuucaaugccuguggcaaguuaaaagcacugggcaaauauugguaucaauaguuaaaacucauuuucacugugaauaacauuugugcuacauuugcacuugucaaagcauuuucacacacaaaacccaguguaaucugcacaucaacccugcaaugacaaguaggggugacuaucccaaauuuuaaaaggagcuaggccgggcgcaguggcuaugccuguaaucccagcacuuugggaggccaaggugggcaaaucauucgaggucaagaguucaagaccagccuggccaacauggugaaaccccgucucuuacuaaaaauacaaaaauuagcugggcaugguggcgugugccuguagucccaccuucuugggaggcugaggcagaagaaucacuugaacccaggaggcggagguugcagugaaccgagaucacaccacugcacuccagccugggugacagagugagaccuugucucaaaaaaaaaaaaaaaaaaaaaggagcuaauggacauaaacaaaggcuaaacgcuuccccaacuucauacaagacagcuggagcuggagccuaggucucuggacuucaaaucccacaccuugcacaagaccaagucacgaagcuuuuccuaagacugucuuccucaacucuccacccgcagccuucucuuugcucggauguguuuucucucuccuucucugucuugcacggggcuggccacccagaaacagaauggguccaugcaugucaguguucuccuggagggaugcugaaggugcccagagcuugcacuugaagccuaaacaccacacucguuuuucuagaagcaacaacuugaacauuucugguuuuaaaaauuaaacuacaauaacaacuaccaggugcuaaagagaaguaucccaaaucuauacccccuaauauuaaacaggauagauggguaccuaaaaauccaucaacucuaccagcaucugcccccuauuuagggccacaaagacacacauucauucuuguuggcuuaccagggauguccuuagaucauaugggggugguccaaagaaauguaaacccuagucugggauggugcuagaguuuugggucuuaaauaauccucucaagugaccuuauagauugucuggcagagucggcuuguaggacuguagugcaggguuucucaggcucagcacuaugacauuuugggcuggauacuuuuuuuauuggggguggugggcuguccuggaaaguuuaacaacaucuuuggccucuaacuauaauacuaaaugccgaugcacucccauauagaucaucagaaauaucuccagauuuugccaaaugucuccuggggcugagggagagaaucuucccucccgcaacugagaaucacugcucuaguggccaaggagcuggcacccaauagacugcaagcuccaugaggguuugucugccuuggugcuggggauaucaagguacagguacauuuauguaugcuuguauuuuguacacacauucauaguaaggguuuucaguaacagccacucuuuugggugucugaccauguacuuguuuuaucuauguaacaagaagucuuggcuucugcugggaggagaccacacuggucgugccuaccacugauaccuggccccuuacagacaagucaggcagugugagggaaaagaccagaagggagaggugguccugggaacagugagcaucucaccgggacugacccugcuccagccaugccugggguggugcaggggcgguguguagggagggacucacucugggaggcaggaguguggaggaucgugacuuucccuuuucuauuugucuuuuuaaguuuuggagaugagugacggggggaggaggaagagcucuaagacuuuggagccccuacagcuuggccauggacggccucugcaucacaacucugaggaaaggacaguugaacuucccagaaccgugaauuggggcagcaggagccagugacaacccuuguaauccucuuccacugcaguacuagacauuugaagauggccagguaguucugaauuccuagcaucaggccuagcccaacuagaguggaaauaaagugcuucuguuuauuuauuuauuuuuauuuuuuauuuuuagagaugggggucuugcuacguugcccaggcucgucuucaacgccugggcucaagcaauccucccgccuugcucucgcaaagugcugggauuacaggugugagccaccaugcccagccaauaaagcucuucuuagcuguaaggccaaccccacgaucacccugagggcaaucacucaugggugggagcauguccuuggggaaguaagugauggcugacugugcuuagauucuuugcaugguaaugguaugugggcagguuaaaacugcugguuucuccaugcccagucuaggcuacauuuaacuggcucugcaaggcccagcuccugaccagugugucguggcugggcuucagcccacagcgaagauguguacacgggcugguccagccaccucccuccugggggaugcccaccggaauguaacacauugaaauggugaugaauggcaucaaugcaacugauggccuggcaauagcgaucgcucccacuucuggggugcuuucuauggguuaaauacccgcuuuuggaugcucaaaaauagaaaggaaaacaccaaacccaaacggcagguacuacugucuucgauuuacauauguugugacuaucuaagacaggacagauacacaguuuuccaaucucacugaaucugagaaacacuuuucuggggacugggguucugcuacugugguucacaguuaaguagacugaggcugugguuuaaaacaugucuuuaccucauuaaggaaggaugauucuaauccuauuuuuacauuguuuucauuggagcaguuguugcauuuuucucucggcauuuaccaaaauggucaugugguuucucuuauuugacucauuuaugagauguauauauagcaauagauuuucuuacaugaaggcauuuuugcauuucccagguaagcccuauuuggucauggugguuuguuccuucuuacgcuguauuguggaaugcuagucauguuuuaaauuuuugacuuuuacauuccuaaguaaaggugaacaaaguuuucuuuucuuugggugacaucuuuaucgaguguugccaucaguguccuuguggcuuuauuauucagaggggcucugcuccucucuuucucaauguuuugggccccuccuuagagcccuccuuggggcgagcacuuggccaggcgggcuguuucugcucaacguggaucucgggaagggucccucugaaggaugcugucacuagagagcuagagcccccuuuccugcaggaaggcggagaauccauccuacagaauccuugcuuugauuggagccauggagcagauuaauugcagcugugcccuggaauuuccccaacacacaaaucuucgugauguaaaacagcugggaggaaaucccagcaugcccuguacagaggcaggacugccaaugagcuacggagauuaacccuccggcucccagaagguagggagggccccgccccagccguccucacccugucccacacuugcuuaguguggacaggacucuacagggcucgggggaaugcccacauucucccuguucgcacguucucacagaaaagccuuuaagcagggccugggcaacagaggaaacaaagcuucauguuacagaauccacagcuccccacaguugcaugcaaggaaaacaagucagcuccaaaaacugcacaggugagaaaacuccagcccagagaacgccuuccgcugcuucuagaggaaaggcccaguaggcagagaaagcgccccuugcuccagccccauggucucgcccauuuuuggccacuugcccaucagcagacacaaagggucccaguuuuggugaccgguccuuccugccucucuggaccccuaugguaaacagugacuuuggggaccuagagccaggauccccuuugauagagaagcaaggguugcccaggcuuuucgggagauguaaagucccagugccacccagaacccaaggcuacacccaaacuccgggugcagguggcuucccaccacagugacaauaacauuauucaaaaugcucuccuuguccucuuagaaacucuauguaacaggaaccuauacuauaaccguacuauaaaugaaaaaugugaagaagcgauccgugucuccccgucuccauucugccacaguugcagucguuucuugccuggacuacugcaaauccuaccagagucagccuucuaaacaccagucacaucucuccccugcucagaacacuucccugguugguuucuggggucaagagauaaagcccccaaacucaccagcaaucccacaccacccuauccuucuggcuuccacccucaccgccccccaccccagcugcacagaguccucacugcacucugaacgcaccaugcugcccugcugcuccccggccugcuacggccuuuacugcauccuucacucgugggaaacuuuaaccccucuucuucaaaacccauuuccucccaaggucacccucccuggcaugaagccuccaugagucugucgcucucgagaagcgguacacgguguuuccauagcacucaccaggcuacuccuccccauuugcacacucugucugcccuugggacgguaagcuccucaagggucaugcugcaccucaauuccucacccagaacccggcaaucaugauguguugaaacccugucccaugcuguauuaaugccgugagcuuaggcccaguuuccacaucuguaacgagggguugaacagccucugccugaagccuuuagagcaggggagagaugugacugguguuuagaaggcugacucugguaggauuugccguaguccaggaaagaaacgacugcaacuguggcagaauggagacggggagacacggaucgcuucuucacauuuuucauuuauaauacgguuauaguauagguuccuguuacauagagcuucuaagaggacaaggagagcauuuugaauaaugucauugucacuguggugggaagccgccacacaggagcccauuucacucaugggcaacgccugcuucucacaguaacuggcuuagucugccgagaauacguaaauguagcauggaggcugggaugcccaacuuggccaguucuuggagaccuguuucuaucuucuguacuaaaguucacaaauggaucuaaguuugaaaauacacugacacugagcaaugaacucaggaauagggagacagaaaagcuuucccaauugggaaaacauuuuuaguuuucagcagucgguaagagaaaacgaaaguguaaagaacuuguucccaaacaagauggauuagacaaagaguuccaggggcaaaaguauaaaagaaguuuuacacucuuaucccuucuuucuuaagaaugagucauuuaugccuuugcuuaacuuuguggauggcacuaaaucccaaacacauuuuuuguuuuaccugaggguagguuagauucuuucuugagguauuuuuuuuuuuuuuuuuugagauggagucucacucugucguccaggcuggagugcaguggcgcaaucauagaucacugcaaccuccaccuccugggcucaggcaauccucccaucucagccucucaaguagcugggaccacaggcaugugccaccaugccuggcuaauuuauuguaguuuugguagagacaggauuucaccauguugcccuggcuggucucgaacuccugagcucaagugaucugcccgccuucaccucccaauucugcuggcauuacaggggugagccaccgcaccuggccuacacuggucuuaaaccaaugaagugacuuugcucucucuagcaccugucacagcauuuagucaacaaauggcuuuaaagcccaugcacugguagcagaggggcuccaaaagcauuucauaacugaauaguaaacucaaaaguaagagugugucaauuaggugucaguuucaccauaaacaccucuuuccucugcuuuccccaaaugauucuuucuuuuguggaugaucucaaaacuauucucuuccccucgcauuccaaagaaccuggcaauuuugccuccuagauuugaccuaagguuuguuuuuaaaaacuggcucccccgcagaagccaagcuuucguuuuagagcacaggaggcaagagaucaggguuccaggcucuuucuaaccuuucuggacuccaucgucucaucuuuaaaaugggaauauuuuacuucaucagccugaagcaggggccuggacuagauggucuccuuuggaaggaaaaaucaaauucagcuguuugucuaaacacagagggcacugggagugccgaccguguugagguguucaacaaauacggaaucagggguccuagcugaaccccacuuacaagcugugugccuguguacaucaccuuucagaaccucugguuuccacauguaaaauaggaauaagaacaccuacugccuggcagagugauuaucucacguguggcugucacacucaagugugaguguccucucacacuggagaggaccaggcagaguguggggcaugcggggagcuuguaagaaaucuguguucagucacuaaauguguaaguuauugguauucuaggagccugugaccugcgcuuuaccuggggagacaggucugguucggugguguguugguaaaugccuaacaacuggcucucuaagcaaaaaacaaagugaaaaaccaaagcauuugcugguauucaugguguaaacacucccgcugauuucaagguaccacgaugagucacugaaggcucagcgcggaagagaugcuaccaauuggcugggugccagcuggcucaggcacaccaaugaccgugggcaagagcuggguuggagggguggucucagauguguccugacuugcugggauggcuggaaagcugagacacacaugguucucagcugacgugggccugcuugaggucuugauggagagccggacacuuggcuagguaugucccccgacagcugcaugcucuggaggagggaaaacucugcucccagagcacuaggcacagccauucugugguggcccugaccagggggaccccgggacagagcccuaggcuuucaaacaaugucaaaguucaacuugcuuucgaguccgcauuucugcagccuggagcgcugggccugcugagucgcaagcugccucucccaucggcugugaccuuggguuugcugggccugggcagugucugugcagugucuaugcucacugcccagccaccaaugugcugcaggaagugucuucguggaaacuggcuuuggaggcccaguccuccuuucccugaggugaacccugcugggccccucccucugucucuccccugucgcugugugccugggaaucuacugacacgcuucccuccccucaggcccucaggugagaacaucugcccuggcccccacaggaugcagaguccaccugcuggccucugaccaggagcucagacugggcugaaagagcaaaugccuuucuccuucacagccugcagccuguucucuggccugcccauacccacccacgccacucugcccccacuccauucgccggcauaguagggcuggucccauagccauccccacagagcugccuccuccuggguuacaggaggugccauaaccgacucaaggggcccaugcucacagacauggagguguuucccaggcuucugcugcagugaacacccuugaacacucaccgugucgcccauguaugucuauagugggaggacacauuuccagcugugaggggaaucacuaggucaaagauaugcacacuuaaguucugaggaguguuauuaaauuucucccaguugacacugcuaacagcaaccugggagagggcuuauuuccccacacccuugcccauacaagguuaucaaacuguuuaaacuuugccaaacugacagguaaaaaagucccucacuggaguuuccauuacucuuauaaugagugaggcugcgaauuguccucuguaugggugaugauuugaaggagggaaaaaagauguguguggcacagaggaaguggggcacauaaucugcuggauggcggggaugggggaggacgaauauggagucacugcaggugaaacacaggaggggucuguggguuccuugcagcuggcacagccugugcaaccucuccugcacuugaucuucacucagguggaagaggccagagagaaggagcugaggcugagucugugcgcuguugugagugaggaggaggugggaggagagcccaggaagcugcuggugggcagcugccccuucugguucucccccuuucccuuccccgcauguacacaggcugcuuacaugcccuccccgccucccagguacuucucagcccccagaaggcuggcuucuguuccacucccuccacugucucuguagacacucuccugucuuugcaaggccauggaugacuuuaggaagaaaauaaaggcaacuggcuuuugaacugccacaugacaugggcagcucuggggaagccucuccccgcuccugcccuguggcugcagguucugcaugccuuuugggugauuuuuuuauugauugauugauugauauacugguuaauggauugauugauagggucuugcccugucagccaggcuggagugcaguggcacgacuguagcucacugcagccuugacuucauggaaucaagcaauccucccacaucagccuccugcauagcugggacuacaggcaagcaccacaccacccggcuaauuuuuuuuuuuuuugguagagacagggucucacuauguugcccaggcuggucugaaacucuuggccuuaagugauccuuucgccuuagccucccaaagugcuugggauuauagcuuugagcuaccacgcccggucauccacauuuauugaccugaauaaagugugcuggacaaacuguucagugagaaaagccaauuaaauaaucuggaagcauagucacccaaauguuaucgcuggauuuuuaacauuucaggcaauuuuauuaguuccuuuuucauauuuuucuucuucacuugaaauuuuuacaaucaguaugucuuauaucauagcaacaguaagcaaagcuauuaaaaguaaccccagaugaauuauuuucaauccugugccuucaguguaccuaaccagaaaccucaaaauccacuuuaaugacuuuaguuaccucccuaaccugcucugggccacccaauuauauggcuucuggacauuuuuugaacccuauuccgaggaggagccccugcagcagccuucuggguuugcuugagcuccugcagguucucacccaggaggaaggcagcggggguggggggcaacccgguuugaaaggggugguagugggcugcaaaccacaucggcagguugcuuugccucacauugacaaaaugucuguuguccaagaauaggguaguugacagaaaugaagggaucccaaauccucucuccauugagucaucagugcuccuguucucaguucaucucuuccagucuacccuucacuuaccucuagaaauaucuuucuaaaacauaaaacugugcuguuuaaagcuagcaggaggcuacucauucuuacaggacugccuaccagaugaucaagaugcagugacagcucuguacagagcccuccaucaaaguuuagugaguaucucauauaaaagguggcuguuuauaugcaugauauaccacaggagagauuuuuaaaguacauaaauaacuagacuauaagccuauaaaugacagguucagauaagacagggauggcaaugggcaagaauuaucguguuacaacugaaaacuucauagaggagguggcaucugugcuggguccugcaggcaggauauacuucuacaguuguuuuacuuuuuaaagcauuccauaugaauuaucugauuugauauuacugacuccuggauauagguaaagcagauauuauuauguucauuuaaaaaaugggaaacugggccgggcgcgguagcuuaugccuguaaucccagcacuuucggaggccgaggcaggaggaucacgaggucaggagcucaagaccagcauggccaauauggcaaaaccacgucucuacuaaaaacacaaaaauuagccgggugugguggcgggugccuguaauccuagcuacuugggaggcugaggcaggagaacugcuugaaucugggaggcagaaguugcagugagcugagaucgcaccauugaacuccagccugggugacagagggagacucugaaucaaaaaaacaaaggaaauugagccugcuggaggcuguuggauuuccucgacacuggcacuagaauauaggacuuugggcguuuauguuguaacucuaaggguacaaggacaugauuucugccuucuagaaacuugugguugggaaugggacucacacuuguaaucgcagcauuuugggaggcugaggcagguggaucacuugagcccaggaguucaagaccagccugggaaacaaaguuagaugagaccccgucucuacaaaaauacaaaaaaaauuagccaggugugguggcgcacgcuuguagucccagcuacccgagaggcugagcugggaggaucgacucagcccucgagcucgaggcugcagugagcugugauugcgccacugcacuccagccugggugacagagugagacucugucucuaaauaaaaaauaaagaaacuuccaacugaucucggaaucuugggauagcaaauauggggcacaggagcagucccaucccuccgugcuuguggcagacacugcuaguagaccauggcacucuuucuugcuaaagguggguaagaccucagaauccucaacacugaggcagcuacuaacaguugauuaaaacugaccuguaaggugcaaucuauuuauucucucugauuuacgccaggagguagauacagauguucugucuggugagaaggaggggcagaaaccaggucauagaagcaucucuccuggcuggcacaaagcggaacucagcuccuagacagaggugaaggcuucaccaagaaugugacuagauggcaaaaacagucauaauuugcagaaaguccauugaccaaaagcaggccugagaauucuaaaguuuacggacuuuccccuaugggaggagaagcuggaaagcaucccagguauugaggagaaaggaagcaggaucuguguauaaucagugaggaacaggaagcgcuuaucuggggccagugaaauacucaacacaaaagaacagccaggcagccuggagcugccuuccagccacagagcuucaagggucucuuagaacccuuccccgcggcuccugcaggcccagcagcuggccaaagucaacaacuccugggcaccgggagaugggaaaugucugaggaggccucuccauagacgggcaguuccaggagagcucuccgaccccacaggugaacaagaacacaggagaauaagggucacaccagccaccucuauacagggccauugcuccugauaaaggagccugaagaagggguccugcacccuacacuaguguguaugcaaaugugggugcacauguggcuuacauaucucagggaacaacacgauuuuauguccauauugaagggagggugcaggaaguuaugacggacaguggaagggcugagaaguucccaucucaauacuauuaaacaacaccuccuauuuuuuaguaccuaaaauauuuacauuaaucggccuuaaaauauuuaaguauuuaaaauauuuaaguauuuaagccaguauuuuuggcugggugugguggcucacgccuguaagcccagcacuuugggaggcucaccugagcccaggaguucaacaguagccugggcaacauggugaaacccugucucuacaaaacacaacaaaacaaaaauguauauauagccaaacaaacaaaauuauaaauacauauguauguguauuuuuuauguauguguauacacauguauauacguauacacaauuacacaugcauguuacaggcaaaguuugauaucuuggauacuguugcuuacagugaagcuccauuuuuaaaaaguggaaaaaagugaaucaauucaaagaaaaauaauuauguaaauaguauaggugguauguggcaaagauuaugugaggaagugacauccagggaauaugguuguaggacugcauguuuguggccauccaggggcuacugccaguuguggaugagggcaccccuaggaauuggagaaagagguucugcacacagacucaaaggucagagcaucccaggacacaccacuauugucuucccaaauugcuucucaccgagaucuaccaucucucucuucucauguaccugcagggucaaaaccucagacaucuuuuccuccaccuucuuccucacuuugucaucuagcccaucaaguccuguguuuuuucaaucucaacuaccacugucuugcaauggcucccuaacauucaccuugccccacacucguuccuccaggucggucacacacccugcugcccgcugacuuuccagcucacagccaggcucauuuccucgcuuagcuuccccuaagcucuuuggggauaggcauccaaucuuuuuuuuuuuuuuuuuaaccugccgcuucagaaaggcauccaggcugggcacgguggcugacgccuguaaucccagcacuuugggaaaccgaggagggugggucaccugaggucaggaguucgacaccagccuggccaacauggugaaaccccgucucuaugaaaaguacaaaaacuagccgggcaugguggcgggcgccuguaaucccagcuacucacgaggcagagguugcagugaaccgaaaucgugccacugcacuccagccugggugacgugagcgagacuccgucucaaaaaaaaaaaaaaaaaaaggcauccaaucuuauucgcccuuuggguccccacggccuuaagcacagcauaucauuugugagaggugcuugaugacuauugcaggguguucuaggauuaaccaaauuagaggugcaaguccuucucucuggaggugcugccucccaggcagcucuaguggaaauguugucugcaaaggcaauuagcggucacacuccugggguuguugccacagacccuaauuuagcugaccuagggugagaacagagaaaccaucaccuuuugggagaaugauggauagagggaaugggaaaguccgcugccacuggggacccuaucaggugaguaagacuccauuuaccuaaagugaucaaauaaaaaacauuuaccaauaucauaucugcuucuauuuuuauauuuuccccuacaguuaauacauuauuaaaaaacaaacaaaaacauucuaaucuuuuguagcugggggccuugaugcugggauucuucuguucagccccacuguggaauacagcacuucugaaauucauacucuguuugauauuaauaucauuucagauaagcaaauaaguaugugccaaagccagggacaggaaacugucugcauaaaucuuggauaaacagauuucuuuaaagaaaacauuuagugaugcguuaccuugugccagauacuccauguguuauuucguuuaacccccacagccuuauaaguugaugcuauuauuauccucauuuaacagauggagggauuaagguacaaagagguuaacuaacuugccccagucuaucccaaacccaaaagccaacucuuuuuuuuuuuuuuuuuugagacagagucuuuccucugucgcccagguuggagugcaauggugcgaucuuggcucacugcaaccuccgccuccugggcucaagugauuuuccugccucagccuccugaguaacuaggauuacaggugugcgccaccacaccagcuaauuuuuguauuuuuaguaaagacagggguucaccauguuggccagguuggucuugaacuccugaccucaagugauccaccugccucggccucccaaagugcugagauuacaggugugagccaccaugcccagccccaaaggccaacucuuuuuuuuuuuuuuuuuuuuuuugagacagagccucgcucuguugcccaggcuggagugcaguggcacaaucuugguucacugcaaccuccgccucccggguucaagugauucuuccaccucagccucccaaguagcuggaauacaggugcacacccagcuaauuuuuguauuuuuguagagacaggguuucaccacguuagccaggcuggucuugaacuccugaccucaagugauccgcccgccucggccucccaaaguggugggauuacaggcaugagccaccacaccuggccaaggccaacucucaauccuuucauuaugcuagugcuggaagagaagaaaacauaccacuccugcagcccauccuggcacuccucagauaagggcagucaggcccauggggugagcugucccaccaaggucacggaggacacuggcagagcugggaucagaacaacccagguguccuggccgccagcuacagaacagcuaugauggaucagguuauuuuuuuuacaacacauaaacauaaaaauaauuggaaggggaugaaauacuaauguaagcaaaucaauauuauaaauaccaaucugagaagucauaaaacacaacaaaagaauacuuguauuauugaaaguuucaauauggauaagccguaaggcaugcagagcaugcucaacagcuccacacugcccccuggugguucccaaguccccaccggaagcaugcuggaccaaugaccagcgggaaacaaaggcccuggacaaggauaccugcugcacugaaaaccccaggagccggugaccuggugggccagacaacaaagauccuccugggcugggcaucaagccgucaaggaaaaucucuggguuccacucccauuuguuugcagaauuugagauaaagaaguuaugaacucaguaaugaguuaacuacuuuuagucucucauguuggcaguggccuuuucccccuuuaauuaccacaggcacuuuuuaauacccugguggugggaaaguaaauuaguaaauccugucuugugcaauuuggaaguauguaucaagucuucugaaggcuuacugucucuaggaaugcauccuaaggaaauaauuaaggaugcaagcaaaauauagcugcaaggauguucacugaagagcuguuuauaauagcugaaagauauuaaaugccuuaugcugcaauuaugauaucugaauuuauguaguaggugguuauuuacagaaacagaaagguguuuacacuguuaagugaaaaagcaagauacgaaacauguauuuccaccuguguaauggggagugcuuaaaaaaagaaaaaacauguauugaauccuacuuuuacuuguaauuuuguaaaacagguaucuuuauguauguguugagaaaucuggaagaauauacacuaagaggugaguugaacuuaaucucucugggagacaagauuauggguguuuuuauuuuauucuuuuggcuaaacauacauugauuuuaaaagguaaaugcaaauauaugcaaugggaaucacuuuuuaauuaaaaaaauuaaauauauaaaaacacucaaaaaaaaaaaacccaguaaagucuauauucaaaucuucagccucucauuucugaacuucugagugcuguuuuauuuugaauggggucuugccccugacaaccuucccaaccguucccauuagggccuggaaaaaugugaccucagccguuuggaagccuucaaugguuccugggcaacauacgcuggggccaguaagugcugugacugccagcugcacgaguccuuccuuggcugaggaaggguccacucuacagccccgcccuggacacucuccuccacucuuucccuuccagagggauuccccucugggggaaggucugggcgccaauucaaccagaggagacaacccagucugcuaguucucagaucucacuggcaccagggcugcugggaggagcuuuaaaaacacugauuccugucugcguuccccauuaugauuuaacucuuccaggguggggcuuaagcaucuacuuuuuuuuuuuuuaagcucccagguaauauuaaugugcgaucagagugguccccaaaugcucacaccuaccccuccauaacuuucuguaguuucuacccauuguuugggcuucucuuucaaagaugaccuuccuggaucuaugguccugucucuuuuacacucuucuuucacagcccagagcaagcauccacccacuuacccauuaaacacuguuuagugcuacugugugccagguucaugguucuccccuaccuaaauccuugccuagaauacauaucuucauuccgguggauccauuauaaggcucaagguggaaguuucugguaaaaauggagaaucuauaaccugacagcagcccucauaaauuagccaucacaaagugagacaggaaaugcccacacaaguuuccugaugguuuauuggacaaauucaauaucauaacccauaugccauaaacacuccuaacggcguuagcacauuacaugccuucuuucuggguugggagaggggcugcaacacauucccccaacucuccaaucaaauccagggcuuggucuuuauggaauuucaagcauccaggcuaggcuaguuggguuagggaggaggguacauuucagagcacaaaggcucuaaaaacauuucucaaauccccugucacuuccugacugaccuaguagaacaccaauucuaggcauagccugugcaugaaguugguuacagaacuuaacuuucacaagcagcuguuugaggaccgagacuggguggugaucaggucuuguucaggccugaugaugaccugaaaauuccacaucuuugccacuuccuuccugagcccccaguuccuauccagacucugaaacccaaucacugaccaggugacaacuccaucucauguccgaggauuugugaugcaugcacagcaccagacuggguagguguggcccauuugaauacuuuuuuguaaguccacuggccaaauucucauuugauccaccuugauuuuccauauuccauucuauccauuccuggaggucaggaguacucacguagucacucagauacacgcugaauuaaacuccaagucaugguucaaaugggucauugauuucuuccucuucaauuuccauuuuucccuucaaagaaggaagaaugggcaggaaaaaucagugcaauuggcuggagacccacaguuggaugggcccugugcugaggccgucucucccuuacaagcucuuuacaaaaccgucaaacccccacugucaaugccuccacucccuccaaucauucggcccacugccaccugccuuccacgucacuggcccuguuuucgcuaaggccacugcugaccuccuaacuaccaaacccaaugucaucuuccaggucuuuuuccuaagaggccccucagcuucuggggcacccuuucggcugguuuuccacuuacuccuccagccgcuccucagaaccuuggccuaugccucgaaagcugguguucucuggguagucuccuccucccccugcagguuggcacccacgcggugaucacgcucaucucugcagcuggcuccagccuuccuccucaucuccaagugcuuccuugacaccgugcuacaggcagcucaaucccacacagacucaucaaaauccagcccugauccuguuuccuacauccuaucaaccaaggcuccuuugaaagugaaagggaacaccuuuaacaauuaugauggaugauguaaaccaggacaugcggucacccugaguauuguacaaaccuuggggaucauucuggccucuucucuuucccucacucucuacaacugacaggggaccaagucuugucauucuaacuuggacugucucuccaauuguuccccuucaucucugcugcucacugcccuggaccucuguaaagacucugagcugcccuccugccggcagccccuccccaggccagcccacccuuccugugauugcauuacuucccccccuccacccuacccccaacaaaagcuccagcgguucccgaugccugcucagugggcauuaaagcccuggccuacccuucccaucuccaacugccuauucccaacaacacccuccauccauuuucuagccagccaaucauuccauucucugaguguuucacuauuuaugcccccaagucuuuugccaaaaggcugccaugcuuuugccagugacuggacuaccacccuggguaccuuuggucauuggcccaagugaaggcaaagggcugcugagggaccgcagcuuuccccaguugcacauggaaaaggugcaacugucaugauguagaugacacucucuccuucucccucucucucucugaggcccuucuuucuggaguuccauagccacuggccuggcccaaguuugggguagggguaggguaucugaagccacugcaguagcaaguacccuguguuagccucuaguuccccgcucuugggugucauuucuucccggguccaugaguagccuuccaaagggaaucugcuggagaacuuauuggaggauggcaucaggcuccaacucuagggaccacaacccauaugcuuguucucuaauugcuuucagaguuccggagagacccugugaguuccuggguaucccccauguauaugauggggaauucauucugcugguuugaucucuuuuccuuugggcaacaucuuuaaaaaaagucuuccuuggagacuucaaaccuggaucuuuaacaaguccuugaugaaaugcuuggaaaugcucguguuuuuacccuggacuugacagcagccucuacagacuccuuucuccauauucugcuuggcuugucagaggccagagggauccaaaagaauuccucaggggaggaagcccuaagccuacaucuuauucuuuuuaguuuuuuuuuuuuucuuuuaagagacggugucuugauucuggaaguugcucucagaggcagcgugcgggugugcucuuugugaaauuccaccauggcauaccauggccagggccagaaagugcagaaggugaagaugcgcccaucaaccucaucuucagauacuuacaaaauagaucgcagauucagguguggcucuaugagcaagugaauaugcggacagaaggcuguaucauugguuuuaaugaguauacgaaccuuguuauuagaugaugcggaagagauucauucuaaaacaaagucaagaaaacaacugggucggaucaugcuaaaaggagguauuccucugcuacaaagugucuccagcuagaaaugaucaaugaagugagaaauuguugagaaggauacaguuuguuuuuagcuguccuuuguccaauaugaacauuuauucauauuguuuugauuacccuuauguuauuacaagauggcaauaaaugcuaugggauuguuugucuuacaacaaaaaaagagaugcugucuugcucuguugcccaggcuggagugcaguggcacgaacauggcucacuguggccuccugggcucaugcgauccucccaccucaaccucuugaguagcugggacuauaggcacacaucaccacacccagcuaauuuuuuuuuuuaacagaugggaucuugcuauguugcccaggcuggucucaaacuccuggcuucaagaaucccacugccucagccucccaaagugcugggauuacaggugugagccaccacgcuuggcuucuuuuuagcuuugacaacaucuacuucaacucaccugauugcuuaggcuggguuuugguuacagcuaaggcacaacuucuuguccuuaacaaccuuugucaagacacaugcuugcugguggaaucauguacagucuccacuucacaaaguccucuuccaggcauuguccagggagguauccuucgugagcacacacaugcuucaaaucacaaacaugaaaaugaucuuccuuuuaaugccugcuuuaaacagcagccacuggagguggagaauccagaggucuggccuguguaauacacuucgauagaaaccaugcccuuguguacaggccuacgggccuuguuauuauaguuaacuuuuaugguggguuuuaggggcugaaaaaauucuacuaauauuauuggaaauacauuuuauagcuuuggcuaugaaauaccacacacacacacacacacacacacacacacacacacacacacacacaccagcaauaauugaggaaguaauugaaaacaaauaacacuugaguauaugugcaaauucuacacaggugacugcaaaccacaaagauacuaaugagaaauggcagacagguucuuggcagguaggaucucacaggacgugugcaaggccugucacaguagauaugauaacugagggagagcaaauucucagucauuguaauaaaaccaaaucccagaagaacuucuuuuacaucccagaguggaggacaacuauuuuaggauguugcugcuuggacacaccuguucuaucagaaggggcugaguaugugauacugaguuuucuuuuuuccuucuguaucuuuuuccccuuuguaucugugguacacaguacagcacauuauucaacauauguucauuaaauggccaccgaaacaucuuucacacggguuaacaaauggccaggccucacguacaaggucuauuugucuguuuuuuuuuuuugagauagggucucacucugucaccgggguuggagugcaguggcacgaucuuggcucacugcagccuugaccucccagggcucaaguaauccuccuaccucaguccccaccggguagcugggacuacaugcacgcaccaccaugcccugcuaauuuuuuuuuuccuguauuguagagacgaggucucacuauguugcccaggcuggucucgaacuccugggcucaagcaaucugcccgccucaaccucccaaaauguugggauuacagacaugagccacugcguccggccacguacaaggucucuuuaaaugaugaauuggaaacaucaguauuucuucuuuugcuuaaauuccaguccccugccaacguacacugccauaccaagauuaaauagagaagggcacccagaagcaucugguucgcuguaagcacuugacagcuaucagcuaugaucaucauuucuucuugcugauguuacuguaacauuguggaugaagcaguguuugccuuaaucaaugggggcgaguuuggaaggccugcccuccagggaugucuuaguuccaggugcugcaauuugcaguccuggaaauggagaaaggagauaagccugcaguuuagugccaacugugaaaggucaguugugggggaggcugcugggggccucuugggaguucucagaggcccuccccucacauaugcacaguaucuggugucccagccaccaaguucuggagaccuccagaaugaucggaagcuucugcaggguccagccagugcucaggaacacucacggcccuccuuuuuccuuuccucauucaacauccccgcauuucaaggcucucuaccagcauuucuuuguucauuguucagaaaaaaaugaaucaagccaugacuagaggcuugaauucaacuuuaaaaaauuguauggcucaaagggucucuauccaaguuuuucccaaaagauuauucuccaaggaaaaaagaaaacaaaauggcuaaaucgcaacauuuuuucagucuccauuaucccacggcucucuuuaccccuugagacacacaaucuucaauaguaaacagggcugaaguuugagggcaaggccuagagaagcuguuuaauuucuaccccaaagacaaacucagauucuuucacaauuuucccucaggccagcccucugcuuuauagggccaaaccacugaaagaacaaaugaaugcgaacaauuugccucccagcagcgagcacuaagauuuccuacagauacgaauucccaagcaaacccugcccaaagauaauacaaaugaagguuggguuuaucgggcuuuuuaaaggguggcugccugaucuucuuuaggaucugaauauguuuacacggggauuggcggggcgcuuacugacagagcaguuuuagaaaacaaacacaggccccagaacacucaucagucugcagcggcucggccgcucauuccacaaauacucacugugcauccaccaugcgcagccacuguguguggugcugugggggacagaaugacaaugugucuugggagguggccucagcuauagguagggaggacagggcuucugucccaaaugguaaaugucauagagugggggugucaccgaguguggggguauuacagaguuaggccaagaggugggaucugagguagaccucgaagaguacagauggcaauuuccacagggcaaggcucuauucuagaaccaacguauucauguuaauaaauaagcaaggguuuugaacugaaaggaccuacgacacuguuuuccuaaagacgccuucggaggcgggcauggcuacaauuugucuuaagucucaggggucagugauggucacccacuggggaaggaagggcaugcagacagcccccccaaccccaauaucugcaggguuugggacaagaacauagaugcaagcccauacgcuuacacauguaaaaguuauaacucaagcugacaaacuguuaaauacauucucuccuccucccuugacaaauaugaaugcuacgaaaaggccaggcucgaauuuagaauucccagacuccuggguucuguaccagaaugcgguggugguaagagagccugaucuggcacccccaccauucccaguuccaucuuguccuaugaggucuugggaccacacauggaaacaucccagacaucucagcacccccaucaaagcucagccccaggcaaacgcgagcccccuaucucaaccuauaggugugcacaccaguggcuuggugcacguccagggaagagucaggcaggcucucaagccucaggaucccauucuuuggauccucagcuccguggauuccuggccuggucaggaaggaaguggucaggguggucagagcagggcccuccaaaguaggguccaaugcaggcccccccugcucaggucuaaggguacagugugcacaggcaaggauuuggcucacuggacugugaggcacacugugucgugugguuuugauuaugaugauacaggcuaaccuuuaucccagauaaugaauacaacauuagucugguuuccacuuaauccucaucagcccuacugaguuuaguauuguuguuauucccauuucacauaugaggaaacuaagauuagagagauuuuaauuuauccaaggccacacagcuagggguuguggagccaggauuugacuguuauacugagucucauggccuaaaaauacucagaggaaaaucauuuccugaucccgaaucauggaaaaucaagagccggaaggaaccaugacauucauaauguggaacccucacuacguggcgggagggggcagguagcagaggagaaauccaggguccugauuccggggcaguccccacgugggcagcagugugucccacagaguucaggagggcagcagcaccugguggguaugcugugcagugggcgugggcuccccaggggaugcaaggggaagccagucagggucaggcagggccagagcagccccgugggcauguguggccagcagcuggcaccacagcccucugugagcugagaaggugaccucacuccaaggggggcccuuggagcuauuuucuaaagcugcugccuuugaugcuuucuucaaaucccaugagcaaaguggcaaacuuggguggggaagccccagaaucuggcugcugugcaacuucauucuguuuccaaacagcggugugggagcucagcgcccacuccagugggcaguccgaggaugcccuggagcuaagccggggaaccuguucuuccucccugcagcugugcuggacagccaaggccuugguaggucaggaaggagggauuuuucuuuuuuuaaauuaauuuaaaauauuuaaaacuaagguguaauauguauacauaagcaaguacacaaaucucgugugcggcucaaugaaucuuuaagacaggauuuuguucuguugcccaggcuggggugcaauggcucaaucagagcucacuguagccucgaacuccugggcucaagcaaucuuccugauucagccucucgaguagcugagaccacaggcaugugccacuacagccagcuaauucuuaaaacuuuuguagagaugggggucucacuacguugcccaggcucuagugaauuuuuaauauguaauuuuuuuuuuuuaagacagagucucacucugucacccaggcuggagugcaauggugcgaucucagcucagugcaaacucugcuucccagguucaagugauucuccugccucagcuucccgaguggcugggauuacagaugcccgccaccacacccggcuaauuuuuguauuuuuauuagagaugguuucgccauguuggccaggcuggucucgaacuccugacaccucaggugauccacccaccucggccucccaaauuacaggcaugagccaccaaaccuggcccaauauguaaauaucaauguaaccaccagccuagaucaagauguagaauguuuuaaauugauuauaaguugcagaagcaaugcaugaacacacucuccuuguaaagcauuaaaacaugagcugugagccgaccccucccagugucccgccuacacacacaaggccccacuguuauauguaauugauuguguguccggaagcaggggcuucccccuaggcauucccaggccucuaggcagcugagcagccugacccaacagguuuagggucuuucuccuugaacauucucuucugcccauucccuucccccacccaaauccuccaacagagaaagagccuguggauuuggauaacacaacugccucgcugagcuuccucccuccccauccuuacaacugaaagcggucugacucggacgcuucuaagcuguggcugcagagaacacaaagagcagccuucggcgcgcggacgcaccaucgauguacuggguuggggcgggggggacgccaaccggccccaaagcacaucgaagccagaaacugcccgaacuaguuacauuccagcaagauuagcacaaggccgggccugcuccugcgcccaccccuccuccccuccugagccaugaauaggauuuuuaacuauuucccucccacuugcuguccagccucacacauggacaaugcuccccgcuguuugcacauuaaccucccauuugccaggcagcuucucaggggcugcagauuaacauccaccaacucagacaaucauccccggggaggggugcaaggggcucagacaaaagcuacagacacugagcccagucaaucaccgcacagugaccacuggccaacagugcaagggacuccuggacuccagacacacaggaaucaccacaggcggcucauuccuggcucugggcaccugccccacgugggaccagagaggauacuccccuaaugcaggccuacagcaaccagaagacauccuccccaccccaucuaaucugggacauucuggccuaggaggggcccgaaaggaucagggacugaagggcugggaaggcagagggcagccuuaggcaggccucgcagacccagcccacccuguuuaggcuucuccuuucucccggcaaagcggagcucucaggggacagaacaggaagcaggugccucaggccccugcccuggggcucccugggaaagcugccuggucucucagcaagaagggccccugacugaagcagcuuguagacaugauuccauacaucaaagccauuuuccuauucccuugugugcaggugugcacacaggcaugaacuuggaaacacaacagcauguaggggggagggaauggggagacagcuggacugugagguaugggaaugguccuucuauguccuaggccagcagcucagccccugcauuuguauuaaaaaucuccuccaggugaugcucaugcacccugguccugaaccagaggcccuggaagugaacaaucgcaugcauuagcugaggauccuguuaagaugcagucugggucaagaggugugucguggggcccaggaugguaaguuucuaaccagcucaagacacacucuugaggccaucucagugaggccucagacugggcgcaucaucagaagggcgaucucucuguaugcugcuucaccaaguaguugucuggcuacaguuuccacccuucucgagaaaggucaccaccucucaagacagccaguugcagcugcggacagcucuguuugaguccuuccucauauuaagacauccaacagugacaaucugaagucuuucuucucuugaccugguaguuccagacccucagaagaccuuguggcuuccacucguguuuuccccacauaccugugccuccucaucuaggccagugaggcuguuuuucugagcuucauucucuucuuaguacuaaugccagacagggugggggcaggggagcagaucucagugcagauuggcgaggcuauuuggguaggagugagaauagagcccccaacggaaacagaaaccagaguucuagccuggagcaguuaacauacaagaaacuuaaggacaauuaaaaagcaacaaccacaauuaacgugguuuacacaggcaaaacucauuaauguggaucggggugcuggaguuuaccuuugcuaggcaaacccuuuuuacagacaguacagauuaauugcaagcaagacuccaaggggaauaucuaaauggcuaugaaacaaccuucaagcccccccaaugcaggaaaaagcaccacugaccuacaagggacacacagaggacuucguccagggagcccccuugccagucuggcuucaauuccuggugaaguucagaagcaauaaaccugugcuccuuuugaaagguuuuauaauucagaagacccccuaauucacacuaacauccaccccaagucugaauuaauuguguuacccagcaguucugcuaaggaaucacuucaucaucacugcugcagggaaaauuugagcggggccgaugguuugcaguggcagcaagucuacaaaugauuaucccuaaugagaugaugcgagagcagccucaaauaaggcacuccuccagcugccccgugcccagcugggcuuccugcccucccacccgcuccaggccaugagcccuucauggggcucucauggcaagaggggccuggaucuuccaaaggugaaaccaucccaaagacccaagggcucccacucagucuccugcugccacucccugccccacugcaaggucacacaugacaguggggucuggcugagcuaggacugaauccugacuguaccccuuaccaguuguuaccuugaucuaaaguuaaucuuucugagccucagcucccacauguugaaaagguauuaguauaauccaguuccuaagauuguguggugguuuaacugagugaacgcuuagcaugcacagggccuggaguagguaaacucuuacgaugguaguaaaaaggaggaagauuucuuuuaaggacagggagauggccccucuuucuuugaggcuccaaagcucacuguucuucuguugugacacuaaccuuucccugccuugagaucaguuccacuacuuguguuguugcucugguggaccaggaaacagacaguuccuauauaaggucauggccccacucaucuuuuacuuaccuacugcaacguucaacccaauccuugcaauuaguaggaaccugaucaauauuucugcauugacuugccagcaugaaccagccuacucaggacaaagcauggaggucguaaccaaaugggucaaacagccaacagaccagaccuccccgcccccgccccugugagcagguuucugaccuuacgaacaacagcaguugcguuuagguaaaacgacaaucacacuucugacuggcugucaaacuauucaugaaaauggccaccaacuuccuauuuuuuaaaucaaacacuaagccauaugucugcuacacaaugaaaaaucccaaaccuaugugguuuaauaggcuuuccaacauuucuucagaagccuagaucucuaacguuuacauuuaaggugacacuggcucacggucuguuguuccauagucuuauugcacuguuuacacauccuaccucauuuuuacagaaaugggucauuaggccagggaccaccuucuuccaugucaugacaugcuuugguugggaguggcgaaggucuaauuuuaggccgucugagaaagggccuaaaauuuccuaaaguaaagcaauagagaucaaguuuuuagguuuucugagguuuuaaaaccagaaagccauucuguuuccuugagcugccauccauucaacccuagaaguugcagccugccguucugggcucagagaagggaggacuaaugcucagaacaguuucccuggggagcuggauacuaggugcugagguugggcucccuggcaggcacaggccucggggagcuugugguaggggcugcuuggaaaccacacacuuacucuacucugaugacacuguuugugugcaagcauuucuagacuguucuuuggaaaugggcuguagaaaacauucauuccuucaaaacacaccgcucuuuuguggucuuuuauuucccccuucuuggcuuugcuacucuccugggagucagaggcuccccaaacucccagggaagggaucucuuuuggagaggccaugcagaggggucacaccgaggcuugggucacaccgaggcuugggucaggguaguagagugauagcaaaugcucauguggaauugucugccugaacggguggcuauaaauuaucacaggguauaacugcccgagaccacguaggugaauuaucuacaaguccugcgaaugcucaggacuacagcugccaugaauauggcuucaaaauaaguuuccuuagaugaaaacaacugagaggccagaggcaucagcuagccuguggggaggaugugggaggaccacccauagccucaguuucccugggugcaccacucacuucccucagaguccuuucugugauaccugccucccccagcccucuugucacuguaccacccaaugcacacacagcagcagagaagcaucuggagugugaguguguguguuuugagagaggaucuuacucuguuacccaggcuggagugcaguggcgcaaucacagcucacugaagucucgaccuccuggguucaagugauccucccaccucagccucccaaguggcuaggauuacagguacgugccaccacgccuggcuaauuuuuuguaucguuuguagugaugggguuuugcuguguuacccaggcuggucucagacuccugagacucaaaugaucugccugcuuccgccucccaaaauacugggauuacaggcgugagccacugcaccuagccuagagugucucugaauugcaaucggaauuugaaugggaaacugucagcuaguuuaaggggcaagcaguagguagcuucuugucacauuuucucaaucagaugccagucacagggaacuaucaaaaagcggcgauuuacaagagugaccugaauagaugcucuggucuggucucucuccuucagcucuuauauccagcuggucccuucuguccugaagagguaaacagccucaagcggggcccagagacuuggguucuaacucgaccccaauuagcagugugaugacuuuaggcagguccuuuccccuugcugaucacagcugcuagaaaaagccuuuauggaaacaaacauguauuagaccccuacuguuuacacuauauacuguacacaauaaaggcaaaggcuuuuuauuucuuccucacaagcuucucuuugugugcauagaaaugagugcugauuaucauuuagacauaauaauauccggauaugggucauuaagcagggcagugaccuacccacuugguccacugaccuauucuugguuauugcaaaacauuauucagacagcaagauaaauugguuaauuuuucuuuccacuccuaaauuguuaaauuaguuacagcaaaaaacaaaacccaaguaaacaaaccacacaaaccuccuaaauacaaaguagggcccugauccugccaucuguuuaacuccuaaauauaggcugguuuaucucucucccaccuucugguggccucaggccauguucucaggccucuaacucuuagcugcuauuuagaauccagcuguuaauuacuuauuuaacaccuuuuugcugcucagucugaacacuaagcauucuccgagacuacaguuucuccuuugccuuucuuuaguggcucugaaaggucucucaaagguuaucuguccucaagaugugccuaauucugugcauucagggcuuucuuugcaggggacggcacaacuugggagcuuuuaacauacacgaaacacaaaauaguguaauacaaagcuagccaggcuuauuaaaaaucucauuuuucggcugggcaugguggaucacgccuguaauccuaccacuuugggaggcugaggugggugaucauuugaggccaggaguucgagaccagccuggccaacauggcgaaacccugucucuacuaaaaauacaaaaaucagccaggcgugguggccggcgccuguaaucccagcuacucaggaggcugaggcacgagaaucgcuugaacccgggagguggagguugcagugagccgagauagcaccacugcacuccagccugggcgacagagcgagacucugucucaaaaaaaaaaaauucucacuuuugagcuagucuauguuuaauauuuaauauauuaccgagugcuuuuuuaaaaggcccaguuaccaauuccuguguguggcaaggugagaaggccaggggugaugggugccuuauggcuuuggucuauugcagaugccuuccaguaguggaccagagcagcuggcacugguguacuggcaucuccuucaaacucaguguucagugaugucacguugguagcuugaaaucagccacagggagaguauuuacaucauggaaauuggcaaacacuaaucagagcacaauccuccccaccaggagcugacuguuaaauauuuaccaguacaucacugcuuauaacccauuuccccacuucucuuucuaucauuaauuuaaaggacucauuuauugggcacacaguccacugcauuagacacaaaugcuacagaaaaacaacaauaacaaauguuaccuuucucugucccuaugucuuugucuaugucuuuacacugcaaacucacuuaauccucagaacaacauagugggauaaagaaauaauguuaucaccuuuucacagaugaggaaacugaggcacagaauggcaaaaccuugcucauggcugcaacugaugaugcuuccagacccagaacugagggcuuuuccccaccccacagagcccauggguuuucuacucucccaggaaaaggccuggauggaggcccagugugcaaaaacucagggauauguuccaccagaacuaagacucaagagcaaaugaguuuuauggaggcuuuguaccaggaaggguucuuaagggagacaguugugcaggcugugaggaagguuccgcagacccccagaaaagcaggugaguggcaacuggggucaccuugagaagagggguuuuggaguacaacaggccccuuggccugguacacuuuaucaaggcagaaaaaugccuuccacuucuggagggaaaaaaaggaaagaggcacaggaugcaauuaggaaagaacaaacauauccucagauucucacagcugaacaacuagggaaaacccagccuguaaacaaucaaaaacuggugucgccagagcaaauacccaggacucugcucacccaugcaaggguaacugcacgagaaucggggcccacaccagcacaggccagcgagggaccacuuuuuccuuagcaguagcggcaguggcagcagcugguucuccugcuggguucccagauggaaauuccaaagggaacuacuuucugcauucagcacacagagaaaaacugcaacuagugaaaagcaaaaacuaaaauuucaaaugcuacuuuguagaaugcaaacagucauagucugccaacagacauuaggcuagguauuuccuuaugauacuuacaagagacggaaaaccaaguucacucccccuuucccuacuuccuccuguuuuuuuuuucccuccccaagggaaugagucaagucagucaacaaguauuuauggagcacccacaggauugcagagucugggaggaggcacggguugcuggaagaagcccaggauagcucucauuugagacaguuaaaggaaaugucaauccucaggccaggucuaaacagggcagugaagaacugacugccaccuggguggguuuauucuggaccaaucacucacuccuggcugagcugccucuguuauuggcaagguuauccaccaaaguggguggaucagcuauguucauguacauuuuuggaaaacuacaagcacaacgcuagcaaucuugaugguuuagggggugggaguuggugguuggcugagauacucuucuuccucccucccaaaaggccccacaacgauaaaaauuaaacaaauguugucagguguucaccauuucuccucugcaaauguaaguguguauaagugggacgggaaggcuagcaaaacccagggcccauggaaacagccuccugggggccuguccgcucuaguuuggagacuggguuguauuuauuuggcugcagauccugcuacuccaaguguguucccuggaccaguaccaucagcacuauguggaauuguguuagaaaugcagaguuccaggccccacgacagcccuacugaaguagaaucugcguuuacacaaucucuucagacgguucccaugcaugggugaguugaagaaacgccagucccaaaaaccaagcaaguguuuguuauuaaaccccagagagcccccaaagucacauuuggggaacaugugccuuucauauugcaggggggcaguuagcucccuagauuuccuguucacagaaagcaaauaccaguaaagccuaaagauuuauaaaucuauuauaacuccugguuuaaaaguagguaccuggaaggacccaggucaguugcacauuauucaaucaccauaggaagauauauucuuggagcuaacagaaccgaacacuaccggccacaaggagucuuuucacaucuacauuacacucaacuaacugcaugcuggccuagauucgcuucuguuuuaaauauccaagcuauguuugaauaaccuguaugguuacaauuaggaucacugcaucugggaaagucaccgcaaacccccacacauaaauacggugauuuuaauaacaaauaacacauuuggaggcugguauauaaguaugcaggcagaggaagccacugaagauguuaauuugcauguucacaaagaaauggaauccagcugcaacguuaaugcuuaauucuacagagccauaggacacccgcgcaaccuuaccaugggcaugcucuaaauuuaaagccgauuuucaaacccucacaauuuuggcaaaaaccucaauucaacugcuuaaggagacuggauuuucugugaauccuaaaauagugcuagcagaaaaaaguccauuuguuuaaguuuugcaaguuaaagacaaguaucugaauugauuugaugcaaagguucucaaaacauucaccuuggggcaggaaaaacaaaaggucucauuggaagagauuccuucuuauaagggauuggaauuuacggacuagggucuaacuuagcuguugcuuucuggccuccuacacuuguauuuacuguuuaaaguaaaaugugaaaauuauaucagucuuuaagaagauaaaccuucugaaauaggaugcauaugagugaauguguuuguauaagagggagagguuaauaauagcggucauggugauauuaauaacaauaaaagguagugugcuaauuuggauauuguauccugguaagcuguguucacuucaccaguuucucuaagaaaauggauucuguugaacugcucacuagcaugguguacuugcucaagcaccugcaaaaagacagagggggcuucuuguagggaugcaaacccaguggggcaaacaaacagagccugguaacagcacaaucaaucaacuguuucaguuaugaaggaaagagcugcuaaaaccucccacuccaguggaauguaccucacugaaagcucuuggcacucacucuuuacagagaaugguggguagccaggaccuauggugacaucaggcacagagcaauucuccuguccuacaaguggacaagagggaaggagggugguggucaaaaccaucauggggguacauguaucagauaaugacuagacugcaugauuucaugagauaagaaaaaaauaucuugagagaaaugcuugagaguccuuaggauugcaauucugcugagcacuuggcucaucuguuauuaauaaaugcugguggcaauauccaugaguacacuugucagaggggcugcuuccucccccaccgagcaacggccagauggagaagucaggagaccugcguggagagccucgccuugccaggggcaaauccaucaccucaauaagccucaacucacugucuauuaaauaggagugauuauaccagcugcacuuaauucuuagaacuauuuugaggaugaaaugagauaauggaugugagucguuaaguaugucaaucugggaauauguggguggagcugugugggaggugagcucccuucugcucugucaugaaaggcaugugacacucuucauaguacuucccucucccaggcccccaaauaagcuugccugucaauuuugacacauuuagaauucauuaaguaauuaaauccauuuugaucuaauugaguuuuccuuugagggcaguuuaagauuccacuaagccugugaagcuuaugaguaauugcaaguggaaacuacacccaacuguguugagauguccauccucgauuuuuucccaaugcaugauuucacuugccgggauggcacuguuacaucuggagaucagaaccaagccaaccaccaccacuagcagaagcaauaaauaacaccauugcauugagucagcacuguggacaguccuguccuaaaccacauucaugggggacaccugacugccauucacuuggagaucuuucugggcaaaggagagcuggucagucaccgggugaccaaaaccggcacugcacugcccaagaaggacauggccauccuuuaacuguuuccaucugacaaacugcuguuggucuaugggcaacuguuggucuguuuuuuuuuuuuuuuaauuaauuaauuuuuuuuugagauggagucucgcucuguugcccaggccggaaugcaguggugcgaucucggcucacugccagcuccuccucccagguucaugccauucuccugccucagccucccgaguagcugggacuacaagcgcccaccaccaugcccagcucauuuuuuguauuuuuuuuaguagagacgggguuucaccguguuagccaggauggucucgaucuccugaccucgugaucugcccgccucggccucccaaagugcugggauuacagaugugagccaccgugccuggcccggucuguuuuaaagaggccccuggcucugaccuuguagcucaaagaugagccacaugguuccagguccccaucugggacuucugguugcacugugccagugggaagccuugucagccaaccuaccccaucuuagagggaagagggacuggugacugaugcccagugaagaggcuugccuucggcccuccauccaagaagggaacccccuauggcccacuauccuaagcaagugcugagccauagucagcuucaccccauucucuaugggagccugacaccaaaccauugauuacaccaaucuucucagauaaggcaguccagcuuagguuccaagucuggagacuuuuuccugagucuccuagggggccagacgugccugggauuuugaagagccuccucucccugguaucugucuugauaccagauucuauucuggaaucuguccugcuagcgggcagagugccaagucuauauuuugaggacagcaaagaccugcauuugcuaaaccuaaugguuguuucucagcccucaucucacucgaccuucagcagcagccccucuuccuucguacacuccccuccuuggcugcaggaaugcggcgcccaccaggucuccuccuaccucucuggcugcuccuucucagucuccuuugccaguucuugcucuucucuccagugugcaaaagcuguagugcccacggcucagcccuugaccucuuuuuuucucagcuucagucucagggaucuccuccagucucauggcuugaaguaccaucaacaugcugaugacuaaagucucugucucuaaccuagaccucaucccugacuucuagacccaauuaccccaccuaucacucuccccacuggauguccaaaaaguaucuccaauacaacaugucccaaacagagcuccuaauuauuuccucccaaaccugccccucccacagucuucuccauuucugucaaugacacuuucuucuuucccacugcccaggagacauuccuaacucuucuuccucuugcuccccacauuuguuccaucagcaaauccugucacuccuccuucaaaauggguccagaaucugagaacuuuccccauuucuacugccaccauccaggccccacuggcccaacaacuugucucugauuuucuacccuugaccccuucggucuaugauuauaucauggcagccauggcgcuacguuaaaacaaagguuggaucacgucaccuuucugcucaagaccccucucuacuccccaucucagucaaaaggcuucaucaugggcugcaugccccugugaccagcccccuguccccuuucugacugugccuccuucagugcugccccccagccuugcccacucugcuccagccacucuguucugcccgcuccuggaaccuaccaagcgccauccccuuugcaccugcuguucccucugccuggcgugcucuucccccguguaugugucuauagaguuugucaccucccugugaggccuucaauaaauauugaauaaaugaaugaacaagcaaacugaaggcuuuacccugaacccucccuggcaggccgggaucccacaguuugccuguucguucuuucccuguggcuggauccugaacuccgcccaccacaucucccacccccagggggugcuguucacaaugugguccguggcuagcagggcagcucccaacgucaacucugcagggagccgugugaagucacaauaugaauacccggcccuuucuaaggugccuggcacguaguggauggcucagcguauaucuccugaacgaaguuucaccucucacccugagccagaauccugcccacucagaacccaagacccaugccuggggcugccucuggccaggaagcucucucuccucagcccauccccagccuucuccuccuggcccagcucccccuucccuugcugaguuucuagcaccucuuaugcuguucacacccagacaauuccgaaaacacuggauccccugugaaugguguggaaaugcaacuuccccacguggagucgcugggcauguuccccuucccuuccccucgaacccugcacagagggggccauuaugucacacaaggccacuucacgaguaagggacaaaacagcccuuuugaaacucaaaacaaagcuuaagagccgcaccugaguuacuaaagcuuccacucagccucacccauuccuagcaauaagcugcagcagccggaucugcucccaccucugggugacggcugggaacaccaggcuguuaccuuucaucaaaaacacaaagggacagcaagggaccucaggcauguaauggcgccgaggaguagccauaacauguuauuacagaauuaguucuuucgaaacugcgugccaacugauuauuaauaaacugcaaaaaugaguuaagggcggaauaauuggggcugaaugccuaccaauccugcacauguuaaccaagacauaugagguucaacuagaagccaauugaacaguuacuuauuguuaacuacuaugugccaagaugucggugcgucgagaucuuuaagacuugcuggaggccccacugccagagguguguaaucuaaauggggaaaggaaaggaaaacaugcccuuucauucaauaguuuuuaaaacaguacaguguacuaggaaaggcugagguaaaacaucugcuucaauagggaggcagagaaaaggggauauagaggcccuggggagauuucuugaaggagacagaaaacuggagaucugcaaagagaagaaacaggaggaagcaacacaucccguguggaaggggagaaagugggugcugugagcaggagugacaaagucuucaggaagacugagccuggggacaaggcuggccucaacauuugccuucuauacagggugugcacaaaccucaaugccaagccccauucaaggaaaaggaggaaggcugcagauggaccucacugacucucccuacagcagaagcgggcacagccgggugcagcgucuaggucaggagaggugguguuugcauucaugcugucauaacggcuguggucaggcuuggaugaggacgucaagcugacaaaaccucaaggugauggaggaccauuccuuccauuauuugagccaucccagaaagaagggagguaauucuuaagcgcgacauguucacaaauggaaaaguguggauuuggccuggauguuggcauuuuacuugggccggggcuuuaugugacguggguucuauguuggcagcccagaggcagccaagugacccagggaagccagcaaccauaggguuuccagccucaugguaucaauggaagaauuaugagaucacaaaugucagagccccuggggccuuguagguaaaugcuugguuugauuuuaagugauccagauaauagaagaaguucucacuggcuucuuuaagauggucccuuagacuuacagauguuuuuagguucucaugauucaaaaaucuauucuugcccccccgcaccaccgccccccuccgcccaaaaaaaaagcaagcaagcaaagagaaaccugaaaggaauauuuaccaaaaagcaaacuauuccuggacucacggaguuauccagguccuaaggaaauacaaauagaguccaacagacaguuuaguuaaaauacuaaaaauaaacaguggcuguauuuaauuucuuuuuuuaaguuucuaaggaagucaauaaaauaaaaauauaucuggggccugaauuaucaugcaugaacaaggacugcuugaaaguguacccagguugggcccgauggcucaugccuauaaucccagcacuuuaggaggccaaggugggcagaucaccugaggucaggaguucgagaccaaccugaccaacauggugaaacccugucucuacuaaaaauauaaaauuagcugggcaugguggcgggcaccuguaauccuagcugucaggaggcuaaggcaggagaaucgcuugaacccgggaggcagagguugcagugagccaagauggugccauugcauucaccuaagcaacaagagugaaacuccaucucaaaaaaaaaaaaaaaaaaaaaaaaaaaacaaaaacaaagugcauccaguccucuggaucaaagagugcaaagaggcucuucccugcuguuccccugcucccauccucuagacucaaugagucagucaacaaacuucuacugugcaccaccauguagaaggcacugaggacagggcauuucaagagucaaaugaggaaaauacucgugugccaacuucuguucccacacugagaaagaaagagagcaaaaacugcugagcuccaaaagacaugcuguguaaaaaauguugaaaaggaagacaaacccuuuaaaagggugaccuugggcgggcccuucccaauugaguuaaaugucacuaacucugagaacuuguacuuucugauuuccugauuuugcagaaucuaaagcuagcauaaugaauuuaaacccuccagcuuccuuccuuucuccauuuccuuaaaaacaaaaacaaaaggcacagauuuaauauuuccauuaaaauaaaacuuaacaaaaagcaucacauacuuuuacuauuaccauaguuuaggaaagaaacacauuuuucucucuuuuggcugcaagacuauuuuuucaaauuucagcaggcacaaaauucugccccuuggugacuuaaucuguaaguacaagcacuauuucaggcaacugauuuuuuuuuuuuuuuuuuugaggcaagagucuugcucuguugcccaggcuggagugcacuggugugaucuuggcucacugcaaccucugccgccuggguucaagcgauucuccugccucagaguagcugggauuacaggcacucgccaccauguccagcuaauuuuuuuuuuuuuuuuguauuuuuaguagagaugggguuuggccauguuggccagccuggucuuaaacuccugaccucaggcgauccacccaccuuggccucccaaagugcugggauuacaggugugagccaccaugcccagccaaugguuuuaucaucuguguguuucucaguuaucuccuucaccucuaacacgggaacuguuagaaacaggagggaaguucccauaucagcccuuugacuccucuccgguuugccauccacacccucugcgaugacagccugagguuuaaaacauccuucaucuccacagcagucccccggcuuccucuguguucacaacagccuugugagagagggaggugcagggacauaaucaucuccauugugcagaggaggaaagggaggcucccagagcugcucugugcaacgugguccaugcagugcaguggccacuugccacauguggcuauggagcccuggaaauggcaugcaggccacaggaaacacacacggaacacucaguacgagaaaagaacauccaacgucucaguaaucagucuuuaaauugauuacauguugaaaugcuaauacuguugaugaauuggguuacauaagauauacuauuaaaauuaauuuacuugcuuccuuuucauucuuguuuuuuuuuuguuuuuuuuuuuuuuuuuagauggagucucgcucuguugcccaggcuggagugcaguggcgcgaucuuggcucauugcaaccucugccucccagguucaagugauucuccugccucauccuccccagugggugggauuaacaggugcgugccaccaugcccggcuaaauuuuuuguauuuuuaguagagaugggguuucaucauguuggucaagcuggucucgaacuccugaccucaagugaucugccugucucagccucccaaggugccuggauuacaggcaugagccacugcgcccgaucuucauucucuuuuaauguggcuacaugaaaauuuaaaauuacugcuucagcuuauauuucauuuuuauuggacaguaccacccuggagagauuggugcaaagucauccagcaggccagggacagaccugggccaaauccacugcucccacugcguuugggggcauggcaucuuccagggcaugauggguugggaagaguuugcacauagaggagaaacaguccacacugugaugaguuugcacauagaggagaaacaguccacacugugcccagcaugagggggagggaugcugccuggggucuguguccguggcagggcagggaggggucuggagggcagggagcaacccucacagcagcagagaagcagggcaaaggaccacagggaaggccuccgacugcauaggaaggagcauacagggacugcagggggagccucagccuggcgggcugguccagugagggaagugggguauauacaucuccaaaacagggacccaacucuuaacccuuccuuccaucucuuuucuacacaguuaaauucuacacaguuaaggaauuacguuaaauuuuauaucagauuuagucauaccccuggaccccuguuuaaaaugcuccaauaccaguuuggccaacaugaugaaacuccaucucuacuaaaaauacaaaaauuagucgguguggugguggaucacgccuguagucccagcuacuuggaaggcucaggcagaagaacugcuugaccucgggaggcggagucagcagugaguggaaauugcgccacgacacuccagucugggcgacagaguaagacccugucucaagaaaaauaaauaaauaaauaaauaaauaaauaaauaaauaaauaaauaaauaaauaaaaugcuccaaaagauuguucccuguccauccaaccuaaaguagccccucagauacuaccccacugugcugcgcaguccucuguaugguguaucauuacugucuggguguuuccaucuguucacucucuguuuccccccagcagaaugugauauccaugagggcauagacuuugccugugugguuuucugccccauccucagcuccuaggacagugacuggaggcagaaggcaauccauaaggaagcguugaaggaagaaucaaugaaggaaucacggccccggcugugcgggaugacucaguuccuaccacgggugccaugugccggauaagaugcugcucugaauccccccaaaagaguagucaucuuccuugcagauaaggcagcugaaggcuccgugucucuguuugcuugugcccuucccccaguaccuggagaacggccuucccugccccagcugaagcuccuaagcccgccucccgcugccugcccugacuucggggcuccuccccuuccuccaaaacccuucacaggacacaaagugccgaagccuggagucgucugugugcuggccuuucuuccccaugcacuuauggacuguuagugaauagugccuaugucuuacacaacugaaucuccaccucccucgcucgcugccacugcgccagggcugcucuggguauacagcaggaaccuaauaaucaucugcuucaacugagccaggcagggagagccuuuccucccacugacccuggcggcccagggcggaagccuccuucgccuggaaugccaccaccuguuggguccugcccgcaucaccuucccccugcgucacuuuccucuuuguccgcucacacuuugcuugcaugccucccgcuucugcggaggcauguccuccauaugugaagagccagggagcccgcgaaccccgcuuuaggccuccuguucuuacccucuccucccugacccugccugauuuggcagccccccaccagcccccucccuccuucuucaugccccuccucccucccccauuauccuuagcuuugcaacccaccccccaaccccacuguuuacacagcugcagaaugaagagaugcucucuucuccacucuccaagcccaggguuaauauauguguauuucuggcuccccacaacuuggggcagagggaacacugcccccaacccaaucuccuguaaauaguugguacauggauagugacauuuucugaggauggaaaagcauguugaaccacuuagagugagugauccuguggaugccugugcagguuguacauagccuuccuguagcccaggaaaggagcagcugcuccacacuguggaagccccagacagcaagcgacaggcugagagggggcugcacugcagaccucggagucaccagggcuccaaucaggggccacaguuauaacaaggauccagugaaggauccuuguuauaacugugagcugugauugcaccacugcauccuucucaguccaaagcuuggccaagugugugggcaaguugcuggaaauuuuaaaaaacacaacaaaccacuagacaaacuguccaggaguucuaacaaauaccuuagaacuauaacaaaaggcuugaagguauuuugggccucuccaguccuaagacgugcuccaaaugaucaccaccuccuggaccauacuucagggcagaugggaaaacccaaccagaaaggucuaaaaagcaccucuccugagccuauggugguaucucagcauccuauuucagacuaaugcagguuaucugagaucagaguuccaagaaaagagcuuacgacagugaccuggggucugagggaugcaaagagcugaugcccucgccccguggugguagacagguuuagggaacaaagcauuuggaaaucucagucacugcaaaugacccugcagucccuccuucucuccuccugguuccuauuacucggcaauuccuagaaagccaugagacuuuugacgcuccucuaaaaugaaauuguuacuuugcauucugacuuucucccaggagcucagacuugggacucuguuuaccucuuauguugccccugcccccaacacagcccccagagcaugauacauggguagauacauauaacugauccccggcaaggcucucuuuccaagaaauuaccugacuuaccuuaugggaugccucccagccagaaaucugacaagcccagcaccugucucucaccuuucucuugaaaauucauucuuacauucuggggcuccagggacacaccaggggguucacacaauugcauccagaggccuccagcugcaaacauagaaggaaagccccuggaucugacccacaccagaggccucucugcagacaaacgggggaaguauggaccugauuuugccugugaugucuccuggaguccaggacaaccauggugacccaggucaucucaaagcaaagaacagaguccagaaaaaucugccuguauggacagagugccauagggucugaaauacucacugauacagaccgggcuugagugaauaacucacuucaggguuguuaaagccaucuuggcaugagucucaagguuggguuuuuuuugggggggggauggcgugguuugagacaaggucuugcucugucacccaggcuggggugcagcagugcaaucacagcucacugcagccuugaccuccagggcucaggcaauccucucaccucagcuccccaaguagcugagggcaugccaccaugccuggcuaauuuuuugauuuuuuuuguagaggcgaggucucacuauauugcuuagcuggucuugaacuccugggcucaagcgauccucuugccuccgccucucaaagugcugggauuacaaucaugagccacaguacccagccugguggguuuuuauuucugguagagacagacuuucccuauguuaccuaggcugaucuugaaugccugggcucaagcagugcucccaccuuggccucccaaaguguugggauuacaggcaugagccacaccgcaccuggccccuuauaagguguagccaaguuuuuauuuaugucauugcuaaaaagguaccuguuuugcccuugcccuuaagauccuaaugccuuggcuaguggagagcgucacagguauaacacauuggcugccucuuccuaguugagcuccgcgaggcuucugggcugcagguagggauuagcuccaugguacagaugaggaaaugugcccauggucacaccacaagggagccagcccugagccuaggggguggggcucccagcacggggccuuccucuuuuccacacugccccuuaggaaccacauucccagcauccccagaggguggugauaaaccaacccugcucacuccacugcauccuagauuguaggauaaagaaauggcuucggggagacaggguagggacagacaaaguccauaaugaagccaaacucacauccaagugcuuuggauuaauaugagcguguuauuuguacuuaguggggacccaggccuaaacuaagggaaaaugaaaacaauucugacagccauuuccuugcuuucuuucuccacccaagagguaccagugguuaacaguaugguggcaacaagugggucagaggucagccccucaguaagcucugguuuccauggagaugaggccuauucauccagcacacagagccucuucacagccacuuacacacaauugagcuauuacugggagcccaggagagcccugucuggagcacagugcgcuagacagggcaggguuuaauggagcugauuaaaugguaguuggggaauuauccagagcaggauuugagaacacccuucagaaacaaguuaaauccccaaaccucggcccauccccagcaacccucuccugcagagccucugcaauccaagccacccuuucaccuucaaugaugccaacaucugcacacucaagcugaccucaccuuucuucccauguguccaugagacgacaaagcccuauucugaguuuccuggaccucaccaccuuuagcgucuucaucuuuugcuuagcaucauggugauuuugugauuuagaaagguaucaacccacagacaaaaaauuaaaaguuaaguaggcgauccacuucgggcagaacauaaauuccagcagauggggaaugugguccaagacuucucaagaggugagaaauucuuuggcauauguuugggaauucgugaaaucaaucuuuugaaagaaugggggcauuccuucaaaagaugcaguaccaucuguaacuuaccaggcagaguuucuaccaaaauuuccacaaccuuuaaaaucagaguggaauggccagguguggugccucacacauguaaucccagcacuuugggaggccgagguggguggaccacaaggucaagagaucgagaccauccuggccaacauggugaaaacccaucucuacuaaaaauacaaaaauuagcugagcguguuggcaggugccuguauucccagcuacucgagaggcugaggcaggagaaucgccugaaccugggaggcagagguugcagugagcugagaucaugccacugcacuccagccuggcgaaagagcgaggcuccaucucgaaaaaaaaaaaaaaaaaaaaaagaaaagaaaaaagaaaagaaaugaaaaaagcagaguggaacaagagagaugaaaagugaaaugccuuauuagaagauuauauucucacacaaaaacuuuacgugacuauuuauaacaguuauauacauaaucuucccacacuagaaacaauccaaauguucuucagcagaugaaugaauaaacaaacacggguucauccauacaacggaaaaccgcucgguaaugaaaaagaacuacuaauaccugcagcaauguggaugaauuucaagugcauauuagugagcagaggaagccagaaucaaaaggcuacacaccauacgaauccacuuauauccuggaaaaggcaaaaccagagggauggagaguggaucagcaguugccaggguuuggggcucacuacaaaggggaugcccagggaaauuuggggguggguggaauuguucuauaucaugauuguggugguacaauuuguuaaaaccccaaaaguuaauuuuauagcauguuaaaaauaauucucuggcugagugcaguggcucacgcugguaaucccaguacuuugggaggcugaggcgggcagaucacgaggucaggagaucgagaccauccuggccaacauggugaaacccuaucucuacuaaaaauacaaaaauuagccaggcgugguggugugugccuguaaucccagcuacucaggagacugaggcaggagaaucacuugaaccagagaaucggagguugcagugaaccgaaaucacgccauugcauuccagccuggcaacagagcgagacuccaucuaaaaaaaaaaaaaaaaaaaucucugaauuuaaccuuuuuagagaacacaaaaagaaagugugcugacucuucaggucaggagaaaaugaagaagaaucuccaggaugggugugggggcucacaccuguaaucccagcacuuugggaggcugaagaggguggaucucuugagcccaggaguucaaaaccugccugggcaacacagggagaccucuucucuacaaaacaacccaaaaaguuagccaggcaugguggcacauaccuguagucccagcuacugagaaggcugaggugggaggaucucuugagcccaggaggucgaggcugcagugagcugugauuucgcugcacucuagccugggugacagagggagacccugucucaaaaaaauaaauaaaugaauaaacaaaaucacaaacaaaaaacaaaaaagaauccccuuuguucucugaaguuacaccugccaagcuguaacaguagcccacugguuuuaauuccuguugcuguuauugcuaaccaggguaagguaaagaugaauauauuccagaacugaagcacugcguggauaaguauaaacauucuaaugacaaccgggauuggauggggaacaucaacauuuauauuuuuugagaucuugcucuuccugaauaugucacuggaagaaaaauaacaguggaggagauaccgcuuaaucaguaggagaaaauagugggaaggagaaugcaaaaauaggguuuaaugcccauaugcugaacaguggugaacaaacuuaagaucaucaugcaaaggggucaacaagaccucacagaggucuuggcggaaugagacagacgaauggcugcuuguguccguggaaugucagcuuccccaggacacucauaucacugcuguggcccccagaacagcuuugggccauggagcugcaccaucaguauuuguuagauaaugaauaaaucugaggguagaaguucagaggaggaaauaugauuaaaaagaaauggagaagaaauaauggaggauguauacagaucgcuugaccgggcugagcaucacgaagcauuccugagagagacuuaaaauaacaaucacaaaaacaaacacacacagagcagaaaacaaaagacagaaagcagacaaaggcgagaauggauugcacgacagccucaagucuccagccucugcuggcagcuacucagcccugacccgaucgccuugugggcugcugaucugggaggcucaccagucagaugcagaggaaacaugaugaagaucuggacucucaacggugugacaaugagaaaugacacccaucuuacagcauaccaggcaccauccgaaguccuucgcuaacauuaacucaauccucuugagcacuaucugaaguaggggcuguugagggucucauuuuacagaugaagaaacggaggcacagggaagcucucugacucacccagggugggaucuaaaccuacccugaccaaagggucugcacccucaaucccuacacuacgcuagaaaaaagagauaaacccaccaacacaagguuaacagaaaugacguccuauacccaugccaggggugggaaauaguguguggaaggggacauggugggagggacaguuacacauguggacaauaacuuuugggggagucgauuuuacaacaugggugccggaaaaacgaagcugcuucaguggccagcauacucccuggugcccagggacugguguccugaucuuggauacaccagcgguggcccagaguggaguuggguggguggugcagagagcugaggacauucaaaaugauguuguaugagaccaucagugugaggaaggugaucugaaaagugaaaggcugucacguggacgaggaggaauucaguuugcucuaggcugcccccaucacugcagguguucaggcagaggccaggcaacaaauaguuggaccagauaacucugucaucucagccaacaauugaucauucucagaugugaagugguucuuaggucuucuagagcuacucaggagugaaaagcccaguuucaacucaaaguaggaauacaaaccaggaugcuaggaggaagcgccagacagaggagagaugcuugggcagcugagucaggugggcaacccuacagccuggggcucucuaacagacccaccucaacaggccuggcuuccugggggcgcacauuagaccuggcuguuccugcuggccagcuuaguaaccucguucaucugcaagauacuugcagauguuccaaaggauuuucaaguacccuauaauguuucugggaacauuuauauguucuuccucucuaaauagagcauuauuccugaggggaccaagauuucaagacacagggaucuguccaaacuuagacuaaguuuuggaaaguuuuaggcauuuguuccuuuauggaaaacuaacagcaaauuaaaaggcgauauccacccauccccucaggcuuuuccucuggcaacguguaugcagccuugaagcuauuacaauuuuuguuuuuuaaaaaagcacguuaguaguacugguucuucgcaauaacaaggcugccccacagaaagcagagugucacguagggaugcaggagaaaugggcacucuaugguugcccccgguauaagcugauucagcccccugcaaggaaaucuggugauaugauguagcuuuaagauguuucuaagguugggcgugguggcucaugccuauaaucccagcacuuugagaggcugagacgaguggauaaccugaggucaggaguucgagaccacccuggccaacauggugaaaccccaucucuacuaaaaauucaagaaauuagcugggcguggugaugggugccuguaaucacagcuacuugggaggcugaggcaugaaaaucacuugaacccaggagguggagguugcagugagccgagaucacaccauugcacuccagccugggcaacaagagugaaacucugucucaaaaaaagauguuucuagccuuuuacucaaugagcccaaaucuaggauuguacuccaggguacuaauccuaaauucagaaaaagcuuaauccauaagaaucaugcacugcacuauuguuuaugagaguaaagcaccagaaaaacccgaguuucuaaaaacaaggaaacaggggagucaacugaagaaagugcuuaggauaaaguaugaagugaaaaaagcuggacaccaaauuguaccucaguaugaagacaacgauauuugaaaaagagaaagaagcagaaaacuuacaugccagaagaaaggucuggcagaaaguggaccaacauuuaauuuauuuauuugagacagggucucacuuugccacccaggcuggaguguuacuggcacuaucucagcucauugcagccuugaccucccagguucaagcgauccuccugccgcagcagcccauguagcugggacucuaggccugugccaccacguccggcuauuuuuuuguauuuuuaguagagacagguuuucccauguuggccaggcuggucucaaacuccugagcucaagugauccaccuacuucagucuuccaaagugcugggaucacaggugugagccacugcacccaaacuggaccaacauuuuaaaacugauauauauugguggcuggaugauuaaguaaaauuuaaaaaaaucuucccccaaucuccaaauuuucuuuaaucaacacacuuucaccuucccuucucucucucucuaguagcucaagacagacgaggugaugaccccucugaaugugcuccccccuucucuguauguaacucagucuggugugccucuuccuaguguccugucagaauagagcugcacuuguacacauguuccuaucauuccaguucuuucucucuccaucucuuuagcagaauugggguuauaggacaccuuuucaauagcuccuguuuccuucagaauaagguuccaaucuccuuccuuccuuccuuuucuuuuuuugagacggagucucgcucugucucccagcuggagugcacuggcacgaucucagcucacugcaagcuccgccucccggguucaagugauuuuccugccucagccucccggaguagcugggacuacaggugugugccaacacgcccagcuaauuuuuuguauuuucaguagagacaggguuucaccauguuggccaggauggucucaaucucuugaccuugugauccgcacgccucagccucccaaagugcugggauuacaggcgugagccaccgcgccuggcccaagguucuaauuucuuuuccuuucuuuuuuuuuuuuuuuuuuugagacagagucucucucugucgcccaggcuggagugcaguggcgcaaucucggcucacugcaagcuccgccuccuggguucaugccaaucuccuggcucagccucccgaguagcugggacugcaggcgcccaccacccuccccggcuaauuuuuuguauuuuuuuuuuuaggagagaugggguuucaccguguuagccgggauggucucaaucuccugaccucaugaucugcccgccucggccucccaaagugcugggauuacaggcgugagccaccgagcccagccuaagguucaaauuucuaagaaugauaaagaaggacuuugagggcuggucucuguuaccucccuagcccaucucucaacaucuccuuccuugcuuccugugacuaaauuccaaccauucugaacuccuugggaaccccaagucagguggcauacuuugcagggagccccaacccaccucuucgcucccuuucaaggucuaggcugcccuuccucagcacaacguccccacuggugacuggacauucaucccucucucucacuugaaacgcagucccucuaaggcuggaacccuaucauuuaauuuuuauuaaacagaauuuugugucacucuguuacccaggcaggaguacaguggugcaaucacggcucacugcagccuugaccuccuagucucaagggauccuccugccucaacuccccaaguagcugagacuacaggcgugcaccaccacacauggcugauuuuuaaaauuauuuguagagacugggucucgcuauguugcccaagaugaucuugaacccgugggcucaagugauccuccugccuuggccucucaaaguguugggauuauaggcaugagccaccacacccagucuccuaucuuuuuauaauaccuuagucccuaagacacugcccagacugcuaggaccuacucaaggauuaaauguugaauggaaaaacaaauacccaaacaacaugaaaauguuugugacuaauuuuuuuuuuuuuuuuuuuuuuuuggagacagggucuugcucugucacucaggcuggagugcaguagggagaucauaguucccuguagccuuaaacuccuggguucaagcaauccucccaccucagccucccgaguagcugggacuacaggugcacggcaccacgccuggcuaauuuuuauuuuuguagagacagggucucacucuguugcccagccuggucuugaacuccuagccucaagagauccucccaccuugggccgcaaaguguugggauuauaggugugagccacugugcccagcccagaauccagagcuuauaaggaggaugggaaaugagccauauacacucaaauaaguggcaggcaucacugguuucuauuagaaugguagaaacaagacugaagagucaaguuuuuaacuaaagcuaagcuuauauaauuuaaaagacuguccuuugcucuagggugagcuuguccccccacccacccuuuuuguuauuauuaaaauauucuuuuucacaugaaauuaggaucguuguuucucuuaauauucuuacuugguuaaaaaaaaaaaaaagaggggguauuacucugacagucccuuuuccccaccaaguuuucugaaauucgaaugguccaaaaaacccaggcguuguucaaguggcaaccacucuaguaguucaugggaagaacaggucgccaaggccugagggagagggaggcuccuuuaguugaguucagaggggguuugacaguguaagcagagcagagcaaugcagugagcggagcuaagugcaaaggggugagggcaggaagagaaguccaaagauaaagggauuugguagaguuguuacaagguagaugccggaaaaacagcaaaacagcauaggagugaacauuuguuaagcaccaacucacucuggagaccaagugcuuguauuuucucagccacucuauguacgcuuuugcacaucugaucuuaaagccucucugagugagucccauccccauccugcagggucacaggguaaaacggcggcagcggugcuauuugaacccaagcccugacuguucucgcugucuuagaagcaagaccuuguguucaauuuaugaucaaugaggaugccuugaagguuugcaagcacgagaaugacauggagaaaguggugcacugggagguuaaaaaaaaaaaaaaaaaaggcggggggagauaaacagaaagggaagagcuggagucaggggcacuacugcagugauccaggcuggaaaaccacaaacuguguucugagagauggcucugggaucacaggacaguuuuagagaauacauaggaccuaggagugagugguuauuaugggacaggagggagagaagagcugaagucaccaaguuugggugauuaggagaaugggaacuaagagaauaaaguugggagaggaagcuacuuuauggugguagauuuccaccaaaacuuggaaguugcacugacauagagaagcacaguguggcacagcagcaaagaagccagguuccaggcuagcccagauucaaauccuggcuuugccagugacuuaagggacuugccacugacuuaggcaaguaauuuaucugugugucagcuuccuuaaugguaaaauagggauagguacaaaauggagcugguaccauuccuucugaaacuauuccaaucaauagaaaaagaagaaauccucccuaacucauuuuaugaggccagcaucauccugauaccaaagccuggcagagacacagcaaaaaaagagaauuuuaggcuaauaucccugaugaacaucgaugcgaagauccucaauaaaauacuagcaaaccgaauccagcagcacaucagaaagcuuaucuaccacaaucaaguuggcuucaucccuggaugcaaggcugguucaacauaugcaaaucaguaaauguaauccuucacauaaacagaaccaacgacaaaaaccacgugauuaucucaauagacgcagaaaaggccuucaacaaaauucaacagcauuucaugcuaaaaacucucaauaaacuagguauugauggaauguaucucaaaauaauaagagcuauuuaugacaaacccacagccaauaucauacugaaugagcaaaaacuagaagcauucccuuugaaaaccggcacaagacagggaugcccucucucaccacuccuaucaacacaguauuggaaguucuggccagggcaaucagucaagagaaagaaauaaaggguauucaauuaggaaaagaggaagucaaauugucucuguuugcagaugacaugacuguauauuuagaaaaccccaucgucucagcccaaaaucuccuuaagcuaauaagcaacuucagcaaagucucaggauacaaaaucaaugugcaaaaaucacaagcauucccauacaccaauaacagacaaacagagagccaaaucaugagugaacucccauucacaauuacuacaaagagaauaaaauaccuaggaauccaauuuacaaaggaugugaagggccucuucaaggagaacuacaaaccacugcucaacgaaauaaaagaagacacaaacaaauggaagaacauuccaugcucauggauaggaagaaucaauaucgugaaaauggccauacugcccaagguaauuuauagauucaaugccauccccaucaagcuaccacugacuuucuucacagaauuggaaaaaacuacuuuaaauuucauauggaaccaaaagagccggcauaggcaagaaaauccuaagcaaaaagaacaaagcuggaggcaucaugcuaccugacuucaaauauacuacaaggcuacaguaaccaaaacagcaugguacugguaccaaaacagagauauagaccaauggaacagaauagaggccucagaaauaacacugcacaucuacaaccaucugaucuuugacaaaccugacaaaaauaagcaauggggaaaggauucccuauuuaauaaauggugcugggaaaacuggcuagccauauguagaaagcuaaaacuggaucccuuccuaacaccuuacacaaaaauuaacucaagauggauuaaagacuuaaauguaagcccuaaaaccauaaaaacccuagaagaaaaccuaggcaauaccauucaggacauaggcaugggcaaagacuucaugacuaaaacaccaaaagcaauggcaacaaaagccaaaauugacaaaugggaucuaauuaaagagcuucugcacagcaaaagauacuaucaucagagugaacaggcaaccuacagaauaggagaaaauuuuugcaaucuauccaucugacaaaggacuaauauccagaaucuacaaagaacuuaaacaaauuuacaagaaaaaaacaaaugaccccaucaaaaagugggcaaaggauaugaacagauacuucucaaaugaagacauuuaugcagccaacagacauaugaaaaaauacucaucaucacuggucaucagagaaaugcaaaucaaaaacacaaugagauuucucaugccaguuagaauggcgaucauuaaagucaggaaacaacaggugcuggagaggguguggagaaauaggaacacuuuuacauuguuggugggaguguaaauuaguucaaccauuguggaagacaguauggcaauuccucaaggaucuagaacuagaaauaccauuugacccagcaaucccauuacuggguauauacucaaaggauuauaaaucaugcuacuauaaagacauaugcacauguauguuuacuguggcacuauucacaauagcaaagacuuggaaccgacccaaauguccaucaauaauugacuggauaaagaaaauguggcacauauacaccauggaauacuaugcagcuauaaaaaacgaugauuucauguccuuuggcagggacauggaugaagcuggaaaccaucauucucagcaaacuaucacaaggacaggaaaccaaacacugcauguccucacucauaggugggaguugaacaaugagaacacauggacacagggagaggaacaucacacaccagggccuguuggggagugggggcugggggagggauaguguuaggagaaauaccuaauguaaaugacaaguugaugggugcagcaaaccaauauggcacauguauaccuauguaacaaaccugcacguugugcacauguauccuagaacuuaaaguauaauaaaaaaagguaaaauagggacaaagaacagcaagcacauaccucaugggaggguugcuguagggacuaaagguguucuuauuuguaaaguccuagaaaguguaugccuugcgggguuaaaucacucauucccccaauuuuugcugugagugguugcuuuuggguacuuuuugcuggguuuugcaacuuucuucauccuccuucucauucucagcacaccaguaucuauccagcuccaccuggggaagcagacaccccauacauccaccuccagcagcucacuugaucaggccuuauucccuacccuugccggccccucccucuaaccccccuuggcugugggguccugcucagacacucaaccauccaccaaacacucuaacuucuaccugggauucugccaggugaauaaaaaugaaauauuuaaaaccuuuuauuuuguggccaggugugguggcucaugccuguaaucccggcacuuugggaggcuaaggcaagaggaucacuugaggccaggauuucgaaaccuugucucuacaaaaaauuuagaaaaauuagcagggcgugauggcacacaccuauagucccagcuacucaggaggcugagguggggggauugcuugggcccaggaguuugaagcuacagugagcuaugauugcaccagugcacucuagccuaggcgacugagugagauuccaucucaaaaacaaaccauuuuggaaaauuuccaauguacacaaaaguagagagaacaauauaaugaaucugguuaagccaccaccagguucugcaauuacuagcucauggcccgucuccauucauccaucccccacccacuccuugcucauccaccccuaagcccaagacuauuucgaaacagagcccagauagccuaucacuucauugguaaauauuucuguguguuaucucuagaaagcagaaaauuuuuuaaaauccuaaaaaauguuuuuaaggguuaacaauaauuuucuaauauuaugucuuacaaauaauuuuucccuacaguuuauuccaaucaggauccaaugcaugguccauacauuugcuauuggucaauuuaugucuuuuauucuuuuuuaaagccuuuaaucuuuuuuuuuuuuuuuuuuuugagauggggucucacucugucacccaggcuggagugcagcagugcaaucuaggcucacugcagccucugccucccuggcucaagcaauccucacaacucagccucccaaguagcugggacgacaggugcauaccccugugccgggcuaauuuuuuguauuuuugguggagacagggauuucaccauguugcccaggcuggccuugaacuccugagcucaagcaauccacaccguggccucccaaagugcugggauuacaggcgugaaccaccacgccuggccaagccuuuaguguuuuuuuuuuuguuuguuuguuuguuuuuuuuuuugagauggagucucacucuugcugcccaggcuggagugcaauggccaaucucggcucacugcaaccuccaccuucugguuucaagcgauucuccugccucagccucccaaguagcugggauuacaggcgugcgccaccacgcccgcuuaauuuuguauuuuuaguagagacgagguuucaccauguuggucaggcuggucucgaacuccugaccucaggugauccacccuccucggccuccagaagugcugggauuauaggcaugagccaccgcaucuggccaccuuuagucuuuuauagccuuuuaaucuuuaggagucuuucucuuucccuauuuccacccugcccacgccuccuguauuauucguggaggaaaccaaguuauuguuccuguaguuuuuuuuuuuuuuaagucuggauuuugcuaaucauauccucauggugucaaucuaacauguucuucugaauuguauuucugguaaauuaauaauuagaucuagaggcuugaucaaauucagguucaauguuauuuuacuuuauuuuauuuaggggagagggaaugccaugguuugaauaugucccccaaaguucauguuuugcaaacuuaaugcauaaugcaacaguguugagaaguggaaacuuuaagaggugauuagguuaugagggcugugcccucauaaauguauuaaugcccuuauugugggaguggguuccugauuaaaguaugaguuugccccccaucccccauucugccgucuugugcacacacaggcguacucucuugccuuucugcuauaggacgaugcaguaagaaggccugcaccagaugcugagcagaugucggcacuaugcccuuggacuucccagccuccuuaacugugagccaaguaaauaucuuuccuuuauaaauuacccaguuuguggugugcuguuacagcaacacaaaaugaacuaagacaggaaacaagacuauuucuucuucauuuauuagcugaaauacuucuguaaagaaaaacuuuccucaacuaguggcccaguggcaaacagcacacagcacaggcaggacaaaugcgugauucuuucuauuaacauauugaaaauaaugacucagcucccuguuguccuccaaaggagaccaguguuguguuuauuuuguuguguuuucuuggugucagcgugaacuuaaggauuuuaauaaauauaauauauucuugaugaucuaauuauuucaucuuuuccgucuuacucaguuuggcugcugaguccuuccgaccuagcagcccuaguaccugagugcguaacaauagacuugggucucuaauggucuucaauagcuuucaugcuuucuuguauaacaauauauucuaggcuaacuucauacaucgaaucagcuccuucucccaggagccugguuuuauuuuaacugggaaaugggauuuggugaauauaaucugagcacuggagcuggucagugcuauugagauaaucauuguuucuaaucuuuuccaguggauagagcuacaaaauauauauucucucucuuuuaagcaccaaaauaacuuucaaaauaagcuuuaauuuuaaaaggaaaacuaaauuauuuauucccacuuuucugaaguuuuaaaaauguuguuuauaguuauggaauaaacuaucaucuaguuauaaaacuauaggcugggugcaguggcucaugccuguaaucccagcacuuugggaggcugagguggguagagaacgaggucaagagaucgagaccauccuggccaacauggugaaacccugucucuaucaaaaauacaaaaguuagcugggcauggaggcgcgugccuguaguccaagcugcucggaaggcugaggcaggagaaucgcuucaaccugggaggagguugcagugagcugacauugcgccacuguacuccagccugggugacagugagacuccaucucaaaaaauauauauacauauauauauauuuuuuuuuaaguacagaaaguaaguagagacacuaauggacaccagauugaauagcuuaucauuuucccauauuaaucuagagcuccccaccucuuuuuuuucuuaaagaaauaaaguguuauugauauagcucaaguauccgaucugucauucauuuaucugcccucccagaaguaauguuguccuaaagguacugcuugucauaccucugcauguuuuucauugaauauauuucacuacauauguauuauccacaauuuauagguucaaugagugucuucaauuuuuuauuuugaaaaguuccauuuuacaggaaaguuauaggaaaaguacaauaaacacccaucuguccuucauccagaucaaucaucguuaacauguucacacauuggcuuugcuuaccucccuccccuauguauguauucacacaaacacauuuuaauuuugcagaaccauuugaaagucaguugucaacauuguaacaccuuacccucaaauaccucagcccagaucuccuaaacaccagggcauucuccuguauaaccaaaugcaauuaucauucucuugggaguuacaaacauucuuauaaauggcacuacauuuuagguauuuuuuagccccuuauuuuuucuuucuuucuuuucaaagagaugaggucucacuaugcugcccaugcuggucuuaaacuccuggguucaagugaucccacugccucggccucccaaagugcugggauuauaggugugagcaacugugcccagccuagccacuuacuuuuucuaaugaguguuacacuuuuagaauuuauucauguuaauacauguagaucugaguuaauucacuauauucuacuagaugacuauauuuauuuauuuaauacauagauggccacauauguuguuucuaguuuaugcuacuguaaacaaugcagcaaggagcguucuuguucaugucccuugugcucauguguaguagauuugcugggucauaagauaugugcaucuuugauuuuacuagauauugccaaaucauuccucaauauaauacgcaaaugugucauuuauuaacaaacauccucgccaacaccaguaugcuuagacuuuaacuuuugccgucucauuguuuuagucugcauuucucugauccugcuucuuucuuucaauggaaagcauacaacagcauuuucuggggaaaaaaaauuguuuuuugagaugggguuucacucuguugcccaagcuggaguucaggggcacaagcguggcucacugcagccccuaacuucugggcucaagccauccucucaccucagccuccugaguagcugggauuacaggugugugccuauuuuauuuuauuuuuuguagagacagggucuggcuauguugaccuggcuggucuugaacuccuggccucaagugauccuccugcuucagcaucccaaaguauugggauuacaggugugacccagugcuccuggcucugaacaucuuauucaccauuaugcccguccaucacagaguauccuuuuauauuauuacuucucauauuuuccccugccuagauggucagcugccacuuaaucugcagaugacugcacuauauaaucaagcaguguucuuuuaucaagucaggaaagccuggguaaauauccaaggaccucuccuagaggaaaaaaugcaaaagcuuuaggaaagaacacuaucaccaguuuucccccccccauuggaauaaaaagauauuuuaacuaaauauuuccuaguucaugauuuuaauauagauguuuggaaccacuagaagucagauaacgcugggcgugguagcucacgccuguaaucccagaacuuugggaggccaaggcaggcaaaucccuugaaccuaggaguucaagaccaaccugggcaacauggugaaaccccaucucuucaaaaaauacaaaaauuagccaggcaugguggcaugugcuuauagucccaguuauucaggaggcugaggcagaaggauugcuugagcccaggaggcggaauugcagugagccaagaucgugccacugcacuccaggccugggugacagagcaagaucuugucucaaaaauaaauaaauaaauaaauaaauaaauaaauaaaauaaguaaaguuagaaaagugugggaugcauuucagaacauuuuaaaucaaaaacaccuagaguuaauuauagugcuuugaaaagggagcauuuauugucuggaaaaaaauuucuuaagggauauaagacauauauaggaaaauuucacccuauaaauacauagugaacaccucucgggcauucuucuaggcacgggagaagaggacaugauuuuugauuccaaggaauuccauggucuagugaaggagacaaaaaagaaaaaaauuauuuugauaaaaacugauuagaccuaauuuaaugcuaguacaaguugagcaucccuaaccccaaaaucgaaaauacaaaauccaaaaugcucaaaaaucugaaacuucuugagugccaacaugacacucaaaugagaugcugacuggggcaugucagauuuuccaauuacagaugcucagcuggucaguauaaugcaaauauucccaaauccaauaagaguuccaaaacugcgaaacacuucuggccccaaacauuuuggauaagggauacuuggccuauacaggguauugggggagggaguacagaagggaaucaugggcaaggaacaugcuacucagugguggguaggaugucaguaaacucugaaaaagaaaagugccucaacagcaccuuggggucauuggugaggauacugguuggcaguggaauguccgagucuguauggcugaagagcauggugcccaugggaagaagcugggacacaggcugugacacccuaugcugcgacaugaguagugagugacaucaaacgugagcagaaugugucuucccucauuugaacucauucacuuuaaacaaagaccuuggaaauuaaagaguguagaaacaccuuaauuuccuuuuucugugaacaaauuguucuguuucucagagugcuucagcugcaagucaguauaacuugccagguuugcuucaaucuuaucuaccucguguuuguaauuaucaaaguuaggaaguucacaggcuuagguggccacuuacaaacauuuguuguggagugaaaauggccacaaugugcagacuuguuucaaguugacgcugucaguuugccaauguggugagggcaggaggugucuuaaacaaugccucauauucaacacacaugugggauuccccuucugaauugaagauggcuugccucugaagacuucugguaaaucaccacguucuagggacaaugaauggggucauuaagaaggcaacucuuccuugcugggacacaggcggaggaaggcuugcauccagguaguacuagaacccacacuuggacggucuccugcaaggcucagaucaaacaucucuccaaagccucugccuucuccaagcuugagaagccccuuucucagguauuucaggugacauuuuauuccacuuuguuggcgcucacugcagguauuguaaagacucauguuccuguuuguucucuuacauuguaagcucuggagggcugggacccuaucaugcucuccuugguagccacagaaguuguucgguaauugcuaacuggagagggggaugcacacacaccaggcauucuuccagggccgggaggaaggggcuaacguuggucugauuaauuucccaacauacgccuucuagaagcaaaaggaagcauggacauguuugugggcugguauguuugcuucuaucuuauuuuacucucugaggcaaaauaaaaaggguaagaugaacucaguuaacuuaauaucaccaauugcucacuggaaguuguuuggaauccaucguuuccgaaaacuccaagcacagcagggcgcgagguucccagauggcaagugggcugucgggucuucaugggcagcggaaacgggcaaauugcauuuugcacagucacauaccuucucagcagagcccaacuauuauuuccucaccagucaaguaaugcagggugggggauggggggaaaaaagcugcccggagccacggggaaggaaaggcugggcaggcagggcccaaacuugcucauacuuuguuagugccuuuucuucccuuuugaauaaaaucugcauucccuuucucggagaagggcagccgggcuccccaccuaacacagcccugaaugcaguggacuuggugccccaaagccaagcuccucaaggaagcugaacccaggccagcaucaccacaagaggagaaagggagauugucccccgcccagcgccaacauuucauucucuucagaggccucaaaacccuaauuugaccacaaaaaccuggccucugguguuucuguuaugaguaucggauuccuucggcugaacuuggcuguucacugccugaacaaauuacauuaacaauacagagaaauguauacagggccuuaaaaacacugcugagcagggaccaaaacaaagacagccguguccuagcaacaaaccucaccaccccccucacccccccccacccccaccccagcagccuugggcucugccagggauuguaagccauugagcuccucucuucucugcaaacaauuagggacagagaagucacaauuacagaugggauuuacagccaaaggagcaaucuauaaaucacagugcucccacccccggccauucccagccagauaaucagagccagauguucggcacagcugcuucaacguggguacacuguuggccaacucgaccauguucccgcucugagaaccagcaaaggcuccagccaagccaaccugccaagcaaggcggggggccucugcacccuggagcccacccaacuguaggaaaaguugcguugugugggaacuguuuguugaagccauuguagagguacaucacuggcgaggguauguggcucccuggaguucccucgaacgcugcacaauuucgugauaguggugacaaugacaaucagcaucuuuagcauuuauugaucaccugcuacggacucaccacuggguggagcacguuacagguacuccuuugcuaaagaacacucaagaguucacccaauucacaaagaaacggaaccugagagagggcaacuguuuuucagaaggucccgguguuaaaguggcagaacagcaauucaaagcuggaucugcuugaccuugaugccccaggaaucucaucuaauuguagagggauggacagacucugguuucagggcacagggcuggaguuuccaaauuacucucuugauggucaaacuaggaagagacuugccauuauuuuacucuccauagcuggcugguguuuuaaaugucuggacugaaccaaaucagguuuuuagcaccuaggaccaggggacagcaaacuccaaauaugguaaaagcuagguuauucaaauguugccaagguguuucuguucacaguccaccuuuaugcauauuuuucuuuauuguuacuuauucacugagauauagcauauauacaguaaaauguacacaucuuuuuuaaaacucggggagccccuguuaccagaauagguucagagcgauuccccacaucuuaaauguacagcucaauuaauacaucuguauaaacuugugucaccaccaccagaucaagauacagaacauuccagaaccauucuagagguucuugcauauccugucccagccaacauuccucugcccccaagguaacuccuacucuaaccuuuaucaccauagacaguuuuguuuuugagccuuauugugucuuguuuugaauacacaugucuuuuguacaguuuugguuauucucagggucaaaucaaggcucccaauucaaaacuaccaacaacgaaaacucgagauaacacaacuaguccuaucggcuggcacuggcuuugggagacaauuccacaacaucccuaacuccuccucauaggacccugcuccuggugacuaagacugccccugcccucaaggggcagaaaggccccaggccauuugucuucgagcaucacccgguaaucgaaucugguaguaacaagcuguguuuaccccucuugccacccgucauccuugacacgcugacagccaccaucuuucacuccucaggaagugcagcagggcauggaggauguggcuguggcucuucacgggagggggaggaugacacaggcuggaaugccuggguucccugacacgguucaggcugcugagcauggcacuccccgaucaucccucacaccucucaccgccccggagguggcugagucaggggcguuccggggugagaauggcagcaggagcaucccacuggggugggaggaagccccccauccaugcacagugggacacccucuggauccagccuuuaauucagaaaucuggacagaaagcuaugcaagauaugggggcaguggguuggagcugugagacguuucagucgaaaugacacaaaaaggcuagcacaucagacagagauucugagaagagaaaacacacuccugggugcugggaggaggggcaugggcagaauuuucuuuucuuggccuucccuccagaguuuugaccucacccaaaagcgcaguacugcccaccuuagcuccuuggcacugccacaguuucacuucccagggugguuauuuuuagcugccccaagcaccuguuuguuuccaugacuguugaaaauucuaaauguguuggcauauuaugacaugggacacuuccaagggaucuagugccaucagccggaaauggcaaauccuuaggaauuuucacucucauucaaguauuuauggcugauacauaaauacagugaccuuaccuuccaaauaaaacacuggggcauaggauuccucaaaggcuauuuuuggguauuacuucuaagugugagacaaucagagaggugucauugggagguggaaaccauagaauuauaggauauuccugauuuguagggaauaugucucauuaccuauaauaagaaccacuagaaaauucauaacuuaaaaucaguguagacacaggcuacucuagaguucugcauuucgaaguuuaauacaguuccuugucauggcugcucccacccaaaaaggagcugggguccauucaugcaccuggcccccaaacccuccccccaccccagccacagggaaacuggagguuucuccugcccaucuuugugcuccccuucaaggcguuuucugggccucccuugggucaccaguccagucuugcacaaccccuucucaccccaccccacaccucacccacuuccaggacuccaccagacagauuuucuagauucucuucugcugagggacaagguuuugucacauucgagucccaggggacaucuuagggccauuccacuucccaaucccguaaugacacagaaggguccucugacccuccccaugucucuguuuggaccccacagugaccuugcccacagccugcucagcggguucgucucaccguccugaagaaggcugugcaugcucaaccugggggugaugacauccuuccucagggguccaagauacugacgugcaccaagacccaaacccauuugcaacucacacagaaacaaaagaaaacucaucagucauaaaaggacccugcugacagccacuugacacggugcacacuuuccaccucugcgcuuuuacucuugcugucccccugccuagcauggcucuucccucucgcaguucaggcccaauucaaaagacagguccucuaaaaaguccaucaauccccaggcugugaugaguuuuccuucuuccgacccacagagcaagcacaugaaugcuucccaggguugggcauagaggagucaagauaauaacagcagccacaauaauaauuaucaggugcuucugggcuuuuacacagacugaagcucagcaaauccccacaacaagaucaggacgcagguacugccacugcccagauguacagaagaggucagguaaccugcuugaggucaugccagcugguaagugguggguccaggguuugaacccagccccacucagcccagacacaccacagagcucugcaggagggguggccacagcccaucugggggcugcugacuguuaccguguaggaauuugagcccauucuugccauaccuccugauuuuuugagacaggcuagaagucuggaauuuuuuuuuuuuuuuuuuuuuuuuuuugagauggagucuugcucugucgcccaggcuggagugcagcggcgugaucucagcucacugcaaccucugccucccagguucaagcgauucuccugccucagcaucccgaguagcugggauuacaggcgcgugccaccacauccgacugauuuuuguauuuuuacuagagaugggguuucaucauguuggccaggcuggucuugaauuccugaccucaggugacccacccgccucggccucccagagugcugggauuacaggcaugagcuaccauuccuggccgaaagucuggauuuuuacaugccuuuuuuaacuuuguaaaaucacuguuccugccccaaaucacagcuacaagggaugugggcccacgggcauaggucaugccugcucuaaagaccagaccaggcacugccauguggggucuccccugcuguggccuggaauuaugauuucuaugucugugguuucagaaacucuucuugccuaaauuauaagcuaggugagggcagggagcagguccuauaaugcaucguuuuaugaaaucccacauagcuguugccccuccuggaaggcacagggauagacuuaccuucauggagaucccacuacgagccagcacuggaugagacccuucccauguguugucucauuuaauccucauaaugaccuguugagguugguaauacugacccagcucuuucuuuuuaaaccagugaagaucuaaagaucagagagguuaagucucugaccgaaagucacagacaucaggggcagugcugugcacacaccuuucaacucagagaacugauguacauauuguugauagucuccaucguggugguuccagacaauuccuaaauuuauuaauaaggaggaguuuauguuuggcaggaucucaccagagacaugccuaucucucaguaaauaagaaagcaauuggaucccuggauaccuaaauucucagagcucucaggccacuguuugucuugaagacagaaaacugcccuagagaugaaagcuauucaacaaugcguacugaaucucuacuguguggccuauuuuaugagugcagaagucaaggugccucugggagauagacccaucuugcugugugacgggaggcagugcagaguggguggugccucgcgcagguuccugggcucugccacuuguuagcuaugugacccuuaggcagguugcugcgauucuccacacuucauuuucccucccugcauguggagguaaugagaugaugcugaccgaaaucgccaccucacagggcuguugugaggauuaaauuaguuaacauacauguuuagaaugaugccuggcacauggcaaguacuccggaaaugaccauguuauuauuuagaacacuaagucgcuauucccuugccacgccccauggaagaaagaggcccuaacagacaaggacaaagggcugggaacaaccuggaugaacccagcccucccuccgcacuguugucugaaacuuccuucaauggccuggugaaaccucuuccuccccuggacaaaucuuggcuaugguguuuucacuugacucucuuggguuuuccagguagacaaucugcaaacugugauaguuuuaccuguucuuuuccaaccuuugcugucuuggcuacugugccaaugcaaaaccccuguccuccucuccuagcccuucacacuugucuaccuagcaccaacccuauggcacuaguggagaugccugccaaggggagaaacuacagggcuccagccaggggccauagcugugcugggcccucagccuccccagcagggcagaagguagaaugaagauggggaugcccauguguguggggaaggggccaggcaggagcgaggccucucagaggaggcaaggggaaaggcacagcuggguuacuauaaggagccaguuaaugguaacauggcugggaguguuccccauggggccucacccagggcuggucucaagaaauacugcugaaucaacacugaccugugaagacuauauccaguucaucaugggcacagccuagguggggcccuucugaauucuccccuuugccaggauucuaagaauauggagauccaauugccuuagaguuuaccaagagacacccaugucucaaacagagaucccugcuaaaaaaugaaaacaguuuccuaauucauuaauauucuaacugauuucccugucuggaaccaccccagaucugcuaaauuagacucccugggaaagggcuauaggauacauuuuuagaggaaauaaaucaccucauaaucaggaaaugcaauagcugccucgguggguuucugugcaaaggugucgcuccccauugccuggguguaugugccugucaccccugggagacagccccuuaauuccagugcugcaccuucugcgcuuuggaaugggcccaggagucugcauuucgacaagcaccugugaugauucugaagcaggggucuguggaccacacucugagaauuacugcccuggcauuuuccagguuugaaguuccugagcauccucuguguaguuucccaaucucucuucucacccaagaugcuccuuagggcauugagguuucaaacagugccuuuucagagcauaagcaacgggcagaccacaggaaaagcagcaggauucccagcaaguacuggcacugccacugaaacaccuaguuuggaaagggcugcagaauggucagcuaagccuuuccaucucaugcauguacccgaauaggacaagugccaccaccucacauauaacuguguccacaguugcaggcaaaggaaggugaacaggucacucaggccuccacaccuuugugaucccuccauuggagacagcaaucacuuuccucuuugggcuacugcuuagagauauacugccuuauucgcucucuagccuaacuuaacgaaggccagcugguucuaagggccuuccuggcaaucggaaacagcuugccugcuaccugaacuggauauguaacauucgucugucccacucggaggaaacgcuuacaaccagaccacccuguuuuaauguggcgccuuucagauuaagagaaauauuugaccccguuauucuaugacuccuguaaaauccuacaacagaugcagagaaaaauguaaagaaaucaaugacauacaaaugaggcugaaccugccaagcccagaauguuuuguaaaguaaucuuguucuuauuaacuucauauugucucucaacaggagaaguaaaaaaauucacauuuucaaugaucuauuacuuccucaagauaauaaaaaguaaauugaagauauaaaaaauguggcccauaaauaucuuuuucccacccuggaauugucccuuccacaaaaagaggcagcucccauuuccauccuuccagaggcccucuuccacuaaaccugguguauuuagcuuuagauguguggcaaaaacuaaaacugcaccaugagacaagauagacacacagauagaauucacucugaaaacauggaauggugagaauuuagccaugaacuggauacgguucaucccuucacuuccuucgggucucugcuuauauaucaccuucuccaugcggugacacacacggacaacaacauccccaccucuucucucuaccugccuuacucugcuuuaucugcucuauuugcucauagugcccuuucccaccugacacgcuguauacguaugucucucucuccugccagaaggugacuugagaggugacaucugauucacugcaacaggccaguacuagaaaguaccccauacucaaguacagauguuccuccacuuacaacgggguuauauccugauaaacccauuguaggcugaaaauauacuaagucaaaaaugcauuuaauaggccaggugugguggcucacacuuguaaucccagcacuuugggaggccgaggcugguggaucacaaggucaggagaucgagaccauccuggcuaacacggugaaacccugucucuacuaaaaacacaaaaaauuggccaugugugguggcgggcgccuguagucccagcuacucaggaggcugaggcaggagaauggcgugaacccgggaggcagagcuugcagugggccgagauggcgccacugaacuccagccugggcgacagagcaagacucuguccccgccccccaaaaaaaaugcauuuaauagacguaaucuacugaacaucaaugcuuagccuagccuaccuuacacucagaauacuuacauuagccuacaguugggcaaaaacaccuaacgcaaagccuuuuuaauaacaguguugaauaucuaauguaaucuguugaauacagcacugaaguacgguuucuacugaacguguaucacuuuugcaccaccauaaaaucaaaaaauuguucagucaaaccaucauaaguuaggggccaucucugcuuggugaaagaacuauuccagcuguccauccauccacccaccuacccuuucacguuccaucuacccacccuuuaguaaaagcuaaugaugagugaggcaccaugaugaccauuuuauaaaugggugaagagaacagacacaguauuugcucuuggagggauagcuagccggcagcuguguguacaaaaaaauacaaagcuauguuucagauaagugccaagggugcugugagaaaggaaaaaggaggaaccuguguaugauuagggaaucagggaugugcagagcacacaggacgugggcaggugcaguggacggagcuuggugguugugacugagggacaaaguggugugaaagacaacaagggucaggccacaccugccagcaaccacugcuuugugugcaugguaggucacaggcaguaacuuggaagugaauucaucagugacaugcaaguauuaacuuuauuuacaagauuuauagaagggaugaacaaacuuaaaauguuugccccuacacugauuauaaaagaguacuaaaaucaauuaugaaaauguggguuuaaauuccuauuuguucugcaucagugaagaugcuucuugagugucugagaaaaaucuugguaugaggaguaaacauagcuaacacauuuugggugacagaauaccacgcacgcgccuuaacacuguuguucugaaugacauuucugaccagagaguggugucaacauucacauucaggagaaugauuuaauguguauuguccuaaaaacaaauccuuaaaagauuggauuaucuuuuuuuccuagaguaaaauaucuccuaagacguuuguuuccugggauuaauuuucuccuaaaauuauaguaugugcaacacuuuugauuaaaugaggcucucuuuauugaacuagaaacucuuugaagggaggcauuaucucuggacuuccagcacuaggaucagugccuggcccacaggagaucccucaaauauguuggaugagaugaaagggucccaguagucaagauuuugcugagucuggauuagcacaaaccccacucucaauauagugucggccacaugcuagcugugagauuacaggugaugggauggacuuuuugggaaauuaaaugaaaucaugacuuacaaagaguacccaucccagagccugggacuuggcagucaaugaauuaguggcagagauuacuguuuuguauucaagaagaaccaugauuguucaugcagcuuuuacacuaccaccuuaacugccuucuaucagaaucuuaccuuggcauaaaaccacuaacccagugacacauuuuguggucaaacagccccacagagugacugcagagcgucucuggucaagagccaacacacaagauggccaccaacaaggcaaggucagugguguguggguggaagaauugccacugacuucccaccaagguggacucaguaccaaugggcaaaucacaggcucuguucuugagccacgugugcucauuucucaucauggccacuggcccuagccccugcagacaggguacaggagcccaacaagagggaguuaauagccccagcuaacagguaccuucacuuggaacuuugucagcaauaaagguaugcugugaauuacagaauggacugccaaucuguucuuggugacagggcucugaagaaagcauccaaguggauggcaguccuuaucaaugaauuauccaucuccaggauccaacuaaagugguaacauucaauuuuuccaucaaguccacuguuuuaaagaagcacagguguggagaaaacugcuugagcagcuagaauaaagaauauggaggcugggugcagcggcucacgccuguaaucccaacacuuugggaggccaaggcagguagaucacuugaggucaggaguucgaaaccagccuggccuacauggugaaaccccuucucuacuaaaaaaaaauacaaaaauuagcaggcuuguaauccaagcuacuugggaggcugaggugggaggaucgcuugaaccugggaggcagaggcugcagcgagccaagauuacaccacuguacuccagacuggguaacagagacucuguauugaaaaaaaaaaaaaaacaaugugggcugacaagcauuucugcuugcugccccggaagucuucuaugaacaggccgggaguguagaugcacacaacaaucuaucugcacaugaguccaucauuucaagauacaggcuuuaguugacaauuggccauacagaaguaugguauugcuacagccggaagacaaaggcuuuuaauauacaguucacucacgaccuucaacucuaggccugcucagcacugagagagaaaaugcaacguaaauuaugcugcaagagggcuuuauuuuucuuuuaaaaaauaucuuuauucuuuuucaaguuccaaaagcaauauacauuuauuauuuuaaaacaacuugaaacuaaaauuguauuauuuuaaaacaacuugaaacuagaauuucaauuuagaaaauaaaaauucuaaccagaaaaaauucuaacuaauccuccuaauucuccuaaucucauuccacuucuagguaguuuucccuuuucuaucucuaaauauguuguuuaaaauaugaaacgcuucacaaaugugugcaucauucuugcacaggagccaugcuacucuucucuguacuguuccaauuuuaguuuaugugcugucaaagagagccccagguaguuuucuguguauagacuaaagaaaaaaaacaaacaaaacuaaguaauaccuucuacaaguauuuucucugcuuauuaaaaaaaaaaauuuaaaugagguauaauuucugcccauuggauuaauuuaaauuuuuaaaaaguuggcaaggguaucacucccauacuauucauuacaguguaauuucacaaagccuuuuuuuggaugguauuuuggcagaauuuauuaaaauuuaaaaugcuagcugggcguggugcacgugccuacaguuccaacuacuugguaggcugaagugggagguuugcuuaagcccaggaguucaaguccagccugggcaacauaguaagaccccgccucuacaaaauaaaauaaaauaaaaugcacaaauacuaucagacccaguaaaucuacuacuagcaaucuaugcuggagaaagacuaguuugggcacacaaagguguguucaaguauguucuuuuuuucuucuuaacaugccuaccaacaugggaaugcuuacaagguacaucucuacuauggaauaccacacaguggcuaauuagaaugagguaagcgcguauguacugacaucgaaaggucucugagauacccuauuaaguggggggggggggggaagcaaguuaucaaauagaaauaacagaauccucuuuguguuaaaaaauccacaaaauaauacauaguaguuguauauguauauauucaaaccagccaggaagaacacacaccaaauagcagugagugaaguggagcuaggcagagaggggaaaagaaaaucaaggaagaauuucauuuuacuuguacuguuugauuuuuuuuaccuccauuagcaagcaucucuuuauuaaauauaaaaagaauaaugaaauaaaucuuucauucaguugauauauuugaguguggcaugagguagggaucuaacucccccuuccaaaccgccccucccuguauaguuugagucguuuaggagauuucccuugcguucuuuucaucuauuaucacaucauuaucacuugcuguggcuuuuauaggaugcuucaacaucguuuucaauacuguuaaagguaucuuuuaaguuuuuuaaacuucuuuuuaaucuauuuagaauuuauuuucuucccuucuucccuuccuuccuuuucuuucuuucuuuccuuuuuuuuucuuuuuucuuuuuuugagauagggucucacucugucacccaggcuggagugcaguggugugaacauggcucacugcagccucgaccuccugggcucaagugauccucccaccucagccuccugaguagcugugacuacaggcacacaccaccacgccuggcuaauuuaaaauuuuuuuuuguagagacagggucuugcuauguugcucaggcuggucuugaacuccuggccuuaagugauccuuccaucuuggccucccaaagugcuggaauuacaggcgugagccaccaugucugauuggaauauauuuucuucuaugguauacauuuuccauuuagcugagucugauguauccauaaucugaacaugcauuucaacuaaucuugguuaucuaccaaagaauuaagaucuuuaaaaauaugacagugaguuuggcaacucaccugugacagagccaugcaauguucuggucauguucugguguuaagauacacauaauaccucagaaauaaguuauagcuucccaauguuagaaaugcuauuaaaauugacugaacagagaaacuauggagaauacacuuuaaccuuucauaagaguuaggagguacugggcgggcgcgguggcucaugccuguaaucccaguacuuugagaggccaaggcgggcggaucacgaggucaggagaucaagaccauccuggcuaacauggugaaaccccgucucuaccaaaaaaauacaaaaaauuagccgggcgugguggcgggugccuguagucccagcuacuugggaggcugaggcaggagaauggcgugaacccaggagguggagcuugcagugagccuagauggcaccacugcacuccagccugggcgaaagagcgagacucugucucaaaaaaaaagaaaaagaguucggagguacuuuagguucaaauaggccuuuagagucaguguuuaucucucaauugaaccucacaguaccuuacgugccucaccauuacaauaagggacuagagcucccaagccccguggccugcucuaauauucuaauaugaucaacuuaucuugcacagaaugaagcuguacuccuaccuuuuuggagugauaaaaucugccuaacacuguauguaaaaauuaacucagaauugaucaaagaccucuaagaacugaaauuauaaauaucuuagaauaaauuaaagacauauuuuuuaugaccuaggacuaggcagugguugcuuagauaugacaccuaaagcacaaaugauaacagaaaauauagcuaaauuagacuucaucaaaauuaaaaacuuuugugcuucaaagaauacuacaaagaaagugaaaagacaacccacagaaugagagaaaauauuugcaaauaauguauuuaauaaggaucuaguacccagaauacauaaagaaagagcucuugcaacucaacaauaaaaagacaaauaacucaauuuuaaaaggucaaaagagcccgggcaugguggcucaugccuguaaucccagcacuuugggggguccaaggcaggcagaucacuugaggucaggauuagagaccagccuggccaacacggugaaaccccaucucuacuaaaaauacaaaacauuaacugggcauggugacaugugccuguagucccagcuacucagaaggcuaaggcaggagaaucacuugaauuugcaagguggagguuacagugagcugagaucgcaccacugcacuucagccugggugacagugagacuccaucucaaaaaaauaaaauaaaauaaauaaauaaauaaauaaauaaauaaaaagucaaaagacuugaauagacauuucuccagagaagacuuaacaauggccaauaaauacauuaaaggguacccaacuucauuagccaucaggaaaagguaaaccaaacuacaaugacauaccacuucacauccauuaggauagcuauagucaaaaggacagaaaauaaugccaaguguugaugaggauguagagaaaccggaacccucauacacugcugauggcaauguaaaaugguguagccauuuuggaaaacaggcuggcggcuccucaaaugguuaaacauaaagugaccacgcaacccagcaauuccacuccuagauauacaguugacccuugaacaaaacagguuugaacuuuguagauccacuuacaugugaauuuauuucaauaaauauauuggaacauuuuuuggagauuugugacaauuuggaaaaacuuguaaacuauguagccuagaaaugcugaaaaaauuaagaaaaagguaugucaugaaugcaucaaaucuacguagauacuagucuauuuuaucauuuacuaccacaaauauccauaaaucuaucauaaaacauuaaaauuuaucaaaacuuuugcacacacagacuguacauggcaccauuuauagucagagaaauguaaacaaacauaaagaugcaauauaaucacugcauaaaauuaaauacagugcauacuguaugacuguaauaauuuuuuuguuuuuguuuuuguuuucuugagacgaagucucucucuguagcccaggcuagagugcaguagugugaucuuggcucacugcaaccuccgccucccagguucaagcgaauucuugugccucggccuccugaguagcuggaauuacaggcgcacaccacugcaccagcuaauuuuuuauauuuuuuaguagagacaggguuucaccauguuggccaggcuagacuugaacucccgaccucagguaauccacccaccucggccucccaaaaugcuaggauuacagacgugagccaccgugccuggccacuauuguaauaauuucacagccaccuccuguugcuauugccgugaacucaagugucgcagguaacucaagugucgcagguaacucaagugucgcagguauccaacagcuagaugcuagugaucucuaugugagcugcucaucucuccaguaaacugcuuauuccaguaaaaagugaucucuugcgguucucauguaguuuucaucguguuuagugcaauaccauaaacccugaauaauaccaugagccccauaugaagugccacuagugaugcugaaagugcucccaagaaaagagaagagucaugacauuacaggaaaaaguugaauugcuugauauguaccagaaauugaggucugcagcuguguaguugccugucauuucagacaaacaauuccucuuguagacagacaauguaaacuuaugguauuaauacaguauuuucucuuccuuaugguuuucauaauaacauuuccuuuucuuuagcuuacuuuauuguaagaauacaguauauaauacauauagccuacaaaauaaguuguuaaucgagaguaggcuauuaguaguuaaguuuuguggagccaaaaguuauacauggauuuucgacugcaugagggguuggcguccuaaccccugcauaguucaaaggucaacuguauacccaauauaacugaaaccauauguccuuacaaaaaccuguacaagaaugcucacagcagcacuguccacaauagccaaaaaguggaaacaaccccaacguccaccaauggaugaaucgacaaacaaaaugugggauauccacacgaugggauauuauccaaaaauaaaauggaaugaaguacagauacacgcuacaauauaggugaacccugaaagcauuagacuaagugaaaaaagcuggacauaaaaggccacauguuguaugacuccaucugacgaaaugccuagaaugggcaacuccauggagacagaaaguagaggagugguugucaggagauaaaggagagugacugcuaacagcuaaggguuuuuucuggaauuagagaguggugaugguugcacaacuccgugaguauacuaaagccacugaacugcauacuuuaauaagaggaugaauuucaugguaugugauuuauaucucaauaaaauaaauaaauaagauauauuuuucagcuauuagagaaauaaaaaaauuaucuuguauaauauuucuggaaauaaaucugaaucuuuauauccaacuggcauaccccaacaaugacucccaacccuggcagcccauuagaaucacucggggagcuuuuaaagacauacagacgcuuggaccuccuuccuagagauuaugauuuaauuggucugggguggaguuuggggacugguguuuucaaaagcuccccaguugacucuaaugugcagccugaguugagaaccacugcccuagaauuugagcuuuuaaaagagucccugguguugguuuagauaucuguuauuuuauccuuucucauaaacaugagacaaacaaaauuuuaaauggcucacgguuucuggcuguuagaacucaguagaacugggauuuuauuuuauugucucuuccacauuuuuuuuaagaucagcagauugccauuuuauagacagagaaucuuaaaugcaaaauggcuaagagacauacugagaucaccauugugagcugggcagggacugaauuacaguuucuuccuugggaaggaaacugaguucuuuuucuaguuacuccagccugaaccaucauggacauuagggacacccucucagcacaggugguaggacaggcagcaucuuggcacuggcagagacagaaagccuggguggagccucacagucugggaaaacuauaaacucucaaguccaccuucagauuugaugaaauggagccuccuccuacccccacaaaaaaccuuuuuucuuuacagggcugggaagaugagguuuacaucaccuacuuaucucugggaagccaucccaaagugcucacuuauuuagaucacuacuggucucauuuucuuuuuucuuuuuauuuuggagaaagggucucauucugucacccaggcuagaguguagugucacaaacacagcuuacugcagccucaaccucuugggcucaugcgaucuuccugccacagccuccagaguagcuaggaccacaggcgugugccaccacacccagcuaauuuuuuguagagacgggaucucacuuuguugcccaggcuugucucaaaccccugggcucauuuuuauuacuuuccccaaagcugccgaaguuggucaguugggucugcauuaggcuccccauucauucuggagccccaaagccacuucuaaauggcaaagucauggccagcgagggcugcucauuuguuuagcuuugggagucugucugggccugaaaccagccccugccuguggaaaaugcucagaacagaggacacuccaggccucugagaccagaagugagggagccacggacaccucucccugagcuccggcucugcacccccuucccuacuugccagcucaaggagugcacaugagauggugguguuugggcucuaauuguguugaguaauugcucaaugauuuucuauguaguucccuggcuccccuaucccacuuucucacucagcuguuuuauaaacugaauucuaaucuggguuucuucacaaugucgccuuuuacuaaaagcuaauaaaaccccaaaugggaaauucagaagucgcagcaauaccacaugacuguaacugaagguuguuggucaacuugauuugguuuucaagcuuguagaccaucugaggacuucagucucccacccaacuuuguagcaauaaaggucuuugucuucccuugcacugaacgugaguccugaaccuuucugaggaguccugcagacagccucacauggcccagacagcccacuggaccccuccucugccaccucuacuuccucacucaggcacccaacacugcucacugaaguaaguuaccccuaugaggccacaggcagacucucuucuagaacccugcuuugcaccugccaccuggccagcugagcccaacccuggccacucugcacaaccaggaggcugcucaaacucucagcagaggaaacauuuucaguaacgagcaaaaucucaaaucuccaacacaaaaaucagaugaaucuguaagaagaacaaagguguuuugcugcauccuaaaaggcagggugacgauugacaguugucuuauaucagccacaucagcuaauauuuuauuuuugaauuuuguuuugauugcagagaaccaaaaaaaaaucuuaauuuccacagauaagugguagcaaaugcuaauuaauggacuuuuaguagacugccuuuugauccuaggauagccuuuagucgcaucaguguuuguugguguuucuuucaucacugucccacaaggagccuuagcagacauucugccuauuugugccaccccacucccgaaauauauauauauuuuuugagacagaguuucgcucuuguugcccaggcuagagugcaguggugcacuguaaccucugccucccggguucaagcgauucuccugccucagccucccaaauagcugggauuacaggcguuugccaccgcaccuggcuaauuuuuguauuuuuaguacagacuggguuucaccgugucggccaggcuggucucgaacuccugaccucaggugaucuaccuuccucggcccugcaaagugcucggauuaauacauauuaauacauauacaaucacauacuguuuuaguaacacaaaggaaaaagaagaggaggacuuacuuaggcugggggugguaaguggaaacuguccaagugagaagugagguaacaccaaccuaggcagagaaaccugcacgcaaggcccugaaaccguggaguuuggauggccugcggcagguugguguggcuggggagugccgggggcugaggaagaggcuugcuccuccuccccauccaggcaagcagcagcagucacugcagucaggggaagggguugggcagugggaaugccucacuuacugggugacauaaagcaaggcaggaaugcuuucucaggcuugguuucccauguauaaauucagaaaaacaucaccuacccaauauagaggugauuauuaaaugcacuauccucuagaagcugugguuauuaaccuugacuacacauuggaaucaccuggaaccuuauaaaguccgggcugggugugguggcuugcaccuguaaucccagcacuuuaggaggucaaggugggagcaucacuuggggucaaacguuuaauaccagccugggcaacauagugagacccugucucuuaaaaaaaaaaaaaauaguccugauggcugggaccuaccaccaggcccggccuggacauuccaaaucauccaagcuccccagguaauuccaaugugcugcugggcugagaaucacugcugcacagcaccuggcacagguaaaugugcagaauaacaugugcugggugcaguggccugcgccuauaguccuagcuacucaggauguugaggugggaggaucccuugagcccaggaguuugaguccagccuaagcaauauagcgaaguuugucuuuaagagaagaagaaugacaucguuuaugugggcacaaaaggcucaaaugaaucauaaacuauucagggauacacuugccccuggcaucugaacuccugucccgaguuuaggaaucccugcuucucguaugaguccuggcaggacgcaggguucaccucccacucuggaagcuggaaaugccagcaacaucaacagcacaguguccucaccacucugguuuugugacuauugugggugcagacugggcugcugccuggucuccaugguuugaguccacagccaucccagcaagacugggaaccaccccaauguccuuuaaagaaauccuuuuucugaucucagucagcugauaccuacugcucaaaacuaagaaugcuacugauaaaaauauucagaguaggacucuuuuuaugguuuuuaagaaagaaaauagggccagguaugguggcucacaccuguaaucccagcacuuugggaggccgaggcaggaggauggcuugagcccaggauuaugagaccagucugggcaacauggcgagaccccaucucuacaaaaaauacaaaaauuggccgggggugguggcgugccccucuagucccagcuacucgggaggcugcagugagaggaucuccugagccugggagguugaggcugcagugagccaugaucccaucacugcacucuagcuugggcaacagagugagacccugucucaaaaaaagaaagaaggaaaaaaagaaaggaaagcaaaaaagcaagcaaaaagcaagcaagcaagaaaaucggucuucauauguaaugagaucuuauuuauugauuuauuuuugagacagugucuccucgcucugucacccagcaugaagugcaguggcacaaucacaacucacugcacccuugaccuuuugggcuccagugauccucuugccucagccucccaaaguguugcaauuacaggcauaagccaccacgucccaugcacguuaacauuucuugagcacugacugugccaggugcugguucuuuucaccuaccaacucauucagucuccaugacaacccuauuaggucuagacuguuauuauccugacuuuacagaugagaaaauguaggcagagaaaaggguagguaacuugcucaagguuacaagguuuguagguaguggagguaguuggugaacccagaugaucuugcuucaaagcccacagucccagccacuacgccauagggcaaaugcugcgaaaaaggacuguagggagacgaacuguccacaccuguuaccucgggggugggacugggggguggagcugaaagaggccucugauguauuccuucuguuugcuuugaaccuuuugcaauaaggacuacucauguauuauuuucacacaaagcaguauuuuuguggugauuaaacuugaaccagugugccugcgaacuaaaagcuugcaacagagacuccacagcagcugcugccaccauccaagaacuugagggggauucugcucugaaucucaugccagggguuuccuccugauucuucugugagaacccacuccuggaguguuuacugugauauggcacacacugcugguugcuguaaucacaccagcuauuuacccugggcucaagggcaccugggggcacacaauucuagacucaaguuuggcuggcuuaguugcaggauccccaucauccucagaagaugcccugaccaugcuuuggguuucccugcccaucuacccugccuacuuuuccuacaauuuucauucuccaagguccaaauucauauuucuccuggcagacuugguuucuccucuucucuuggcucauuaucagccugauucuccugccucagccucccaaguagcugggauuacaggcgugcgccaccacacccggcuaauuuuuguauuuuuaguagagaugggguuuugccauguugaccaggcuggucucgaacuccuggccucaaguaauccacccgccuuggccuccccaaagugcugggauuacaggugugagccaccacuccugaauucuguaauuccaacuuggcaaugccuuagagucugcccacaucauuucccgaagguaaucccuccuguuucggugggaaggugcucuguuugggggacuuuucuuauucaguuuauuccccccuucuccucucuucauucacaugucuucagccauccacucccagggggucaccuuccaggguucugccccaccccucuccaucccauagccccucucccaucuuuucacacuaacccuccuaccaccucagccacaggagggccuuuuuuuuuuuaaacuuuuaaauacuaaaauaauuucagacuuauacaaaaguugcaagaauaguaaaaugaacuuccacauaccacucaccuacauaccccaaauguuaacauuuaacuacacuuacuuuaucucucucucuauaugcauuuuuccccaaaccauuuuagaguaagaugcacacaugauguccccuuuugucuaaauacuucuguauuucccaaaaaagacauuuucuuacaauaccaguuuaccuagucauaaaauugccaucuuauuuauuuuaauugcuuuuuauuuuuuaaggcuagucaaguggagcagugguagaggagaaggaacaaagaacagaaaacuaccgcugguagaauacuaucacucaauccacagacuuuauucaaaugcugccagcuguccugauaaugcccucuauuuauuuacuuauuuauuuuuaaauauagacaugaggucucgcuuuguugccuaggcuggucuugaacuccuggguucaagcaauccugccaccuuggccucccaaagugcuaagauuacaggcaugagccacugcacccggcccuaauaaugcccuuuagagcaagaaaaaagaaagaaaaaugcaugaucaguaucccacccagacuaaauaucacuuaguuuaaacuugccagcuuugagaccugccugagacuuuggcuccucagcuguggaaagagccauggauggggaacuguuacugucuacgcagauuggacaagucacuuggcccucugugcucuacucgccaucacccacgagaauaaaaggacagggaagccaugggcauuuuagccugagugcucuacauaaauaucaagcacagcaaagguggucagucagcggaguuacaacuaacaaagcaaccuuuggcuucucccagguaucgauacaauucauucaaaugaaaaaauaagaacuuaauuuuauugagugauuacccaguuagauaagacagagcgggcacaguggcuuaugccuguaauccuggugcuuuaugaggcugaggugggaggauugcuugaggccaugaguucaagaccagccugggcaacaaaaacuugguagagaaacaaaaauuucucuacaaaaaauuuaaaaaaaauuagccaaggaugguagugcaugccuguaucccacuuacucgggaggcugaggcaggaggaucacuugagcccaggaguucaagguugcaaugagcugugaucacaccacugcacuucagugcagugcacuuaaaaaaaaaaaaaaaaagauuaguuaggccaggugccacggcucacacguguaaucccagcacucugggaggccgaggcagauggaucaccugaggccaggaguucgagaccagccugaacaacaugcugaaaaccccaucucuacuaaaaauacaaaaaucaguugggcauacaugccuguaaucucaacuacccaggaggcugacgcaugagaaucgcuugaauccgggaggcggagguugcagugagccaacaucacaccacugccugggcaacagaucgggacucugucucaaaaaaauaaauaaaaaaaaaauaaaauuagagcucuacauguuucacauguaucaucucauuuaauacauacuguuuucacugcuagcuccauuuugcagaugacuagacugaguuugggggagaggggcgguagcugacugauuugcucaagcucuuuccaaugcuuaaauucaggauuagaaaugaggaggauagaaaacauguagucauuugcaagaugacauaucuucauuagggugaaauaggguagaaggaagcagaccucugaauggagaccacugccccucagcuaacuguggcugcaccugccaucaggcacagggcuacauagcuggaacacccagcccuaugcagcacagaguccccuugucagaggacaaauggauucugggaccauagugaaaacaaaagugcacuaaguuccaugcugcaaaaugacuucucuuggugaccuggaguuaaauuuuuguccccucccuaugaaaagcuuuauccuagggacuugaagaugaaguuucuucccuuuguaggaaguuggucacauccaaugaggaaauaaaauaaacuucuuuuuuuuuuuuuuuugagauggaguuucacucuuguugcccaggcuggagugcagugacaaaaucucagcucacugcaaccucugccuuccagcugcaagcgauucuccugccucagccuuccgaguagcugggauuacaggcaccugccaccacacccaccuaaucuuuguauuuuuaguagagacagaguuucaccacguugaucaggcuggucucgaacuccugaccucgugaucugcccuccucagccuccgaaagugcugggauuacaggcaugagucacgugccaaggaaaucaacuucuaaaugcacuaaacagaguaguacagagcacacagcaugcaaauacuaacuaacccuaugagaggugccaucccacuucuauaccauugcauagugcagggagcugaggccaggcaggguuuggugaucuggccugggcuggcaccagaucagggucugugagaugucacauagcaccugugccuaacagaagaagcuggcgggaccagaggguuugaaaccaaugucauguuaagugguucuacaucccucccuuagccauggggcaaccuaacuccuuccuugggaggaaggccaugcaguggguuugugaucaccuccccaggguaugugacaaguaggaaagcuuuucccuaucuguccucagcacugauaccaccacucggcacuggcagcuuggcaaguguuucuauauugugugcugcguuucuccaaauaaguuauaaggcucuuaaagacuaguagagguauuuuuccuuuucuuccuucuuucuuaacacuuaaaauugaaggagaaauuauaaagauaacucaguucacugcaccagagucauuaaugcuggcagcagcccucgccucaguugcuaagagccuaagcccccguuuccacugaagcucugccacucaccuugggaagccacuuaauauuucugagccucagguauugcguccauaaaugggaauaauaaccuuuccuaccuuaaaaugccugcagcacuuaccacucauacguggguguauauaacaacagaacagcuuaagucagugaaguauuauguacaaagcucuuaguccaguaaguucccaauaaauagaagauucuacuaucucuuuggcuacuacugugacugcugcugcugugauccuuaaacacaauuuuguaaaacuaagaaacacaaaggcuccuuagcaucuuggccugugcuuuucauucccccauguuccuaggucagucaucaggugccagagguucccaggguguuggcugccauaugguaaguguccaugaaguccauucucccaucuccacaucuaccaccaacugguuccaagucagcaccagguccugcccuuuccugcaaaccagccacccaagacuggccucugcagaggccuauggugcuccuuacucagccucucaaauuccaaaugcagaucccuggccaucagcacucuguucuacggcaacuucccaccuugaaaauguccuucgucccuccaagaucucaaagucuacucuccuugaccuaagaggugagcccagucuuuucaguaaggugaucacaccccaagaggcaaaauauucuguggccucuucaaaggacaguaaaguacaucagugugccuggggcuauaugaaaggagcagcaauguaguucacuccuucaacaaggacuuacugagugccucagguaugugggacuauaaagauaaagaagacaaggucucuacccuuaagcaggggcuccaagagguguacacaaagauaaaagcugaaggucaggaccaaagauaagcccuagcagcccugaacuugcucauucccagcucacugcaagguauucccaccccucccuuccagaggcuccaagugcacagaaugaaugaaccccaaguggcuguccagugucauuccucugggcucacucccgggcccugggcuucuccaaacaauuggaggcaggccgagugggcgcauucucaugugcaaggcucgcagcgccccucucagcugauuguguccaggcggccggggucucggaggcgcaugaaugccccugaaugggcccuuucagccugauggacaggagcugaaagcugcacacacacaaaagccacugggcagcugggagggcuccagccccgggguuugcccacgggaagggaggccguccuuccacaaagagcagugugaagacuucuccacuuuucaauggcauccucuggccgccaacuguacagcaccccuacccccaccccugauggugguaacagcagcagaggauggcacuacauggagaagccuuagagggcuagaggcagaaauuaaaauccaacaaauaaauaacagaaugcccuuuucuuuaagagcaggauggggaucugagccaaaggcccugaagggcgccuccaugugcccaucauguacaucuguaagcagcauuccugacacccacagugaucuuuaaggacacagacugaccugagauugucuaacaugucaccaagaaaaaugaucucgaaaggacacggccaauauuuaaaucaggaauggagagucccaauucuugugucacucacuugguauauuccaggaaaaaaaaaauccccgaagcgacacuuguauuuuuaaauaggaccaggaaggggagaaucacccaucuggaauucuuuuaauugcuucggggggaagggcagccuccaccaguuggaggagcagagaagucuauuuacacuguugcacacaaauauuuuaaguucacagucagguggcuacuuuggaagggacgaugcucugcuucugagaucacauuacuuuagaaacacccccccaaaaagauaauuaaagauaguuccuccucauaaugcaauacuauaaggagcaauuaaaauuaaauuagcuugucauaauaaaaaagauggauuauguucuuaggcuucccaacccggaguuaguaauucauggagagaagccugugaccaaguagcaguuuuacuaaggaaauauuaaacauucagaccacuuuugugaguggaccaagauaccagggagauacauacccuggcauaauuauugcuuuuguuuacauuuauuuuauuuuuuaaauaauggaaugauucaaacacauaauaaaggacagggaaaaacacaacaaauaaaauccaucauccuaaauucacaaauguuaacauuuuguuauguuugcuucaagaccagguuuuucuaaacaaauaaaauguuaugaaaucagaugaagccuccuuuugcagaggcaacuguauguccauauuuuuacagguuugccauucuugaugugacauaaacagaauguaauauuguuuuaacuuuuuauuucaaaaugauuauagauucauaggaaguuggaaaaaaaguguacagggagguuccaagcaucuagccuagccucccccgauguuaacgucuugcauagcuaacuagcaugcuaucaaaacuaggauauugagauuggcacacuccacagaacuuucucagauuucaccaguuuuacaaacacucguguguguguguguauguguagcccuauguaauuuugucacauguguagcuuuguguaacaaccacaaucaaaauacuaaacuguaccauuaccaccagauucucucaugcuaccccuuuugagcaacaccuaucccuuauuccccucaucccuagcaccuggcaaccacucaucuguucccccucgcuauaauuuugucauuucacgaauguuauauaaauggcaaaugcaguauauaaccuuuggagacugacuuuuucguucagcaucauuuccuugaggcucgccuauauuguugcaugugaucaauaauuuuuucuuuuuuauugcuguauuccaugguauagauauaccacaguuuggucaaccauacaccacugaagaacaucuggauaguuuccagauugaggcuauuuugaaugaagguguuaugaacauucacauguauaaguuuccuugugaacauaagagaaaggcccuagaagagccaaaacuauuuugaaaaagaauaaaggaaucucucuucccaguguuaaggcuuacuauauagcuccaguaacugugacagcauggucuugguagagggcuagacauggagaucaauggaacacaauagagaacacaaauugcccacuugcuuuuuuacaaagguguaaaaacaauucaauggugagagguaguccuuucaacaaagugugcuacagcaaguggacaucuacaggagggggaaaaaaaucaaccucaaccuaaacauuacaccuuauaugaaaaguaacucaaaauggaucuuaaauguaagacuuaagacuucaauguaaaacacaaaacuauacaacuuuuagcaagaaacacagggcacaugaggacaucugaguucuauaauucuggguacaccaggaagagucucuuuccuuaacaucuccccaucuagucugucccagaugacugaaauuccgcuauuagacagucauaccuuuggcuuaaaggcucauccagaaaauucuucugggagagauaagaaaugagagcuuugaaucuuggggugaaucagaguaucaggucuucuuuagcugacagcugagaggaggaucuaaaaggaagugaaaugaaaagggcacuuggagaaugaaugagggugggagggguaagaggaaaaagaugacguucugacaaguuccaccuacuugacaacaauaaggucaguucuuccaaaauguguaucuggugcugcaucuuagucagggcugggggcaggggacggaguauguucaccaaacuacacucagccaacaugugcagacauuuauacaugguauccaccaacucacaugcaaagaaaaggaguguauauacaugucaaaggguggcaguucguuguuguuuaccuuuccucauuaguacaguacaaaucuagcugagaacaaagaauuuauauuccaaacaggauaaaaguaugaaaaaugucuuuauuaccuaccuaguauuuuccuuccuccguuuaugacuucuuuuacauacacguuuuauggaauuauucaggcaaaugccuucuuugggacuccuaacucugugugcagcaugguugaagaaugggauauuccuguuacagauacaucaggcacaucaccaacucccaacgaaucaaauccaauugaaugcuuuuaacccuaaaauuuucaggaaacaaauuuaucaucuuugcuaaauuagaagacacaaugggagccauaugguaauggugaccauauuucccaaauuauaaauuuauggcauagaaccugaggaaugcucaucauggaaacaacaggagugaaaauuuaaaugcaagcagugugggcccauaugcucuauggcuaccauggcugccugucccauucaagugggauguguucagaggaagcgcugacucuggauggcgcccccucauggaaaggaggagccacugcagcucagagaaccuuuagcuuuuccauguuacuuugaucgggcucuaaaauaaaguccccugcggccgggcgcgguggcucacgcuuguaaucccagcacucugggaggccgaggcaggcggaucacgaggucaggagauugagaccauccuggcuaacacgaugaaaccccgucucuacuaaaaaauacaaaaaacuagccaggcgugguggcaggcaccuguagucccagcuacucgggaggcugaggcaggagaacggagugaaccugggaggcagagcuugcagugagccgagauugcaccacugcacuccagccuaggcgacagagcgagacuccgucucaaaaaaaaaaaaaaaaaaaaaaaauccccuguguugucuccugacugggagguaaacucguaucuccuggcaggcugcuccgaggaucuaagucucaaguuaaaugaggcagcagugcauacaaacagacuaggaggccuccaccaacauggggcuacccgcacagugagggcccucccaguucugaccaccuuccucucuaucagcccaucacaaaaacccgccacaggcgugagcugccacuuccuaagauguccuaaccccaagccagggacugccacaaccucagcagaguguggugugucaggcugagacacauccucucucuccaaugcagccuccccagaaaacccacaagcagagauagacaggacaacccucucuggagcugggccacauaaacaagcgagcuuccaugaggagcucuggcugcccugugguucagugugagacuaucggcuggcuccugcuugagacuggcucuaccugugugaccccagacagcucauuuaaccucucucuucucugugccucccauuuccucuucuguaagacgugauguugcugagugugguggcacuugcuuguagucccagcuaaugggguggcugaggcagggggaucgcuuuagccuaggaguuugaggcuacagugagcuacgauagcaccacugcacuccagccugggugacagagcaacacaccaucucuuaaaaaaaaaaaugcugugaugcagauucaugaguucaaacgcuggccuggcacagaguagacccucaauacaggcugguuauuacgucacuuaucauuacuagggcacacucuccugaagcuaauuucucaggcgucgcuaaguccuugcccagguagucacuuuccuaagaaacaugaaauucuucaucuggggcuauaaaagaucuugaaugguggaagagaacaagcucuagauguggagucagagaacuaagacacagguagaaccugucacugaacuuugcugugacacccugggccaggcccuugacucucugagcuuguuucagucagaaacaaaacagauuggcugcuaagagucuuugccuuguaagggugcugugaggaucagaagggaucacucaugugacagcccagcccgccuggccaaacugaacagcaaagaccuagcccagguagaagagaggggagcacagccguuaguuucccuagccuugucccgccccuauaccaagggcagggaacaucagcagggccaccucagucuaagcacagcagcauccccugagagaggguccaagugcugcagccuuguccuuacacaccaugaagaugggccaagaaaaggguagguugaugagaucaucuucugcggagcucuccaggugaggaaucuggccuuccaccugcaugcuccaagggcuggggcugcaaagagacuucauaaucaccagcaucaucuagacaccagaaccaccaaggacuauagaccuauuuccugaaagcuggcucuuaaauuugcuccuuguccgcucauucuccuccaauacccaaucugaaacugcuuccggguuaccuuccccacggaaggucccacaaucuucaggcggacuccacuuucccgaacacugccucuccccugccagccccagcucugauaccaggccugguuccgccuuucuuccccgccucacugcccaucugcugacugcagcguccucuccuccugcucacccaaauccuaccuggccuuuagagcuuggcuaaaggcucgcuccauggaaaaugcccuuccagauuucuaacccacauggacaccuccuuuucuucccaaagucauuuccuuaacaugaaaucugccaaacugugugaacaguucuggugccuacauaccccaagacaaaaaacaaccucacuccacugagaagaggagagaacuuaggccuagcuuuccuuccuggaaugacaccuuguaucaccucucuucccacaaccacgacccaacuuuacaaagauuucaauggcugaaaugccccuugacuuucccucuucuccaggcagaggccucccagacccuugcuaucaucuguuugucuaaguccuggugaaacugcagcuccuagaacuaagccugaagcuccagaaguggguugagcaguacagaguugcuggagccauuccguauccugagcugggcucuguaaugccaccucuggcuaauacacuugcagucugcacuaaguccucacuuacuuuauuuggguugcuuuugccucuccaaacagccuggagucauguucucuuacauccuccagaaugcucggcacagacauaaacuugcugacucgcccgaugauuuuccccaaaaucagggcugaacuauauaugacaugcuuauucaccauggcuaagauucugaauauaaaacaccuacugccuuauucaagccagcaggguuaugggcucugagagacaccaggcagcaaagacaccaagaaagacaugucaaaaucauggaaaugucagaagcaaaguccaucagguccaaugaugaucugacuacugucugacgcauucuucccuaggccuaggauauaaagcuuggacuagggacaccacgggccauccauccuaggaacccaaguccuaggugacuccccuuggugcuagcacaauaggacaaguuauacauuaguaaugaccuccauucaugaucugccuucuugaaaggcauguaugccuaugagucagugacacucuuggcugacuugcccauccauuugaaaugcauuuugauaucuaguauuucaggcagauaccagguuaaacccggcucugugcugccccuuuucacuguggcacagacaauaccauuugauuuuccuccugggugcacaaaaggacuacauuucucaggcuuccuuggagugaaguggggccauugugucugacuucugcucucucaccccuugaagcagaagcucuagugaggaaccacgaagcccuagagcggggauucucagugcgcucccuggaccagcagcaucggcauccucugagaacuuguuggcaaugcagauucucaggaccuuuccucuggagguggggacccagcaauguauuuucacaaguccucaggugauucugacacuccaagugggagccaccacucaggaagacagcagagcucuuagacagggagaucuggguuccugaaugaacaggcagugcugaugcagacuugcauuggaccgugauggggagagaaaucaacuuguauugugcuaagccauucgggguguuauuuugaaagugguuauucugucccugcugaagcaguaaucaucaccagcuucauguccagucuacucagagggccauuucccaccugggguuuucuagcaucaaaagcugguagcacaagcucucuggagugcagagaaccaggguuaucuuauccugccuggaacagccugaccgggaaccucucuacccacuucauucauuccuucacagucuggcugguaugcuacaaugggugaagaggaagucacagagggccaggaucagagagcagcugcuggcauuaauacauuccuucuacccucagcucccuggcaccccaggccagcacccaccugcuucucaguuaaaggugucugaagccugcaucuggccuuaacucacagagagugaguaucagggacucugccugcaggucccgcaggccagcagcuaugacugcagaacagaccgugccccagaucacgugccagaccucauggagaggcuuggauguccaucucccaucugacgaacaagcucaguuuugagggccucgucucucccugccaucuuugcuuuuccucuccaaccgaaaucccacuuaauuccuucaggcgccccguccauccugccuccuccccauguccaccagcugcucccuuuuccccuguccuuuggcaggaucugagacucccaguguggccuuagacaccacagggcccgccccauaagguuucaguuuuacgcaaaguucugcgucucccucccuauugaaacauggauccuguggcaggggcugcauucagcaugccuuguaccugccccuggccuuggcacugaacacaagacacuuguuaaacugacacccacucgaugcuugcuuaauggucaaugagugaggugccucaaagaggggcaacaccagacgagcgcccugggaacccucccugaggauacuacacaggugcaaaggaaccaauggucucagauuuaagaugcagacacacggaccagucaccuuagcuggggcaguuuggccccagaccuucuccuccaagcagaauuccucucccucuccuccagccagccuuuugcuccccugggaucauucaacuacaaaaaggaaugcuuccccugggcucugggagcugccugggguucccugugugugcugaacccucucccucucuccuggccaccacacagucacacacauaguucuuuuuuuccuccgggcuacuugcuuccuuuugcugcugcccccagcaggcgggcccaugcccagcagggaggcacacccguaccucugggagccuccuauauguccuucuacccuccaaagcagggccuuucccaggggcuguuuugaaggcuguaguuuacuaacuuacaccuagcuuuuggcuauaugccaaguuagacaaggaauacauucccucugugcuaccugccccucacaugcacacgcuggcuacucucauugggcagguccaucuauuuaccacuucuuccagcccucucucaggugcucccugcucuccgcaccucuuucucuuauaacucuccucccuaaucccccaaaaagaagccccaacucaggaggggucacagggcagcuggccucuuaggucuacgaaaccugaacccaccagccucccccuuuucuccuuccuucaggaacugcagaggagaaacaguugacugcuccagucagcagagccacucuggaugccaggggaaggccaccgucuguuaggggcccuuaggaaggcuggggcuaggaaucaugugcuucagaccugccagggaggaagcggucuagcuacuugcuauuugcuggcugugagaugcucggcacaucaugcaaccucccagcaccucagcuuccuuaccuauaaaugggacuagugacagguccuaaccuauguguuggggcugcuacagaugacacgagugaauaaauacagauacuuggaacgggcuccuggugcacaggaaacacuccagggucagcuguaacucuuaucgugguuguuauuuccucaauccucacuuuaggaagucacuagccucugaagaacgugaaaggcaaggagcagagaccaucaugagccaggugguguggaagauuccacugaggucuguaauguggauaacugagaagauucaccaggaugggaaccacaagaaaucugugugggguuggaaggcacauuugagggguaugauaaugugcgggguguagccgucaugaggcugcgauggcugagggucaggcagguagacacacccuccagguagcugggcucacacacuguucaacaaaaagagcacuuuggggcaccguagcucacaucuguaaucccaacauuaugggaggccaaggcgggacaaucacuugaggccaggagcucaagaccagccuggguaacauacaacauagcaagacccugucucuaccaaaaaaaaaaacaaaaacaaaaacaaaaaaaaaaaccacuuugcagaucagaaguuuagaaacucaauacuagauucucagccucacaucucccuccccaucucucaaaggagaucuucucggcccucuccccagccagugcccccugccccuuucuccaacaguccuugcagcuguucccaggacccggcuaagccacguccugggcagugacacccuacacaggagggcaagacacccccuaugugugaagccauuaacaauuauuaaaauuuaacccaagagaucuucuacagcuacagaaaggcacccagagaaaaguguucaaagaacagagcuuuaagucuuuuuuuuucauucagcaacuaacaauagugaugacucaagagaaaggauauauuucuuucuuucaaaaaaugguaagaaaucuuuuuuaugcacuugccguggaaaaugcuuagcucaucaaauuccuugugcuaaaaggagcuaaaccaacaccacagcagggcccuccccguaccagcccacucagcccuguucuaauccuaaucccugcauagcagcagguaacggaggguuucagucugaggggugaaaggugugagcagagcaagggagggggcagcucagcuccaggacuuagccagagccccuugacugaaacucucuuuuugauggcucucuaccacauguaguggauuauguuagguuuuggagggggaagaugagaacaaaggcccaagucugagagaugaccuaguauagagguucucagagucccaucugggaccagcagcaucugcaucaccugagaacuuagaaauacaaauucucagggccccaccccagaauccccgaaucaaacacucugggaauggagcucagcuuguguguuaacaggcucuccaggagauccggaugcauuugagaacuauuccuccaggacucagguuguguuucauuccaagggaaacaagaaacuguucugugccuggcuaauaggaaacaaaccacagguggucccaauuucauucccuaggucguaucauuuugaacucagggugaguggcucuauugauuuuaacauggcaauaaaggcaauuagucucuuuuugcuguuuaggagcaaaagacaacaacgccugcagaagccaguggcccuggagggaaagcagcucagagguggagagaagcaccagcucugucuuccaggagcccucccuuaucagccccaggcucugacggguggguaguuacuuucucuccucucagguuaaccagccccuuucuuccauccauccucuugacugucucccuaaacuccacuucccuuugaaacaggcuguaggcaggagauccaaucacagugggguuggcugaggcuccaaagugacccccaccuugagacaccuaagacaagagugucuaaaaucacagcccugccgccugucuugucucugugguucucaaagcucagacaggauggguggcaaccauggcugagccagggcuucagugaggcugcaccaacuucagauucuaggccguagaaaggucaauuaacacuggcaggccucaauuucccugucuauaaaauggacaaauaaccaucuaguaagugcucauuaaauaucagcauuucuggccugaagagagagcccucugagugggagcgugaaagggccuagaugccaggauuccagccccgcugccuuccacacagcuguccccuucccaccccugccacccugcuccuucuccagcuccuucuggagacuugggugcacaggaggaguucaguaaauagugugaauuaaggggagauagauggaaggaaagagacacaugaaccauguaugacucaggcaaagacugaauugaucuguguugguauuugagggggaaggaaauggcuaaacaaaacaaacuguguuuaccaccaugaaaggaagcccaaacaguaaccagcuaauggcaggugaaaacacaggaaauucugaaaaguguguaagaaaggcacuguguuuuuuucuucuaaauaauucaaaugguucaaaagcuuacuccuuuccccucuaaagagcucacuguccauggagacgucucugggagcguaguguagcccuaccucauaccauuuuuuuccucaccuggcaaggucccugcuuuuucucagggcucgggggcccugcuccugucuucacugaucugcuugcucucugucaguaucacugguuaacaaaugacucuauauccguuccacagaauggugugcagccaucccaaugcuuacugcagcuacaugauaucuguguucugucgucuucaucuuauaaugccuagaacuuugagggaaaucauuauauaaugaaaugaagaaaccaccaaaaacuguguaccuaugcuuugauuuuaacuauauaaaauaugaauucaucagaauaaagacaaagauaagacucaaaugaaaacaguuuguuaggugguaggauuauaaucgucuuuucccuuuuuucauuuuuuuauuuuuauuuuuuagagacagggucuugcucuguugcccaggcuggagugcaguggcgcaaucauggcucacugcagccucaaacuccugggcucaagcaauccuacugccucggacucccgaguagcugggacuacaggcaugcgccaccacaccuggcuaguuuuuuauuauuuuguagagauggggucuuguuuucuugcccaggccacuuucaaaugccugggcucaagugauccuucuuccucgaccucccaaagugcugggaauacaggcaugagccaccacuccaggucucucuuuuauauagugugguggauguugacuuuauacuuaaaauuuuuuuaaaacauauggcaaauauuauaagguguuugugccccacaccccugccaccaaauuccuguguugaaauccaauccccaaugugaugguauuuggagguggggccuuugggugguaauuaggucaugaggguggagcccugaugaaugggauuagugcccuuauaagaagaggccagagagcuggcuuguucucuuuccacuguaugaggaaugcaagaagucagcagucugcaacuuggaagaggguccucaccaaaacccgacagugccaccacccugaucucacccucuauccucccaaacuaugagaauaaaugucugcaguuuauaguccacucacccucuggcacuuugugguuggauuuuuuuuuuuuuuuuuuuuuuugagacagagucucgcucugucacccaggcuggagugcaguggugcgaucucggcucacugaaaccuccaccuccuggguuuaagcgauucuccugccucagccuccugaguagcuuggauuacaggugccugccaccacaccaggcuaauuuuuguauuuuuaguagagacaagguuucaccauguuggccaggcugguccugaacuccugacuucaacugauccaccugcuucagccuccugaaguccugggauuacaggcgugaaccacugugccuggccagcacuuuguuauagcagccagaacggacuaagaugucaggcuuccaaaaucuacugauuuucccauggaauauacaauuuucagaaaagcauuauuuuucuaggauaaugaaggaugaggggucauagcccaugugagaacuacuuaccuggagacaccaaagccuuuggagccagggacaugaaagaggaugcgaacuugccauggggacuccagacaguggaauggaggagaaaacaacagcuaaauauaagggagaaauucccuacgaguggagcugucuaauaacagaauugccaagguccagucuccugaccaugaagauguaugggaagaggguauuaaauaaucaucuaccugcagacacuggggagcucaggugcuuccagaucucauuucauaccacaacaggcugcaguguaaacauauggucagucagcggaggacugaagccucaaacucagaugucccagggccuggacugcugcugcacgagagcuacaccagagcuuccaaacggugcuucuuugcaugcccaggguuggcugccuccagccuguuggcucaccccaguaugcccuacaaauaucaucaguuuccacccuugccaugagacagaaagguggggaguaccucuuaucacagcaaagaggaggagauggcuuccuacaaaagcuaguaaauauuucaucagaaggaagucugucuucacaggaauugucccagcuagacuuccaaucccuaacccugauuuuaagagauccaccugauaaaugcgucuucaggaacaacagccaaaaacaaagacugaccuaaacguggcuggugacagcgagaaagggaggagagccaugaaccgcagagggccagcauugagagaguccaaaguauuggucacgcuuccauauccuggcucauguuacagccaacuuuuguuuaccaggccuacagucccucuuccugucauucccagcuuccuauuuuaauguucuuuuuuucucuguucacuacuauuuaggcagacaaugaauacagauaacagcgacagugaaaaaauucaacugaguuaucugcuacuggggauuaccugauccaucgggaaaucacaaguugacaagaggacaaagaacaggguguaccucauuguugucgauuugcuuaucucaaguugcacccaccccccauccuggcuacccaugcucaagccuaugaccaggagggaggggaagcacuugcccccguggcuccccacugcauggacguuaucaggggucuugcuggaugguggccaggcaccuguuacuauccuguggaauuuacacagcuaggcauggucagaaaggaaauccaugguucaaauuuuuaucaaaauucggguaauuuuucagcuagcucagccaaccauaugcuuucaggaaauaacaauugugggggcagggggugguaaagcaggcuucaaacugauuuaaaccugauccccuguccaaagagcauuguacaacugagcaggugucuccauucacacuuccacccucuccaguuacauggcaaagggcucacaacucccagacacucagccagccagcauucacagagagcccacugugagcugcgccgggcgggccagggacaaggaugucacauggcgcugccugugccauguuacagugaggguuugguugaggccauaaggcaaaucaacgauaucaaagacacaaaaccacacacauaaacaaaaaaccacacacuuaaacauaguaacacuuugagacggucauguccaaaaaggccugaggagcuggucuaauaugagguccggaggaagaaagguagggucgggcagggaccugcagugacccaaggauguaggagcagaggcuggaugccccagcagggcccaagugugagaaagcuggaggcccugggcauagacugcgaagaaaccaguugggcaggagugaaaacugaagagaaaugaugguugucaggcggagucagggggaugcuaucccaugaggaggcucucaggugcuaggcuagugaguucagacuugacucaccagucaaaacacaggaacacugaccaucuuacacacugcacaccagcacagaacagccacagaaaugggggaaggcccauuuuuggaguugacagugaccaguuaaaugagaugcauguaccauugcugagccucauacccaccugccaggugggcaacaucaccucuuuuuuggaagcgaggaaaccccauuagccuugagccuugcaucacauuuccaaaugacucagugguagccaugaaguagaacgaacccaaaugaugaauggauauacaaaauguaguauauccauauaaugcaguacaguauuuggcaacaaaaacggaggaagugcugauacacaccaugacacagaggaaccuugaaaacaccaggcuaagugaaagacaccaaucacaaagaccacacacuguacgauucccuuuauaugacagguccagaacauagaaaaagaaggccgguggcugccaaagguugggggagaggagaacaaagugacugcuaaugcagugaugaaaauauucuaaauuuagauaguggugaugguugcacaauccugugaauauauugaaaacugcugaauuguacccuuuauaagaaugaauucuggccgggcgcgguggcucacgcauguaaucccagcacuuugugaggcugaggcgggcggaucacaaggucaggaguucgagaccagccugaccaacauggugaaaccuugucucuacuaaaaauacaaaaauuagccaggcgugguggugcgggucuguaauccuagcuacucaggaggccgaggcaggagaaucgcuuaaacccaagaggcagagguugcagugagccgagaucgcgccauugcacuccagccuaggcaacagagacagacuccgucucagaaaaaaaaagaaugaauucuauggaaugcaaaucucaguaaagcuguuguuuaaaaacuggcuuaaaccaggcaccguaguaugugccuauaguuccaacugcucaggaggcugaggccagaggaccccuugaguuuaggagacuucgauaucccugucucuugaaaaacaaaaacuggcauaaauguauuugcgauuccccugccuucauauauaggauaugugugauucaauuuaaucuuuauuaauaauucaaucaauagguacccugugcuguaaucaaaaucaugcgccccuccuccccgcagagugcuucuauauauccccccauggugcuguuucuguuuuucugccuccugccugucuccagugcucccugucaggcugugggccaacaccuaccugcuguuuggagccccccacccccuccguacccacuccccugcuccuccacaccccugcagcucaacugugcaagggcaggucugugcuugugccaaugcucagaaugaauaguuucaaucagucacccggugaggccccucugcucagacagagcaggaaaagauggggagaagacaagcuuguuaucuucauuuuccuuuugaaaggaauauuuauuuggcaaguuuaacuuuucucaggaaauaaggugugugugggcaaaggcgggaaauuucgaucuuuuaaaauacugcugccacucauuuauucguucuuuuagaaacguuucuugggcaccuccggugugcugacacuguccgggugcugggguagaccagugaacaagcccuuguggcgcugcugugguagcgaguggagacgggcaaugaccaaugauggcaggggugcucuggacucaaauaaauccaggagaggggugaagagggcuggagguggggcggacgcugcaauuguaaauaggguggucaggggaggccucacugaggaggugacgguuaaacuaaaggagggaagaaguggggagcaagccugcaguugugaaaggauaaagaauguucuagguggccgggcgcgguggcucacgccuauaaaucuagcacuuugggaggccaaggcgggcagaucaccugaggucaggaguucgagaccagccugaccaacauagugaaaccccgucucuacuaaaaauacaaaacuagccaggcgugguggcaccugccuauaaucccagcuacucaggaggcugaggcaggagaaucgcuugaaccugggaggcagagguugcugugagccgagaucgcgccacugcacuccagccugggcgacagagcgagacugucucaaacaaucaaacaaacaagaauguucuaggugaaggaggcacagaacaagugaaaggcugugugacaagagugugccaagugaguuugggaauaagaaguauggaucaaacaaaguuggugugggggugguggccacaggggccacggggaggucagcucagugggaagaauucugccuucucuccaagggagaggagggccgaccauuaccucaauggcaccccauggcccuaacaucauugucugaugcuuguugguauaccaagcuggacguggcugagugggaugugaggugggaagcacugcggggcuccccugguggacacguggcugcaaucagggccuucugguggcaacaucaaggacauauuucaaacaggccucggggaggacacugcacaucucauuggacggugcgggagaacaccuaggagcagugaagacugagaaacuggucuccccaaggucuacgaggacucaggcaguaacccgggauguguuuagggcaguguggggggaggggggaagaugggaaugguuaucacaauaggauaaaaacaguagcuacugagguaccagggacacuugacauguacacgguaaacucuacauuuuacaagaaucuggcaaaggagaugucacaauccccauucuggagaugcaagauggaggcuuggagaguccaaauuauuuggccaaggcggcaaagcuagcaggcaggagauggucaacuccaagccccaaccagccucacuuccuggcucuaucagugaaacugcauagaauugcuaaccaucaacuauuucugacuuauaaaaauggcuuauaaaauuucauaugaacccuauugaagaggauuggcuuucccaauauuuacccacaacagaagcucugaaggacucugacaaaggcagaucaucucauucaugucuacugcccaguccugugaguagcaguacacaccacaaagcucucaagccuggcuguggucagaaucacccuagaaguuguuguggauucccaguucuguccuaucuggagcggaaauuacaggggugaagcccaggaugugcauuuuaaaacagcacccccaaaucauucugacauaauccuucucaugugguuuggcucugaccccaccuaaaucucgaauuguagcucccacaauucccacgagucauggaagggacccggugggagguaacugaaucaugauggcaggucuuucccaugcuguucacgugacagugaauaagucucaugagagcugaugguuuuauaaaggggaguuccccugcacaugcucucuugccugccaccauguaagacgugccucugcuucuccuuucccuucugcugugaggccuccccagccauguggaacugugaguucauuaaccuuuuuuucuuuauaaauuacccagucucagguauggcuuuauuagcagcaugagaacaggcaccuucccaaagucuaaaaaaccaacagccucauuauuccuuugacaagcggcuacagaacuaauuucaagauaugcauuuuccaagaugucccuaggcaggaaaauccaaggaaauucuuuuguccacagcccaucuguugucuuucuguugugguuccagucggggaauggcugcagcaagggagacugcaucacaccuacuaugugcuggcuuccugggcagacgggaaaaaaucacuuucaaaacuccacucugaguggguuuccugggcaccauuuuucuuuccugggauguccggguacuaagaucuuuaugagacagaaguuucuccaauuagcagaaagagagagagcgagagagagagaggaagaagaaucagagagaacucucccccuuuacaauaagggaagaagucuuuggauaacagcaggaaggcaguggcaaaaggaaccaaggaagagcuacugauuauaauuggaggcucuggcuuguuuuagaacacaguggcauggcaccaggaacaaacccaugauuuggcacuccaaacccugagcauagcuauuugcuccuuaaauuuuuuuauaucucaauuuucuauauugcucaauuuucuuuugaugaauauguaugacuuuuacuccuccaaaauugacuugauuuuacaaagugagauugcucacuuuguugaaaaugccaggcuugaugcuucugaaaaugaaauccaccuauggaagauacagucucugccccaacccuaagaugacccagcagagcaaagucagcuccagucuccacaaagaagggaaggugggguacacaacucuacucacugggcugcaggagcuauuccagagagugagcacacugcuggcccuugggaucucauccuccucucucugaaauauucaucuuucaaggcuaucuugucaugcucuagauccaaguuugcagaacgcagguuuaugcgauaucaacuuuuaguaacaagaaaguauuguuggcucuucuuuuucaauuuggaucuuucacaauuaucucaaaaugaguuuaacuaucuugugcccaaguaaaaccuaaacauuaucuuaaaaaauccugauugccaggcccuugcauuccaggcuaaugacuacuguaauuauaaacuccagucugugcuggacgagucugccaaggaagaacccagaccagggcuguguggcccugcaucaugggagcugguuguacugucaccuagcaagcacagaugcagguacauggcagcacgggugcccagagcagaccaaaaaauacagccuugguuaaaaaucccuccccucccguuggcuagggagacaaggccucugcacugaaacaauuagggaacaacacaauaugcuuugucuuguucaccaaucacacauagauaaaugacagguagaaguuauaagauaauacauccuauaaaaaggcaauuguguuugauugugagguacauaugagaaaaugugcacuuugggaggcugaggugggaggaucacuugagcccaggaguucgagguugcagugagcuaugacugcaccacuguacuccagccugggcaacagagcgaaacuccaucucauuaaaaaaaaaaaaagaaagaaagaaacuguggacagcaggcgaaucuggaguucaggucaucaaagccaauguuguuaggccagcaugcuaggggguagagucuggaaggagguagaagcgcacuagguguguucaguggggaagguucagagacugcugaaugaaggacugaugagaaggaaggcugaccugaccgagugaggucagauggggaaagccuugagaguuacacagggaaguuuagacuuggugugugaagugaaaaggagcaauuguggcuuuccuagaaaugaaguuaugaaaugaugguguuuuuuggaagaugaaacugacacuaaugggcaagggaaguugaauggaggaaauagaggcaggagguucucagauuuauucuguccugggauugcagcaacccuguccuccugccacaaguuuaguuucaaaaaucauauuuagacugggugcgguguuucacaccuguaaucccagcacuuugggaggccgagguggguggaucacaugaggucaggaguuugagaccagccuggccaauauggugaaacuccaucucuacuaaaauacaaaaauuagccgggugugguagcgggugccuguagucccagcuacgcagaaggcugaggcaugagaaucacuugauuccgggaggcggagguugcagugagccaagauugcaccacugcacuccagccugggugacagagugaggcucugucucaaaaaaaaaaaaagucguauuuacagauggaccuguggcccuccucugauagccugucccagguucaguccacgcagcucuaccaggcgguggguggauggugcucagacucggcagcacccagcuccaugacuccccgacacccccacaccaccugaggugucccccucagggacaguguagggccugccugguuaaaccaccccuaccccuccuucuccaucuucacuguucccacacuuacucuuuuuuuguuuuuuacaauuuuguugagguaugauugauauaccaaaaaacugcacauauuuaauauagauaauuucaugaguuugaacacgugcauacauccauaauaccaucaccauggucaggguaauaaacacaucaucaccuccaaaagcuuccuugugucccuuuguguguguguguguguguguguguguguguuugguaagaacacuuaacaugagauugacccucuuaauaaaguuguaagugcccaacucuaaaccaugggcacuauguuguacagcggagcugcagagcuuacucaucucauaucuguaacuuuacacccaccgaacaacacauuucccucuucccccauucccuggcaaccagcguucuuuaaguuugacuauuuucgaucccacauacaggcagaaucauacaauauuuguccugugacuagcuuauuucacuuagcaugauguccuccagguccauccauuuguugucacaaacggcaggauuuccuucuccuuguuuauuuuuuugaaauagggucuuguucuguugcccaagcuggaguacaguggugggaucuuggcucacugcagccucgaccuccugggcucaagcgauccucccaccucagucucccgaguagccgaaacuacgggcaugugccaccaugcucagcuuauuuuuguauuuuucuuagacacggggucucacuguguuggccaggcuggucucgaacuucugggcucaagugaucuuccugccucaaccucccaaagugcuggggaauacaggcaugaaccaccaugccuggcuccuucuuuuaaaaagcugaaugauauuccauugcgugcagagcccacauuuccuuuagccauccaucugucgacggauacucagguuguuucuguaacuuggcuauugugaauagugcugcagugaauguggggguacagaucgucucuuugacagugauuucacaauuuuuuuggauauauacccaguaaugagauugcugaaucauauaauucuuuaauuuuuaauuaauuuuuuguuuuuugaagaaccucuauacuguuuuccauagugguugcacucaacacuugcucuugggagcuggucuuguaccaugugcuagccccuuaccccccagccagucccacauugcuggaaucagccaggagaaaagguagggugggagaaugauacuugcagguguagaguaggcguuaucucugacuauaaagguaaguacuuagcugaaaacuuuaaccaaggaaacuggaagaaauggcaaacgaaaaauaaaaauagaaauacaugcaccaaaauuagccgggugugguggccggcgccuguagucccagcuacucgggaggcugaggcgggagaauggcgugaacccaggaggcagagcuugcagugagccgagaucacgucagugcacuccagccugggcgacagagcaagacuccgucugaaaaaagaaaaaaauacacgcaccagcauugccagauaucuaaaaccauaaaacccagacacaguaugaacauuauuaucuuuugugguuggagaauguagcuuuccacuuaaucagauguccuggucaacugagaggugcuaaagagacaaucaacccaugaccagcuuugggacaaaaccaccaccuuaguuuuugagugugcucugggauuuguaucaaaugccuucccaucuacugugguaaucggaucucacauuauaggcuguaggaagccaugcccagcagugauguccgaucugacuguacucagcacagucaguuccagugugcaugggaaggauagggcagggcuccuggguacccccaugcccaccaggcuaagaccuuacccuacaacccuuaccacgccacccaggucuagucagggcaucucuauuuauuccugaccuguccccucauugccuaugaggccuggagcucuucucugaaccccugaggacucagcuggugcccuugugcccugccccucacucacauuauuccugcucuccagcccagagaaacauacucugcucccaaggucuagccccagagugcuugugccugugaagcaagaggccacuggcacccaagacuccugcugcagugcuccagauccaggcugagcccuguaaauaauagcccaccuagcacuggacuccaaauacucuggggcucagcccuacagucaaaucucuaccuccagccccaaggcugaccagacaggugacucaggaggcagauguuacaaccaccacugugaccugaggcuaaaggacaauuuaacagaacugaugcaaacucacugccauuugccucccgaucaaguuuuaaaauaaguuccauaaaacagcucuguaucugauugugguguuaguuacacaaauuuauacaugggauaaaacugcauagaccuguccacacaaacuacacacacacacaaaacaugaagaauggugagggcugaaggucuguagucuaguuaacaguaaugugucaguguugauguucuaguuuugauauugaacuucagcuacauaagaugacaccacuggggaagcuggaggaaguucucccgaaucuuauguccuauuuuugcaaccuaagucuaucauuauuuaaaaauaagaauuaaaacaaaaaacaaaccaaguuccauaaaccuaaugaucuacagcagauuauuuucacaucaaccagggcccaugaucuggcaccauacauguuuuuccaggccgccccaaacaggucuuccaaccccagcuuuaguguugucauccaaccagccucagcgucuccaacacacgccacucgggcacuggaacuuugcacauuuccagagugacccagaaggucacgucucaaggcaaguaacucuggaaggaguggguauuuauuuugccugcagcuccucucagccccacucacuugagacugacuggccagggacagggaccagcuucccaagaaggaucuaacaggacuggagggcagauuuaaggcugggcuuguucaaaagcuucuaccuaaucaccuaaucucugaugucuuugaaaagaaggcaagccguagucuacacaggcgcacaugugugcacacacacggcagccucaaggagccaaaaagaggagcuguaaauuuaacuauuaauaaaucaagcgauggucaagacuguaaucuagaguuaucuccacuuacaggauuuauucacugacugggaacaggaaacaguuacuauaaaugcaaaccaaggaucccuauccucuucaaugccacagaccacuccuugguaggcuagggaagcccacagaggccuccacagaaugaugcuaaaugcacaaauuaaauacacagcauugcaaaggaaaccaauuacaguaaaaugcaguuaucaaaauauuuuauauuuuccaccaugguaauauuuaauuaacauauuaaauaagaccuagcagcgaaucucauaacaaccuuaauucugaaguauuaagaauugcuaaggauaacaguauaucaagacauuuacaaugacucuaccacacuguaaaaaauuaacuuugcuuucauguaccuauaaauacaucgguguacuauguacccacaaacauuuuuuaaaaaugcacuuugcaauugcuacuggugacagucaugagaacuguuaaugucccugugguuuauagucuacauucauaauugaagaaaaugccaauuuucaguuagugaaaauaaaauguaauuucuuuccauucagguuuuuggagcuucccugaauucugucuguggguggacuccagcugagagccucugaccccagcgguugauacagaauagcuacgggaauggaacgccuccuccucuccauaacccugccacuccccaaccuguucacuaaugagauguccauuccaaaguagccucgcuuuaaaacaaaccccucuuguccaaagaguuuucacaauccucuccagcugauguuuaacacugccccugaccccagccuucaucuuaggcaagaggggcccaucucucacaguucaccucucccuucagccacugcugccacugugaggaaauuaggggaauuauauucaucucuggaggagccugaaugcaaacaaucauccucugaguguacccagaagccagggagcagacgccagucagugggcagguucgugcugaacgcugacaggcaaccagcccugggcuccgguguuuugagcaauuugagggugagaguggguguaaagaaaaaaaaauaugcagcuacccguuaaaggcugcagucaaaguggccggcuuggaagauauuuguuauggguugaauugaaucccccucauacacccccaacaaaaaaaguuauguuggaguccuaacccccaguacaucucagacggugaccuuauguggagacaggguguacuauguauguguacuauguggagacccugucuccacauaaggagauaaucaaguuaaaugaggucauuacaguaagcccuaauccaauuggacugcuauccuuauaaaaagcaggaacagagacagacauccacagagggaagacuguuugaauacacagggagaaggcagcccccuacaagccaaggagagaggccuggagcagaucccucccgcacagccucagagggaaccaacccugccgacaccuugaucucagacuuccagccuccagagcugugagacaaugacucuuucuguuguuuaagccuccuagcaugcgguacuuuguuauggcagcccuaacaaauuaauacaaaaauacaacauucaaaaucaaacguauggccugaaacaaggaaaucuuacuuuggagcuuaucacauccuuuauguuugcccacugaucgaucugaaauuagauucuguucggagucugcuucuggucgggcaggagggaugguccgagguaggucuguuggaugaugugacugggugauggaggggcauagggaauccaggaaagaacugcuggcaacucuaccaccagcccauggucuuaugggggaggggggccaauaccucacuaggcagggaucuguuuaauccuuucauucagauauucagugaggagcuuucaacuagagcagugguuugcaaacuuggcugcauauuagaagccccuggggagcuuuuagaaaauuccagcaaagccugagccccaccccagaccaguugaaucaaaaucuuuguggguggaggcugggcaugaccauuucuaaaaagcuccccagaugauucaaaugugcagccaggguugagagccacuggacccuacgaccuuggagggccuuuccuucucagaauccggcgagagugcauuuuguguuuauuuuagugguucuggggagugugcucuggggcugccuggagucugguuuccuacagguucagucuacggcgcccuuuacuggcuauguguggaugaguaauucggaugaacagcggggaauggugggaaaaagggagcugaaaaggacuuuucucccuuucacuaaaacaucaauucaguaagcuuguguuacaaagcuccuccgugccagcagcucaaaggugaaccagaaccaaaugcccagacuucuagaagcucagucucauuccagaaacaaacugacagcugcuacacaaaacggggcguaccacaacucauguccuuaucagugucccugcggcagaggcucaaacacccccaaggcaaccgaaggugaccccagagauggucuuaaaggagaaacaagaaugucuuccauggggacuaaagaauaucagaagguuugacccaugauggacuaaaaucauucuguuuggcuaaaaauagagaaaauacgucuucacagaccaagaaaauuugggaaccacugcucgagugaagcugguguuuaauaagggguggccuggcuuggguaaaguagugccugaccuuccagcaggggcugccuucuaccuggauccacagagcagccugggaucccacuguggccacccuaccuguguaccaacuuuuaaaagugagcuuugaauaaauguauguuccagggccccauguccagagauucugggcacagaagucaggcaugcggacuuucuuuuuuuaaaauuauuuauuuauuuuuuuugagagagaagggucucccucuguugcucaggguggggugcaguggcguaaucauacuucacugcagccucaaacuccugggcucaagcaacccuccugccucagccuccagaguagcugggacuacaggcaugcaucaccacacccagccaggcauguguauucugauuuuuuuuuuuuuaaaucucaacuuuugggggaacuucagggcacugcucuccaaaccucuaucuugagggcagaccaccaggccuguggcccaacaccuggcuugccuugcugggccugccucgcuagacccucagccucuguuucccaugugggacuguuccccuggcucccccuccggcucuguuugaucaccacaagccucugagcucugccucgaaagacccagccacgcccagcccugcuuccagcccuggcuccugcucucaggccagcauccuggcaccaaccugaccaaguggaugacccuagagugcaggccccaccacaaguuaaucaccacaaacccgcaggccacaguguggaaaggcacucucauccuuuuacccuggaccaaaacugcacaaagauagaaacagggacuucugugcuccuugagcuucacguguuaaccuggcuccccagaccaaagaccaacaccgcaggggugaguucauccucugccaacagcaaucuuucccuuccucugaggccagccauccccaucccaggaggcaggggaagcaagcccggggagggcaggagagcucccagcucagugaagcagcuccaccggccccgaagcaccucccuugcucacagcucagagcccagcuucucccugcugcaaagauaacugcagccuucagacugacuuccaugccccucuagcuagggcccaucacuucaaguucaggcgccaaaaaccaagaaaguaaaucacacuucauagacuuuauuuaccuuaaaaaauuccugaguucauucaugucuccaaaccacuagagaaccugaaaauucaccaggaaauugggcaacugcaaguuauccuggagacuccagagucaacacuucauuaaaugagaacaaucugguucaugcguugaagcuguuacaguaaucagggcgacaugggcaggggaagcgauuuuucugaggacaaggcauacgguaaauccuuagcucuacggaugcugguguauucccagaagucggcccacuaagggcaugcauguaccugugggccaguggacugugguccucauuccuccacacggacagaccccgacagccaccccuguuuuacaccaauuaaacaggaaugaugugcggguucucauugaugauugcaaaugaucuucuggaacaaaacuaagcggcuucuuuuuucuuuucuuuuugagacagaguccugcucugucccccaggcuggagugcaguggcgcaucuaggcucacugcaaccucugcuucccaagcuaaagugauccucccaccucggccuccugaguaguugggacaggggcuugcuaccacaccuggcuaauuuuuguauuuuuuguagagaugggguuucgcccuguugcucagacuggucuggaacuccugggcucaagcaaggagccucccaccucggccuccgaaagugcuaggauuacaggugugagccacugcacccagccugcuucuuuuuuuaaaaaaagguguaccaagacuucaaaaaauaaggccgagcgcaguagcucacaccugcaaucccggcacuuugggaggcugaggugggcugaucaccugaggucaggaguucgagaccagccuggccaacauggugaaaccccaucucuacuaaaaauacgaaaauuugcugggcguggugacacaugccugugaucccaaggaagaugggaggcuacaggagaguggaggugauuugcaugucuuuauccuacaucagaagguaccaaggacauuucucagaagaugcacacaaugcggccaacaaaucucuguuggaguguuggagaacagagcaguggcugccagggggaaggaggcaugacuacaaagggguggcacaggagauuuuaggaauuuggaacuauagcagugguuacaugaaucuguacauguguuaaaacucguaaacuguauacccaaagacucaaucuuucuguaugcuaauuuaaaauuuuugaaaggaaaaaagccuuuagguagagugagaaaagcacuggcuggagaugggacauggcgugaacucccccaccaugugacagugucccaggugccugugaaaccuacagagccagugggcaucggucagggagccuggggacaggagggggccaaacaaagggggaagcaacagagacgcuuguggaggaagcugggucccccuggcacacgagaaagccagcaaggagggacuuugugaagggcagaaggaaaccagcaaggccggcaggaugucaggccaggccugcugugagagggacuuggagaaggccagauguuacacuucacccuaagcaucccagggcgcaagccuucccacaggccuugggucaaggaagccugaaggcgaucuugaauuucucuggggcuucucccaucuccaguaggucaaagggccaguaccacaagcaaaggagagggcaggcacuggucuggaaggcaccaggaacugccaaccuguuuccuuucacauucccucagaucuucccaagugcaggcagccaaugugugcccuuccugguccuuucugcagaagguuucacugggcaugcagacaaccaccacaacuugguaaggccggaagaaaggccaaaagaggacagugccugcacaacuggucccugaguagcccagagcaaccaacagacagcuaaaccuacagaagcugcaggcugagcaggagaccagguucccgaagugaauggucugcccagggagccccgggcgccugggcaccaucaggaggagaacacaggcucgagggguggucuguaaacccuaggaaaggccuaaaaggcugggaagaagccgcagacacugcaggaacaccaggaaguguuuccugucucaaacgccaaucucucucgguccaagacuccccuuuuccugaagcuggagccugcuucuauuuauugaucgaaggcugaaccgcacuguccacggugcuacaaagcccuccucuaccacaaagccggguuaugcuucaacauccucgcagccaacucugagacagcaacuugccugggguuaagacaauuuguaaccagacauggaaaugcagguagauuuaaagacacauucuucaguaacagagaucuaccuuaggguggagcaaaccuuccgaggacaaacagaaaguguggcugggucccagcuuguggcaguaccaggaggcccuucaguaggugagcuguggccacagggccuggaccaccuccaaagggccggccuucaaccaaggccugacagagagaaauuagcaugcuguucugcucaauuauccacuuacagagaggcauaaucacauuuucuuaaagcuggacauguagaugaaagauauguccacgauagaaaaucccgggaguuuuuuuccaaaagagauaaaaacuuuaucacaccuccgaaacuaaccugaccugagcuaucaugauuuuggcaauagagacacaaugacuuuucuuaggacucaaaugugagcuuucuuucugcccccaaccucucucaggcaagaguuugggcagacauuauuuuuaaacaggcucauaucaccccaagacaaaauacauugaauaagcacuaagacagccugcagggguuugggccucggaguucuggacuggcuucagcuucacacggagucaugugcauggucuccuggacaccagacccaaaaggagaggggagagagaggacucccagaggggacugggucuccuauguucuaaagugccaugcuggugggcacgggaaguuaaaugaagucauuuaccaguccguuuggguuuggcugcagaagccagagcaggaguccuggacuagacugggguggacguugagggccaugcaccacacuugcugucagcucuccuagccccugccccgccuucugcccacucagcuagcaccuuacaccacuauggccaggagucuguaaagcugaccuucccaggagcaacuccaguccuuccuccuucccuggaaaugccugcuuuccucuguccgccauguagcauucugaguucccaggcucucuccaucccagaaggcaccucuaaaagccaugcccccaucugcacaaaugaugaacaauuaccacuaacugccccucaccucgcauuaaccccgagaccucccuuaaggagggaaggagggagaggaggggaggggaaggcaggagagccagucagggccccuccauccugccccuacccagcuccccugguccuugcagguagauuggccaccaucauucuugcucuucacccagaggccuccuaagcaauggcugcagacccgaaaaccccauggguucaauagcucagggccucuuagggacaagguucaggcauuauuaaccauuuccaaacuggaguuucagaaugcaacuauuggaaggaaccccauggguccccaguucagcaucuucacugccuugucccucaggcuuacacaagcugucagcauggcccugggggagguggugccacauggcaggggcugggugaaucugguuuccaagccagucccugccccaggcuugcugaauggccucaggcaaggaucuugaccucucugggccuugauuuccucuugaguaaaggaugaauaaccaguuccuacuugcagggucauucugaggacuaaacaaaguaaugcaugcaauauuccucugggacacagagaacacccaaagaaugaggguucucaaucuagcaguaguucggaaagaacuauuaucacugcaaaaagcacuguucagagaagccagaagcccaaguucugggccugcuaugcuucucaagagcuuugugacauuaggaacacuguucaccucucugagccucaguuuccucaacuauaacuaaaauucaaaugggucucuaaggccucuuccaguaaauaaauauauacugaauauguuuuuauuuguguguauauauaauauguguauauguacaccagggauucucagccucggcuauggacauuuggggccagauaauucuuuguugugaggaaccauccuaugcauuguaagaugguuagcaacaucccugaccuuuacccucuagaugcuaguagaaugugcccccagccccacccaagucuaaccaaaauauuucuaaccaaaauauuucuaaccaaaauaucuccaggcauugccaaaugucuccugggcagcaaugcugccccaagcugagaacuuauucaucaugcacacaugugcaugcaugcgcguauacacauacacacacagaauaauaagaugcgaacuuugauacagugaagagguaagcuggugagagcagaggaacucaauuucuguguacagaggccuugaaaugugcucauggaaacuuuacagggaaugagacuacaaacauacacaggacuuuugagcuucuuuacaucuguaaaacgguuacugugcucguaaagacugccugcagacuuaauuuggcauauacauacagagucccauuuagugcauaaacgcacuggccccagagcuccccacaucuggucugcccuggucaagaauguacugggaacuuggccugggggagacgaacacagggggauucugugugcucccuuccugaacacucgccuugagcacccuggaggaaaaggaagcugaagcuggacuggggcagcaggcugcgguggucauuccugaggaagagggcauuuugccaaaugugcaaaucccuuugacuuaguggauuugaccagacuucucaauguacuauuuuccuaguucagcagagcuuggugaaugaggcuugugcucaccgacaugagaccauagacguacauaccuacccacuuggcucacugaaguaaaaaugaacaauuaucacgaagacggaacacagaaguuccaaagagggacugguaaaguggaggaggggaggugaacaucagcuuuaaagagaagucuguuuacccugagucuuuaaaggccagaauccugaacuccuuuuuuuaccucauuaugacuucuuuaacauuuguuuuuaauuuauucaagaucauaaucuucacugaggaccacauaugagccaaacuugaacuugaaaaccaagcugggccuuuuguucugccugcguuaauuaguguacaaaggggcaucugauuuccccccucccccaacagucuaaaacacugguuccuauuuauguaacuaacaauguuagaguggggugcagacgggccugguggguaacuggcccuaggacagguaucaggaaauuaacguccuaauccuggcugauucucugugggccacuaagacaaucuauuucaagugcugagccucaucuuuaaauuaguuaacaguucccuguuagcugaaaacaugaaguaaauuaacuagaauuaugaagaucuauaguauucuagugauuuguacuugaaaaugaaguacgaagacuagagcaguuccauagaccaaucuaugguucucaaaguggguucuguggagcacaagucccacuguguccagaauugguuccuuccaguggguucauggucucgcugacuucaagaaugaagcuguggaccuucacagugagcguuacagcucuuaaagguggcacggacccaaagagugaacagcagcaagauuuauugugaagaccgaaagaacaaagcuuccacagagcguugcugcugcugcuggcugggguggccagcuuuuauucccuuauuuguccccgcccauguccugcugauugguccauuuuacagagugcugauugguccauuuuacagagugcugauuggugcauuuuacaaaccucucguaagacagaaaaguucuccaaguacccauucgaccaaggaaguccagcuggcuucaccucucaccaugagaugcuacuuggagaaaaaauguucugcuggguguggugccucagaccuguaaucccaguacuuugggaggccagggcaggaggaucacaaggucaggaguuugagacuagccuggccaacauggugaaaccccgucuuuacuaaaaauacaaaaauuagccaggcaugguggcacgcaccuguagucccagcuacucagaaggcugaggcaggagaguugcuugaacccgggaggcagagguugcagugagcugaaauugugcuaccgcacucuggccuaagcaacagaacaaaacugucucaaaaaaaaaaaaaguucuaugggugccucacucacuuggacggcaaauacuuguuugacggccuuccuuauaucuggugcugagaacacaggagggaaggaacaaaacaaauccacugccugccuucuucagugaguuuaagauccagaggaucagaucauuauuaggccacauauuuaccgacagugaaaugugcucaaguacagagagcugagaacuuacagcagggaaaccacaucuaaggcugggaggcagggaaguaugaggugagacuuacgcauggggugacggggaguagguggagggguaguauuccaaacacaaggaaagccuuggucaaacaaacccaaggaauccugcauaauacacucccuucugugagauucacuggcauguuaaaggccugagaaguccugcagaaaugaagcccagcacguucuaccuaauaacaucccaaggauguuacucugggaaguacuuaaagaggcacuauuguucucauagccuauaagaaacuucaguauaaaacaaaagcucuuguucauauaacuggaaaacuaucauguguccucucagagcagccaaaauaccuuggaguugcuaauguaauucucaaguauuuuccuuggcacaggccuauaaaacgauauggccucuacaacugcucacauacucccaguaacacagaugaaggaaaguccauagcacaaaccagcgagccagauucaauguucuaacucuagcacagaccucggcuuuauuuauuuuuaaaggauguacagccucaauucugggacgaauugagaaaacuuccauaaaaagcaaaauaaaaaugaacaaccaccaguaaucaacuuaucaaaaauuacacauggaaagauacccgaagugaacaaugauuucccuuguuaaccuaaaaugucuaagaggaagacagcuuuugcuguuuauuuuauuacauacugugcauaaaaaagagggaaauguaaaucaacaguaacagauauucacacauaugcagaaagaaggcagacuuugugugcaaagaaugguguuagcgacaaugaucaucaaaagagaaauaugacagccaacauacuuaagaauauguauucuagaaaacuagcaauccaaaauuaaacauaaguuaguguccuaggaauagugcaguguagagauuaaauuuuauagaggcuagccgggugcaguggcucacgccuguaaucccaggacuuugggaggccgagguggguggaucacaaggucaggagaucgagaccaaccuggcuaacacggugaaaucccaucuuuacuaaaaauacaaaaaauuagccgggcgugguggugggcaccuauagucccagcuacuugggaggcugaggcaggagaauggcgugaacccgggaggcggagcuugcaaugagccaagaucgugccacuguacuccagccugggugacagagcaagacuccaucucaaaaaaaaaaaaaaaaaaauuuauaaaggcuagcaagaucaugaaacccaggaccacuaaaacagauaaugaguuuaucuuaacaaaacccuugcugugugugccaggcacuguucuacaugcuuauaugcaaccuuauuuaaucuuugcaacuaugagguagauccugggaauacaucaaaguauggcuucagccuauacuagucaauggaaaucuguuauccagcuuuagcaugaaucuucagaaggacugaacuucugccugauugaugaugauguaaucacauaggugaccaacauaucccauccauguagcaaugugagaacuaaggaaacgaagcauuguucaaaucugcugucauuaucugagcaugcccuuucaaaaacagguaaacauuccacgugcaacuugagugaaaaucuccuugugacccuuaucucuugaaauguaucaguugguagaaauauauauaugcuuauuuuuuguugaaagaguaaaauauaagcaugaaaaauauuaauuuuauguagaaagcaauuaucauguaaaauuauacaacuauuaaguagggggauugaugaacagaaucaccaauauuaagaguacauuuaaaaaaagagacuaggcuggacgugguggcucacaccuguaaucccagcacuuugggaggccgagaugggcagauaacccgaggucuagaguuuaagaccagccuggccaacauggugaaacccugucucuacuaaaacuacgaaaauuagccgggcaugguggcacgugccuguaaucucagcuacuugggaggcugaggcaggagaauugcuugaacuugggaggcugggguugcagugagccaagaucgcgccccugcacuccagccucggugacagagugagacucugucucaaaaaaaaaaaaaaagagagagagagaaugguauauccuuuuagagcaaauaaaugcuuauuguuuuaaaauuacaauaggcauauuauauucuaccucuagucgcuacagaacugcuuagugcacucauaacauuaaacacaauaaccuuuaguagcuauauaugcaacccuaggguucagacaguggucuguaaguaacauucuccacuaaaagaagacagagcuucuucuagaaauggccagcuccuggccugggacaagaaauguacaaggugugcuggaguauccugccagaccaguaagcagagaagcauccaagaccaccaggauugugucacaaggacucagaagccagccugaagaggcucccccuggcuaaagaugggacaguuuggguaucaauaaggauaauaauugcaaauggauugaaagacauuaaguagguuuaaaucuauuucauaauauuuuaagcuucauuggucaccuuuacagggugccaugaaaccaggaggaaacugguauauaaagggaaagaaugaggcauuuaaauugcuuuccccauaugaucuaaaacaagggucagcaaauuuuuacugcaaagggccugacagaaaaucuuuccagcucggugggccacauauggcuucaaucacagcuaauuaacugggcaccuuguagugccccaaagcugcccuaaacaauaugcaaaugcaugaauauagcuguguucuaauaaaacuuuauuuaucaaaguaaguggcaaacuggucucagccuguagacucuaguuugcugaccucugaucugagguaacuaaagaguuggugagggguaguuucucuuuuuaaaaauauuauaacugauagacaagggaaugauacaaauagacuaucaccauuuugaaacugcaaaugagguaaaggaugugggugcugauaauuaguagcugcugacaucacagagagauaaucaguaucucugauggaaaacaacaucuauuauaugaagcagucuugcaaaaauaaguuaaaaaaggagagagggaaugggagagagagagaaacacucugaaucuugaccaaaaaucuaaaucuaauaauuuucaagaacuucaguggauagagcaacauguuaaaagauaucaugagguugcacuuagcaaaauccagacugugaaaaacuccacaggagucaucaagauaaaaaccuaauuaggaaguuacucacauccuaugaaaaaugcugagcagaaugucaacuuugcuaucucaacauuucguaaggaaaaaacuccaaaaucuugcaguauaguuucuugauaaaucaucuuugauccagacauaauaaagacuauaaaagcuucagagaaaauaaaccuguuauuuuuuaaaaaugagagaccccaagauaucucauacuuucaccuuauuuaguaugcacaaauauguucuauagugucacagaaacaaucuagcaacugaaaaaauuauugcuccugcccuacacugucaauuuuuaaaaacugaucaucaauuuggcaacugucacaguggaaauuguuucuggcaagaaucaucaauggccacuaaaaccauuggguaaagguuugaugagaaaugggauauuuacauagucucaaaguaugucccauaaaguacugauuaauuacaaagaagaaaaguaguaacuuucuuggagaaagcuggaacacaugauuuuaaccaagaaaacaaaauuaguaucaccuauaaugggaaaaauagauaacguuccugaggagauacaauaagaacacccuaucuuuccugcccaaaauguacaaccuaaagcuacucaugaagaaacaccagaaaaaaaaaaaaaagucaagguucuucugcaaaauaaauggccuguaaucuuuaaagagucaagaacauggccgggcgcgguggcucacgccuguaauaccagcacuuugggaggccaaggcggguggaucacgaggucaggagaucgagaccauccugucuaacacggugaaaucccgucucuacuaaaauacaaauaauuagccaggcgugguggcgggcgccuguagucucagcuacucaggaggcugaggcaggagaacggcgugaacccgggagguggagguugcagugagcugagaucgcuucacugcacuccagcccgggcgacagagcgagacuccgucucaaaaaaaaaaaaaaagagucaagaacaugagagacaggccgaagaacuuccagacuaaaggagacuaagagacaauuaagcauaagaugugauguugaacucauccuaaagccaaaaaaaaugaauaaauaaaaguaaaaauguuuuccucuucuacaaaagacaucuaucaguaagacaacuggcaaaaucuuaauaaguuccauagaugagacaauuguacugucucuauguuaauuucccgauuucaguaauuacacuuuggcgaauguccuuguuuuuagaacguaucuugucccuucaucuuauuuagagucacaaauaugcucuauaguaucagagaugcaaucuaacaaauuaugcccccuuaaguaaagggacauuacgccugcaacuuacuugcaaauggcucagaaaaaaguuacagagccgggcgcgguggcucacgccuguaaucccagcacuuugggaggcugaggcaggcagaucacuugaggucaggaguuugagaccagccuggccaacauagugaaacccugucucuacuaaaaacacaaaaauuagccagguguaaugacaggugccuguaaucacagcuacuugggaggcugaggugggagaauggcgugaacccgggaggcggaggcugcagugagcugagauggcgccacugacuccagccugggcguugcagccagacucuaucucaaaaaaaaaaguuacagaaagaaggcaaauuuaggggaaaguacaagggaauuauuugugcuauuuuuguauauuuucugugacugaaauuauuauaaaauuaaaaguuaaaauguaauuuauauuuauauacuauacugcuuacauauauccuacauauaaauuucaacuuauuuauaaaguuaguguguguguguauacacauauacacacauauguguauauguguauauacauauauacacauauacacacauauauaugcacauuaucuuguugauagcuauuugaucaagaacucacacaaacuggcaauuauguuaaaguaauuuguuaaguuuuugcaaagggaauugacaaccauguaaauucaaaacccgcacuaaauacuaauugcuuuuguuuaugcauuucuggccucuccccugacuccauuuagucauuuccuauaaaaaaaauuuuaagggcugggcgcgguggcugacaccuguaauccuagcacuuugggaggccaaggcggguggaucaccugaggucaggaguucaagaccagccuggccaacauggugaaaccccaucucuacuaaaaauacaaaaauuagcugggugugguggcaggcgccuauaauuccaucuacucaggaggcugaggcaggagagagaaucgcuugaaccugggggggcagagguugcagugagccaagaucgcgccacuucacuucagcccggacaaaagagcaaaacuccgucucaaaaaaaaaaaaaaaaaaaauuaaauacuguaagaaaagauccacuuguuaagaugcugguuaaaauauuuggcuacuaaacaucuuaauaaaguugugauaauacuguauauuauuuugguaacauuucuaauuucuuuuuauauccuggagauucuaugaugcugauauuucauuucagccucgaacaacuccugauuuuaaaacacaguccauucagacaaaauguuacuucagugcuucucaaagcauuaucuguccccauuuaucauuaugacuaucauuauccccauucucccugaggggggcccuggggcauagggacacagccaacucaugacgcggcugggauucagugcucugcaaacccuggucaaaacccaaguuccagaccccccuagacacacugccaccuggagggacaagggguggccuguuaguagaauauucuccaucccucaagccuugggcuucuuucuuuccacacaaguuccucuccucucuuuccaugcaagguccaaggaacugcuuauuaaagggcugucucagacuccacagacucuccccaucccagccccuuccugcauuaacucuccuuugcaucaucugggaacacccuugugaagaugacccauuuuccacuccaaagcuucagcaccagcgucucacucucccuaacaaggauuuuauaacaaaaaaagcuuauguuguaaaguagaaagcaaaguguuuucagcucaugcacucuaauacuccuacuauacucuuacccucccaugguaacucuccucuaugcaucccacccagaacauaguuuaagucaauaacauaauuaauaaguaaaaacuacagacagucccuaaccuaugaugguccaacuuaauauuuuuuugacuuuacgauggguuuauccagauguaagcccauuuaaaguccagucgcaucuguauauccaauguaaaguuacacccacacaugcacgaggauguggggcuggucaggaguaugagcgaggcaacaaacuaaggcaccaaacagaugcccaccauuauuacauaugguguauagauuuaacacccagacaccaccacgucugccagugaguggauccccaagggcagcuucauccacaaguggcacaggggcuacaccuuaaugcuaggguccuggggccccuggcccagcugggaccaccaagauccuguccuccucaaucucugggacuggggcuccccucccucacuuucucuggaauccccuuggaccccaagagccaggaguccccucccugucuuuccuccucuccccaucuccaccuagcgcccuaccacugcccucaucuaggaggugcugggguuuggguucccacagcaucacguggggagggguggggaaagagugacaggugggagggggacacacaagcaaucccuaguucggguuguauggaagauuccacagagugaggacagggugagaguauuuugcuacccggaccccccacgaaaagcuucaucauggacaagagaauaaggaccugcugcaaccuuggccugagguggaggacacggccuaggcagacugcaggguuuccagaugugagacuacagggacuuugaauguggcugaagaaauaggccuuaguuuauuuauccuggguuuuuaauuccgaacuuuuccaaacauacagagaaguugggugaauagauugauugcccguguaucuccaccuagaacuguuaacaucucaccuaugauauuuaaggaaccaaguguaccaccucaaaauaucauaagaaaaacacaagggaauuuggagauugggaaaaacagaaucaauagagcugcacagugcagaaaagcaaagaaagauuaagauagcaauuaacaccaccucugagacuguaaaucaaccagcuauuaaggcucugauucuacgucagguacuaaaaaugccuccuaagugaaagggauagaaaugccacugaagccaggcacaguggcucacaccuaugaucccagcacuuugggaggccgacgcaggcagaucaccugaggucagaacaucaagaccauccuggcuaacacagugaaaucucgucucuacuaaaaauacaaaaaaauuagccaggcgugguggcaggcgccuguagucccagcuacucaggaggcugaggcaggagaaucgcuugaacccaggagacggagguugcagugagccgagaucgugccauugcacuccagccugggcaacaagagcgaaacuccaucucaaaaaaaaaaaaaaaaaaaaagaaagaaagaaaagaaaagaaaugccacugaaaagaauauaugcugagggauguuacucaucuuuuacuucuacacaccauuucuuugaaucuugccccaaauggcauuuucaugcauugucacgucaauuuggcucucaauuuucaguggagggaaauugcagcccaguggaaccagaaucccccacagcuggaaugcuggcucuaucaccuucuggggaggugacucugggccucugguuuacugucaaagucuuggcuuccucaaggauaaaaucgaggugauaauaucagaugcacaagaauucaguguaggaagaguuagaacagcgugauauagugcccuggaacacuaaaggugcuuauggggcuauuuuuuaauauugauguuuaaauauucauguugucaacaaucaacaagugaaucgcuuauuaugagucagguguuagguuuuagauaaagaaguauuucaaggugcaucaucucagcugggcucaguggcucaugccuguaaucccagcacuuugggaggucgagguggaaggaucacuugagcccaggcauucgagaccagccugggcaacauagugagacccugucucuauuuuuuuuuaaauaaacaaaaaauaaaauaaaauaaaauaaaauaaaaacauagcaaaaagaugugcaucaucuccggagcacugcuggcuguguacuucccugagugguagaagaugaagcuuuaccacuguagagugcagcuggacccuaguccuguuuccaucacuccuaauuguuugcccuugggcaggucaacaacugcccugagcuugugcuccucaccuguugggugggcgggaugguuccaccuagcucagagggcuagaggacacucccgcaggguccuugauaagaaucucagggacuaacacccaaccaccucuagaagguaugucuugcaaauccggcugaguuuaaugacccugacauauccuuuuuuggaauuuacagaggggaguguagucccaaacaucagaaagcacuacugccaacaaaucuggacuuguaaauugaucugcuuuucauaccacucauuccuacuucauuuuucuuccucauuaucaaugagauccaucuguuccuuaaucacaguugccaucucucaaacuuacaccuuucugcuuucuccacacauucucuauggacauuccuacauauaauagccccauucacuuuaaugaggucuaagauauuuaucuaagauuuagugccuugcaauacccaggucucuaggauggcuuagguaggaccccaaaagccucccaacuucugucaaccauaucauaagcccccuuuguuaaucuuuccaccaugcuauuauuggaaaguaauuugggaaguaaaggaaaaaguauggaaugucaugauuucuuuuuuuuuuuuuuuugaaacaaagucucgcuuuuuugcccagucuuggcucacugcagccucugccucccggguccaagcaauucucccgccucagccucccgaguagcugggauuauaggugugugcuaccacacccagcuaauuuuuuguauuuuuaguagagacgggguuucaccaugguggccaagcuagucuugaaaucaugaccucaagugauccucccgccucggccucccaaagugcugggauuacaggagggagccacugugcccgguggaguuucaugauuucuaaccaucuuaaacauacauacacacacacacacauacacacacacacacacacacacacacacacagagagagagagagaaagggggaugggaaagaagacaaauauccccucugcaauucccaaaauaacuguguaaauguuuaguauguauuucuuuauuguucaaaaaaaauuuuuuuuuugagacagggucuuacucugucacccaggcuggaguacagugggguaaucuuggcuuacugcagccucaacagccugggcucaagcaauccucccaccucagcuuccugaguagcugcgauuacaggcacacguuaccacuccuggcuaauguuuuuuuugguuuuuguuuuuuuuuuuuuuuuuguagagacaggguuuugccaaguuacccaggcuggucucgaacuccugagcucaggcuaucugucugccucagccucccaaaguguggggauuacaggcgugagcuaccacaugcagccuaguauguauuuccuuaauggucaauuaacgcugaaauagucuuuuauagauuuuugggacugauuuuucauuuguggagagcuuaaagaaagcaaccaauuuauaaaauauuuuauaagaugaaccauaaggaaauaauacuuguacauuugguucaccagagcuggguuaaccaaacuauguuguaauccaaauugugaguauaguaaguuuacuccuccagcguucuuccacaccaaacauucguuugcguauucuuccaacccucaccaauuucaaugaggaaaaacaauccccaauuuccaaacaggucaaauguuagcagguaagcaccuuuuccucggaugaaguuccugggacagcccacgaaaggucauuaaccccucuggggcacugcacugggggaacaacuucaaccacaacugucacucgcuucuacaacuguuuauucaggaaaguacauucucagguccaauguguaaaguuggaacaaaucuauccacccucaaccccagcugauaacucacaccaggauuucugaacugggaaacaaaggucagcugcccuucucuggagaggaggaggagcuaauuauaucaggcauguguguaaaaucacauggguagaaugggagaccuagacuuuggacucacaaccaaguucaaaucuuggcgccaucaaucaccaucaauguaaccuuguacgagauacuugaccucuacaagucuguuugcacagcagcaaaaugggaacaaguaucuacuucuuagcagguuagaagcuaugaaaaacacuaaagucuuagcagccauugccaagugcuuuccaaaugggguggagcuauuugcgccccuuaagaccagccaaaaagagcagccggagcagccauuuuaccucauauuugccagcauugaagaggcuuauucagacaaaaucauaauguggugggccaaagaugauucuuguauuaauuaguauuuuuugacucccugggaaguuaaacauaguuucacauauuugcagccauuuauaguuguucuuuugugaauuucauguuuauguuuauuuucuacaauuagggugaacacuuggggccuuguuccuccucuugaauagaaaugaaaauauuuccaaaaaugcugugacacaguuugagagcaugagugugagcucauuuccuguccugaggaccccagauaauuagagcuauugccuuugaccauauccacaaaaacuccugaaaaaggcuauguuuaggaaaacauuuuuaugauuuuauuuccaaacuuugaaguauacuucucaauuagaagaucauuuuccuaaucuguacauuaugcacacaaugaaaaggaaaaauuuagaaguuugaaauuuauuugagaaccuuaaacguaucugucaauugagugagcucagagcauugcuaacaccuugugagucucagaaagaaacuauagaaguguccuggggcuguucccugggcagugcauacagcacagagcaaagggcaaguccccuucacuccccucaugguucccuucauuucugaacaccaagguuuuggaaacugcauuuauuuuauuguucacuauaucuaauccgguuugggagaaauaauauaaaacaugggauauauaaaaaccuccuccaaaaauagauuagaaaagacaaucugggacgguuuucuauaugcucuuaagugaccaguacuuccccauccccaguuacuuaucacuucaauaucucaauaucugccccuagcuacacacaaauugugucuguguuguguguguguguauauauauauauauauuauauauauacacacaacacacacacacacacacacacacacacacacauuuuuuuuuuuuuuggaaacagggucucacucugucauucaggcuggagugcaguggcgugaucauggcucacuacaaccuccaugcccaggcucaagugauccucccaccucagccuuccaagaagcuggugcccaccaccaugcccagcuaaguuuguguauguuuuguagcaaugggguuucgccauauugcccaggcugcucucgaacucgugagcucaagcaaucugcccgccuuggccucccaaaguguugggauuacaggcaugagccaccacaccaggacacaaagcguauuuugaugcucuaucccucuucaacaucagccagcuccagauaauaaaaggagggaaaauuucccaggugugccaugucuuccuuucaaucaauacacaaacauuucauuaucuaacauguagcuaaaagguucccaacauuuugggcuuuaugagaggauggagaggaaguuccugcagucucccuacugccaacaaaauuccaaggcccccacucuagccaacuugcccuugguuuuccugagaauaccaagaagccaucugguccuccaaugcacacuauccauuucugccaacucaccucugcauuccccuacaaccucaucuucaagucuugggcucgucuuuaaagcuggggggacaccuacuauacagcacccuccacggaugaaguaagaagccuaccugcuuuugaagcucucagucucaccuccucuuccucucaucuucuuucccauucaucuucaagccugcccuauggcuccuacaaacaggcucccacuccagcaucccaaauacacuuucucccaaacuugcggcuccucccuuuccucuucuuuccauagccaggcuuuugaaauggguugucgagucuuugagguuccccguggugguacugagauauggaagguacaccgggauagaaggaggaggcugcuugaaacugcaggagucuggucugggguuccagcugagggggaggcacugggccacaccugagaucagucugcagcuuggcgccuuggcuauccuauuugggaagcacugagcuaaugucucuucucucuaccuuuaacaccaccacuugccuggaacacuucccuccaugggcaccaguaacuuccuaauagcugaauuccaaaagcuccucuuauuuuuuauuuuuauuuauuucuuagagacagggucucacugucugucacccaagcuggggugcaguggcacaaucauaguucacuguagccuugaacuccugagcuaccaccaugcccggacaaguuuuaaaauuuuguuagagauugggucuugcaauguuguacaggcuggucuugaacuucuggccucaaaauauccuucugccacagccuccugaguagcugggauuacaggcacaagccacagcaucuggcucaaaagcuccucuugacuccucgaucuucuuguccccucucucucuguggcaucuaacaccaaggacacucucuuuucuuucucucuucugucucucucucucuuucgcucuuauugcccaggcuggauucuuucuuccuuucagauggaguuucacucuuguugcccagguuggagugcaauggugcgaucucagcucacugcaaccucugccucccagguuaaagcaauucuccugccucagccucccaaguagcugggauacaggugccgccuccuggguucaagugauucuccuaccucagccuccugaguacccgggauuacaggcaccugccaccacgcccagcugauuucuguauuuuuaguagagacaggguuuccacuguguuugccaggcugaucucgaacuccugaccucaggugauccacccgccuugaccucccaaagagcugggauuacagacaugagccacugcaccuggccucccacuuucuuucccuccagcuuccaccauggaggaaaagaaagggggaggggagucccuaagugcuucuccuaccuuacccaaugcucccuuccauccuccuccaacgacuucugucccugcucuaagcaucccuucuccuacuucuauaccucucuuacaucagccaguuucaaucauccccucaacauccccucacaccuaacgugucuccaaugaaaccgaggguuccucccaaugagagccucucauagacugugugggcucugucaucgccaaaauauucaguaagcaucuguccaccacuggggagguagagacuggggaggccuccccacccacagaagucagucuccaggugccugagcuuggacaccaggaauuaacugugacaucagccacuuucuggaucugguaccuccccuccccaaagagguacagacaagaauccuauuuccucccaucccaccuuuccuuuccacucugcuacucugaagcccuuuucaccucaccccugacuccugugagucuaauugcucuauccccuuccagguccucguccuccaauccaccauuaucuuucuagccauguguacaagucacaucacuucccagccuaacuucugaugguucucugcugccucuuaaauaagaucagauuccuuccauggcauucuagguccccuagcccauguccuggccccuucuccuuccaggcaaauggaacugaaauaagcugcauuacccccaaaucgcccugaacuuuuccuuccuccaugucuucacucuccugguccuggcucccaccucaagaugagagugaaggaagacuuccacuuuuucacucuaaaugccuccucuuacuauuuacauucuucuaaauuaacaagaauuaccuggauuaaagaaugacugaguuuuaaggaccaguuuaaaccuacuucuucgaccugccuucuuggaucacccaggaaguaauuuuucucaauuucuauuaugaaaaugcuucuccagacuuuacuaccucuuaacuucuuauuacagugcuaccaugacuucuuuccuacuuaauuuuuaaauccuuuagggcaaagccugggucuuaucuuguuucccauggucccuuagccauugcccaugauagguauccaauagacuucaguugaagaaguuuaagaguuaggaauuaguuuuaagagugcaaaucuaggcugggcgcaguggcucacgccuguaaucccagcacuuugggaggccgagacagguggaucacgaggucaggaguucgagaccagccuggccaacauggugaaacccugucucuacuaaaaauacaaaaauuggcugggcgugguggcacgcaccuguaaucccagcuacucaggaggcugaggcaggagaaucacuugaacccaggagguggagguugcagugagccaagaucacaccacuacacuccagccugggcgacagagugagacccugucuaaaaaaagaaagaaaagaaaaaaaaaaagaaaaguguaaaucuaaauuucccuagguuggcauguaaaaggugucucuaaauuagaauguaaguagggccuuccuauuauagaagauuuaaaagauuuuccagcgaguuaaucauuuauacucuuuuuuauuucccaauuauuuuaguaacacugcacaucacuguaaaggcuggaauacgcuguuagauuggguggggguguguguguauguuuugcuucccuuuucuucaagaaucccuaaaagugugaucaaugaagaaugugaccaaacuauaaccuuccaaacuuauaacaaaucaagucagcuauucccugcccaauccacccaaccaaagaaaaaagauugacagguucccaguccuucccuacagaguuugucaccaauaucaccccagcaauccaagggcgaaaacuucagcaacacaggcccucucaaaagcuuguuccaugugaaaagcccucauuaaacucugaguuauauuuagaaaaaaaaaugaaacagaaguuauauuuagaugaaauggcucaaaagaauuuuaccaaaagcagcauguuuauacugaucuuccaaaagaaaagguuuccuuagcuuuuacauacaacuccuaaaaacagacaacuucuucauacauauacauacaaagauuucugcuuggguuccuuugggucugaaagaacaggagcucccaggauaugagcaagacugcccaugggaagcagugggauauaaaggacuuaaaaaugagcacgcguuugaggaccaggacaauuucauacacaagccugagaugagauggucugagaaauaauaaagcaaagccuuucgugugcuugugcugaacgaaagagguucuguaauuuauaagauggacacaaaaaccacagacucccucagcaauacuaccuagaaguguuucuuuccaaaaugucaucagcccucacuucauggucacagucaaauuacuuucuaucacauuguagcuggcuugcugaaccacauucaacauuuucuuuuuggcucuucuuugucuuaaaccauuuuuggcauucacuuucuaauguguugacuuacauuuucuuucuuucuuuuuuuuuuuuuuuuugaggcagagucucacucuguugcccagacuggagugaaguggcacaaucucagcucauugcaaccucugccucccggguuuaagagauucucaugccucagucuccaauguagcuggaauugcaggugcucgccagcacgccuggcuaauuuuuguauuuuuaguacagaugggguuucaccauguuggccaggcuggucucgaacucccgaccucaggugauccgcccgccuuggccucccaaagugcugggauuacaggccuaagccaccgcacccagccaacuuacauuuuccuaacaaaauucuaggcaacagccccaaaguaguuuaguaaaccgugaagccuuuucagaaaugaauguauaauuuugaggugauuauuugaaaaaugguuuguggcaguuauuccucucuucacagggucccagggccuccagacaagaagcaauugcagcucacagagacuuggcccacaucccaugcugaggggaccucuucucuaaagagccucaggaaaaagccacuucccagcaucccagccaaaccagaguggagggcaagggugauggcucauggggagagauggccagacuguaggaugggccagcccccaguggucucagcaggaauuaugccagugggugaggcugcugaagccuccugccugcuauuccuaggguucauuaacacccugaaaacaauccagacaauucccacuucugcaucuggcuugguauuuccagaggaaguguuagagcagcagauaacuggggucaccuaauuuuauacuaccucuaggccuuagagcagcaaagccuaaaguggugcaguuuagaggccaaacaauaaaaaagaccuaagaugucagagagaucggaucauauaucccaggcacuuuccucccuccucccuccccacucguaucuauccacauucauuuuaccaggcugggaaaccaacagagggccacuuugucuguaccuaccauuugccuacagugacaauuaucuuaauuauauuaauagaaucguucagcagaaaaccaucaucuccacccuauaguccagacaaccaagugcuuaaguguuuccucacuugcuuuacuuacuggcagcaaacgaacagggucaaauuagguuuaacugugcugaccuaagggcaggacacuuccccaguauauccgugaacuaacacagcgaaaggcacacagagacacagaaacacugggaacugaacuaacuucuguaagggcaagucaccagggagacaagauguagguaugggggugggaugggacauacuaaguccccaagaaaguacauguccuaggaggcuugaaaggaggcuggugccugggccagggcagggaacaacugcagagaugaacaaggacagucagagaggcaugcagagacgaaagguuggcugccucaaggaggggcuccaaaaucccacacgggccuggauuuaguaaucaggaaucuccaggaucagcaagaaucagccuuuggaaguucuuaggcgaaagaacacauaaugugauagaaggaaggaaggaggggacacuaacaaaaaucugucucacuuggacugucagagagagcagacagcagagccuggaugaaucaaaaugcccuaaagagaaaugggugcauggagaaauagccuugagggagccauagucauauuugauggugaaauagucauuucuggugacuuuaacugcaucaggacuuggcugagggcugaugcacagaugcuagugccucccagaccccucucucuagauauccuaauaguaaauggaaaccugagacuuuagcggcauuaacucucccccauacgcaaaguuacacgaaucccaacaaaacuugcagaacuaagcuacaugugugggcacuggugggaaucacugaaaaccuaaauaagaccgcagcagcucguugaucccccccccccuuugauuggcacgcaccucuuuucuuuuaaugagaaaaagcaacagccauagacccacauccaguuuucacugcaaaacugacacuuacauucaggacuuccuggggugcuccaggccagcagggccaaagcugcaagaccucccucccucucggggcaaaacugugaggucuguguagucccacuccccauuccccucucucucagucagagucucuuccaccgccccccgucaaucccccuccaacccaucuggugaugguagcgcccccgcugaaccaaauguggaggacuuggcucuccaccgaccgcuguacaaugacagcaggaauggccauucagcaccuagccuuucucuagcacccuuuaauuaucgucguuauuuuagggcagucuuagcauaaaguguguugcugggacccugcuccuaagaggcuaacacucccugcccccuuacccaccgucgacagcgaaguggcaggcaaugggaaucugggcgggaagcaaagaacuacuacgauucacaucgcgcccaagcagcagcacgcgggaaccuggcacacaguagguaggcguucacccaacaucugucaucggacccagcaccugggcagggagccuagggguggaguggcggcuugggggacacaaaggccucgccagcccccagcugcgccccucgcaacgcggggggcgggaguuuagagccagagagagggggcgaaggaauccgcccucauuugcacgucgucuggggcccggucaauuugcuuaaucaccgcucuaaaugccagcgggcagcacacaauacgcgcccauuaacagguuuaaagugucgcagcgcucgcuuuaaaugagaaaagcaggcgacaaaagggggaaaaagccaaguuccucaacuugaagaaugccuugggucgccucgaaaucaucuacgcgaguuuaaaauucggagcuagcuccgcagaaaagcugaggccccggugcgagggcugggggugggaacgggggcugugaauaacccgccacgaaaacuggguuucuuaggaaccagccugcagccgcccagugaacccggagucggaggacaacgucgccaacccagcucccuaggccccuugccccacugccagagaaagcugaccgauuuccaagaaggaaagcgagacccccccaaagcgggcacaaauccaaguuuccuucggugcaggcgaagaauucuggaggccaaggaagaucccagagguggacuccaaaaccucaacccgcaagaggggaaaaguuaaaguaacuuuacuuucauccaggcacuggccagcgcagccucgcgcucggccgccagagaguaguucaacuccgcaaacaaguucugcuugggaucggcgcagaaggccccaucccccacuccauggccaagcccgggggcgcauccugcgggccgcggccucccacccuccccggcgcgcccgacgggcacucacggugcgcgcuccuccgggagacagggguccguuggagagguacgggcugcucagguccgggaucaucaggaagggguacccaggguacggggguccuuuaaagaacgcgcuguccugaggccuucucacugcgaacaagaccaaggcgaggugaggcccaggcccccgggacugacagcgccgcggcagggggcucgaggcgggagcuggggaccccagcgccccccacgcgcgccccacgggggcugccgccaauaaaggcggagggcaagggugcguccacccaagcaagggggacggugggccgcccgggcugagcagcggagcgcagcgggaaucgagaguggggggcugucccagcgggcacauaccuucggcgaaauagucccgcggcuucuggaaagugucccggacgggcugcgggcgccucuccgccugcggaggagacacaaaggcaagagcgggugagcggacgcagggccgggaucccccggggguggccgcggugcuuccuuaccuccgaguccgagcugcugcucugguucuccgacucguugaccagggacgacuugaccucgucuaggucccgcugcgccgaggcgcuaucgcugcucggcuccugcuccucgccccccucguccuggaaggggaucagcucgucguucgccccgaggucguccccuccgccggccgccccggcgcuggagccgccgccucccccgcugccgccgccgccgccgccgcccccgccgccgagcuggggcaugguggggccgcgggccggggccgccgcucucggagccccuagccgcccgcgcccugcccggcccggcccggcgccccucccgcccgcuugcgggcccgcugcgcuagccgccgcaacaaaguuugacagggcguggccccgcgggaagcgggcccggcgcugcccggccggggcgcaggcggcucggcucgggccccuccggcagcgccgagccuagggcucccc
